United States Patent 6,812,339 (POLYMORPHISMS IN KNOWN GENES ASSOCIATED WITH HUMAN DISEASE, METHODS OF DETECTION AND USES THEREOF) - sequence listing, part 35

SEQ ID NO: 13614 - DNA, 183202 bp, Human
  misc_feature (1)...(183202): n = A,T,C or G
gctgagcagctgggataaggctcccactatctgtgaccttgaactggaataaatgagttggaaaaatgaataaatccgtgaaacaaatgactgtaaaataaaaatatgtaagtgtacattaatcataaaaatgcacgacaataaatgagataggagtgcactcagctaccatatttgtgattgtttttgaatttcatggtagcagcaggtcctacaggcaacttttgctttgcaaacacttattccttgacttaacccagcaccacagcaaccatcgctcacttaatcactagaaatttggcaaaccattatcttgtttttatcaatctttaaaaaatgtaggtaggccaggtgcagtggctggtgcctgtattcccagcactttaggaggccaaggtgggcagattccttaagcccaggagttcgagaccaacctgggcagcatggtgaaaccccatctctaccaaaaatacaagaagtttatccaggcttggtggtgcgcgcctgtagtctcaactactggggagtctgaagtgggagaatcacctgagtctggggaagtagagcctgcagtgagctgtgattgcaccactgcacccccagcctggttgacacagcgagaccctatctcaagggaaaaaataaaaataaaaaagaggtatagctcacatttattttaatgtttaatattagaagtgttttgaatttttactttgaagttcggtgatgtttttgtaaccggaaataatgctgtaggaacttaactctttttttatatgtcagcctatggcaaatttggttttgttatatgttgttttgcttaaggtgacagtttccaagaacctactccgtgaggactggtgagctgggtcagagtaaatagcacaggatgacgactgcaaggacgatatgggggcagcagggttttagacatacttggaatggcagcttcctgaggtaggccaagtattctcagcataataagggctacatttaggtgtatctggaggaagacggtgaacagatttccacggacggtgagtgcactggaaaacaggcagggatggcaagtaccatagtgatggattggaagaaggtgcactttggggcatgattctactggttaagccaagggctctcgatgaggtccgaggttcctgccccgggcacggagtgggttggcagtgacagcccagcctattacgtgggagtctccctcttgaatggctccaggaggcccatatcgagggtctgaaaggccagacggttatccgcacaaaagtattaagttcatttcagggactgacccggcaatgtgcccgggtccttcccctcggtgctgggaagccctggtctccctgcagcatttcacacctggctgggtctcctgactcgtggcgtgggtgagtgcatgagcctccctccttcgcctgatcgacgcctgggggctcctctccccaacctcctcactctgcccactctgtcctctccctccttggggagcggcaggggacgcctagccggggtccccaggctcccgctcgcaacccacggcctcctccgcgggcagggagcgaacgcccggtaggtcgcccgcgcacagggggcggcccggctgcagcggagccggggcgggaaggcgcagcctaacggtccagctgccgcgccccgcgccccacacccagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggcgggcggagcggagcgcggcgcgccggggccgccgccggggggatgcggctgcctccccgggccggggtgtagagagggcgggtccccggcctcgggagcacggcggtggaggggacataggaggcggccatggcgacccccggcaacctagggtcctccgtcctggcgagcaagaccaagaccaagaagaagcacttcgtagcgcagaaagtgaagctgtttcgggccagcgacccgctgctcagcgtcctcatgtggggggtaaaccactcggtaagggctcagctgcggcgcgcggtccccttcctcctcctcctcttcctcctcgttcccctcctcctccggctgcagctgctgcggggcggggagccggagtcagccctggacctccggctgctcgcccgcctcgaagcccccagccccgcggcgcgtgcccccagccctctgggccgcccaggcaccaccacttgcgtcccctttagatctatggcccggtgcgggtcgggggtcccgtgtgcatgtgagtctcacggtgggtgccagtgccgcccccggtccgcccgcccgcccgcaggtcggtccccgcagcctgggaggtaggaagtttgtgcggggcacggcgcctcggctgtcagccccggcgggagctgctgggggccgggtccgggcgaccgctacccggtgtgggggccgcgcggcgcccgcgtcttccgcttgcgggcaggtgtacctgtcccgggctgggcgcgtgcgagcctcccactggggcactggggcgaggataccggagcgcgagcagatttggggcagcagctttagtgcttaggtcctttctttttcctttaaaggcaatattactgggcacaagtcggctttttggcaaagcagcagccgatgtaaatatggctctggcgtcgggcggcatccctgcgcttctcccgcatcgccctgccgctgtgcgggctggagagcccttggcggggagtcttcctcccttcgtcgcctccccccactttggggagtcaggcagaagtcaccgactgcggaagggcggccggggcggggacagcaggcgggggtcccggcgggcgcgggcggagggggtcccgagttggccgcacccgctgtggggggtgtgggaaaggctggagaacgcgtggaaaggttagcgtcacgcacagtcggggattggaggatgcgccgctgcgggctatgcggactgcggttcgagggtctgaaatagcctcctgctgatctgacagcgagaaactcctgcagttttaatccacttcgataggatcaggaaacatgatcggagctgttggctcagccaggaaagtttaaacgagctgtgaattttgaccatgaccttagccactgcagtcacttagcatctggggaaaagtgtaagttcgctttccctgcttttgatttcgatggatgtctgtatgtccttttcagcgtaatggaaatgacagaaaaccatgctggtttttcggaaaacacacacacagacacacacacacacacacacacacacaccctcaatgtagtgaagttgtttaaaatgcctaaaagcatcgtttttgtatttttcttccccaagctgagcagggggaagggcaaaacagtatcaggatcgatcgtgtttgcatggagtgagtgtttttggaaaagttgagaaatgattatttttatccagcttaatgactgactcactgaagttcattttaacttcctggcaacttctttagctatttgggaatgtaagttgttacaagagcatgcattactgcaccaaaaactcctctctcaagttttattacggaaaatgaaatgcaatttttcctaagtaataagtttacaatgtagagttatgtataattttgttaagctcttttattatttatgttagtagtttttgggtcccttattactagaatagaaacttacaatttaaaaaaaggatgaatactgtagtgcttactcatatttatggtgcttttatctcctttggagttctggtgttttggtcaggagagtgtttctgtctcggggtttaatttagtaaggtagtgtcaacaatatgctgccgaaaaagagtgtgctttctgggaactcgtctgaattccagtttgccttaaaaaatcttgtaattgtgtatgttttactgtaaccacttacgttgctaccttatatttatgaattgctacatttgttttagagtttcttgctaattggaaatattttgaaactacttaagtgtttcatagtgtatgacttgtaaatagtacatttggtgttattttcttttgctctcaagagaagttggcagttctaagtatccacaaccagaggagtgaagtttccatttcatataaatgtaagcatgttactcattcaacagatatatattgggcacatacagtgccagctactgtgggaagaattgctaaaacacctctaatatttttatccaactgtctttattttgagggctctgagttgacataagaaaggtctgtttcacagccttttttttcaaaatgtctattttctttactatattatttttgaaaaaagaatggaggtgtaatataaacatgaaatctaaaacccttagatgccatgtatttctggtttgatttcattttaggtgacaatgtctgatattagataaatgttttatatgaccttctgtgcaccaaagtttatagtataatgtgagaataaatatgtcagcagtcttaagaacaaacaagcatggtgttgtatacgagcatcttccacatactgtggtaaaacgctcattgaatctgcgctttaagtttttcttaaattctaactgttgaccttgggcatgttaaggtcaggttttggcatcagtgtttgcatctgtgaactgaggttgtttggatgatttccaagtctaactcaagattctgttttttcagtctactaggtgcacagtgttatactaggatttgtagaatactatataaaagttgtcttactattataaccttccaaatgcagcaacattcagggaattttcaagaccttgactacaggggaaggaaatctatggtgattttaagagactgtgaactaagggtttgttatattgaatgtagctgaactgcattgcagtctattaagccaaagtcgatttgattgaaacataacaacttgcaattaaggtgaaaatgttcaagtccattgaggtggtaatgaaaatcttgatttgggcaatggtcatagtcgggagtaagcctgccattgtgtggttaatttgatatgttactgctttgtaacttaaaatacccatcagtgaatggatcagtgccaatttttaagtattttaagcagagaatataactgaatacataaaggaaaagacttaaggcagttttgtcttgttacatttagaattaaactaaaaatgatcaaacagtaagcgtcttaagatgatattttaatagtgtggggaggatgttgaatgatatgagccaagacttgttttaaatagatactctaaaagatttttatccacagtgaaatgtgagccttttagaaattagtattttaaaacctatttaaatatccaaaggaaaacattatctgtatagaaaaatcttaaagcacataaaacttgtttaaaacatgtagcatttagaagtagctaagtattgatgttagaggcttttggtttaaagctgtagaagttgaaatgagctttggcaaaaatgtcaggtattgaggggtttggggggcctatcacagtagaaggaaaggctggtaatggaaccatgtgaagagctgggtgcttgagtgtgtgggtgtgtgagtgcgtgggacttttctgtaccctttggctcagttctccttcatagctggctggttcctccacagagcagggaatgaacggttcctgtatttcacattttgtcatttctgctcccccaaaagggtttcctgtctctaattcagttataaaaataccgtggaaggattccacttgggattggtctggccttggtcatttgtggccgtcccttggactaagcagttataaaaacatggcagcgcttgcctgttggcgttggggaaagaacagtccccagagaggggaaagggcctgccaggcagtttcaggcaggtctctgtccgagtaatagagctggatggttctggacatccgtgggtctttaccgtgggaatctgtgagggccagcctgatgagcaccatgtgctgtgttgtgtgtggattggagaattcatggtgtccttggtggagcgtcagtagctttgattatattctccacaagctctggtttttggaatagacaaagaccatattggatacatcataatttttttttttttttttttggttcatgggtttttatttgggcactgaaagaagataaggaaactaagttttaaagtgatttgagtgactgtgaaatgactttgactgaataggacataataaggcaattacattaaaattaaaattagacattagatgaaattattgagtggaacccagctaccattcattcaagaactagtctcctcaaactatttttttgttctttttaatcttcagaggaaagaaacataccaagcagacatacagaaagtttattagggaagtcgttttatactccttaaaacttgggattataaccagagaacagaatacattttcctctccatttgtcagatactttagagtgaactctaagtatttatacttagtacttagtgttacttagtacttacagttactaaacttcagtactcagaatgatgccccatgtcaggtcagtgatttctatttccagggtatcctgatctgctgtgtctttagataggttgccggcaagaattataataaaccaccaaaatctgccttaagttgattagaaaatacaggcaaccagagtaattaattctgccagcatagccttcgaaatacaaattttggaattgaagggaattggtgcaatttggcaaaaaaggtttgtggttagacagatgaggttcaaatgctaactttggaactgatgggctctttgagcaggtgatttagtcacttgagcctcaattttcacattcttaaaatggagataatgatatgacttcacagggttgagagttaaatgagatactgtgtttaaggcctagcactgtaattagcacatcataaggattcagtaaatgatgcctaaaagtaataaagttcaaatgcagtttggatggtgatatattaaaagaaccagatccctgtttctcaaaatttaaggtgtttatcaatcggggacttttaaaaaaaaaaaaaaagtctgctaaattaggctctgctgctgggtaggtggctcatgcatgtaatcctagtcatgcattgggaggctgaggcaggaggattgcttgaggccaagattttgagaccagcctgggcagcatagcaagaccctgtctctacaaaaaatgtaaaaacatagatgggtatggtggcacacacctgtagcctgaactactcaggaggctgaggtgggaggatcatctgagtccaggaggtccaggctgcagggagccatggttgtacagtgtactgtagcttgggtgacagatggaggctcccactaaatgtgaaacaataaaaattaaaatgcagtgtctaattcagcagatctgttgggagtgctgcctgagactgtgcatttatcatactctcgggtggtactgatgctgcaggtccacaggctacatagcagtagaaggaagaactttaccactaaggattcctcccccagccccaactgtatgtgatgagcccttagaagaatggtggccccatgatagattagagaatttgggagaagaaattgtaggttggaaagggacacaagcaatttagatttaagaatgtggaattgcaggtgatggtggtgggtggatcctgcagttacagtaccatgtaggatgctggaaaggtgtgattggagctcgggagccactagggctgggatagaccattgagacctgcccgtacagaatcggtaagtcagatctccaccggaggagcagggacactggggacacttggctttgagggaaggacagaggaagaagaaacaggaggagaaaacagaggtcggcacaattagatgttcccaagtgcttgaaagtcatggctgtgcttgtggttgattgcgggtggctgtgaaagcttaaagacttaaggagtgaatgagtggaagtagaggcaattcctcttttttggaaggtaagtagaaggaaggtgaaagatgccattttgttaggaatccctggggagtttccttgaatccgtctcttcgtttccattctcacttctgtcactcctaaccagatttgtttccctctttcctagactgatattaaacccccctagcttatttccctgtgtctgcctttatcctcatttcttttcttttttgtactaggaactcctatggcagtccagtgaaggccatagactcctcagaatgaggcttttaaaggaataaatgaaaatacagaggatatgtcctagcaagttcaaggatccttttaattctatccatggaccacttgggagttcatggaaccccatcaagaacccttgcaagaataagatggggatagtgtggggtgagaaagtggggagagcacgcagcagccaggaagaattcttgggggggaacacgcataggctgaattgattacccgcctgggtcacagtgcctagtacttgggattcacaacggtaccgttaaccactgagctgtgctgcctgggccaagctcaggaatcattcatttctttgagttcttttattttcttagtcttaagagctgttcttcttggatggacagagtattagctgttaacatgggagaaaactacttgaaaaccagtttttcccttcatagaaagaaaatcattgttaatgttcagagcatgtagggagagaaccagtacataatttatttaagaaaaatgttgtagggagttttaaaacagtaacttacctaaagctaagcctcacaattctaaatctttatagtttttcagctacctgggcacagtgattaagagctctggagtccttgttcggttggctatgtgaccttgaacaagttattttgcctctcagttccttgattataaaaggaggtaataatggtacctactttggaagtttgttatatggattaaatcaattcatacttgtaagatgcctaaatagttgctggcacatggtaagttcttaatgtgctagctgtcattattactatcctttaaaatagagacagggtcttgctgtattggccaggctggtctcaaacttctgacctcaagcaatcctctcacctcagcctcccaaagtgctggaaatagagccttgagccaccatgcctatcctatttttttttttaatatcttaaatgctaagaggtagcaaattatcagattgtatgctaaatcaatggttactttatcctgttttgtagtagaacatcatcgttgttcttggcatccttgtgtatttttgagttatgaattatcattttagaattacccttgtgcccttgctttgctttctgtatctattttgttatgttctttcttgtatttttcacacttccactagcgattaggttctttgaagtgtcagaaatctaattcacatccattagttgcaagttatgtcagctattgacttgatatttcaccttgtctttaaatatggagacactgcaagatgcttcagatgcaaaatgaatatattgtggaccttgctctcaaattgtgcataactacaggggacacagacgtaaaataaatatatgtgtaaataactacagtgtccagaatgctaggggtggaaggtattaaatagaccgtgcagaacattgagcaaaggcatgacgtcggtgaagggcttagacatgaggcagtttgggagaagagcatttcaggcggaggggtcagctggtgcaaaggccgtgaggctggtgtttgcttggcttgttatggcaactgcaggaaagctggcatggctggagcacagcaagagggggatatagtggtaggagatctgccaaggtgctaaccaggactggatcatgattacttctgcctgggggacttggagaatccttgagaggaggtaacaatgaggaggaccttgaggattagatagaatctcccagctgcagaagatgggtgatatggtttggctgtgtccccactcaaatctaatcttgaattgtacccataatccccaggtgttgtgggtggatcagctggagataattgaatcatgggggcagttttccccatcgtattctcgtgatagttagttctcacgagacctaatgattttaaataaggagcttctccttttgctgggtgttcattcttctgcttgctgctgccatgtgaagaaggatgtgtttgcttccccttctgccatgatcgtaagtttcttgaggtctccccagccctgcagaactgagtcagttaaacctctttcctttataaattacccagtcttgggtatttcttcacagcagcgtgagaacagactaatacaatggggaaaggcatatgcagctgagggtccgacagcgggcaaaaccaagcagagcggagaatgtgagtagttggctttgggtgtggccacagtggcagaacccagtaacatgttagaaatgcagagcttgggcctctgcagacctgctggagcagaatgtacattttaacaagacatgttgatcgtcagcatatttaagtctgagaaacacccatcagggtaaatctttggtttcaagccctgagattccttagatgtgcctcaggggctggtgggagggggccaagctggtgggggaatttaggcctacctcagtttcctccagaacagccttgtttttgtcctcattgtcatctctctgtccttttttttttttttttttttttttttttttttttttaactggggtactgaatataatacgtaaagggggtaaaaaagatcctgcagccaagaaaattgaaaaccacagaggaacataaagggagtgtcaggagatggttgaaagagtagtttgaggccacctttgaagggccaagtggttgatgtttgccagagaaaagccagcagttctgaccagggttactttaaaatttgccacaaatctcaaatgacactcgacccggaagtgttactgcctcctttaatatgttctccactctctgaagtcatttcttccttttcacttctccttgaacttcacctagtgtcctgtcccccacttcccccaccccgtccttccctcagcatataacctcatttagaaagcattgaacaaatagaagccgtcagcttccactcttcccaccatcccatctaaattttggacagctgggtccgtcagtctacagacatgctggaggggctgccctgcctggttttgtagctgctagctatatatggcaatttaaatttcagctaataaaacttaaaattcagtttctcatatcaagtgctcactagccacatgtggttagtggttactggattgaacagtgcagatatagacgattcccaccattgcagtgtcttccactgacatggctcaccattccggggccgcccatcttgaaagcaaaataaactacagtaacagcagaagctctccttcacccttagtctctcattttagtgtcttctcgtgttttctgttccttttttttttttttttttttcagatgaggtcttgctttttggcctgggctggagtgcatggtgcaatcatggctcactgctgcctcaaactcctggtctcaagcagtcctgcttcagactccctaagtgctgggattatacatgtgagctaccacacctgccctgttccttttcatagcaggagtgaaaagccttgtctaaagctgaggtctcctatttctatagagacaccgtacctggcaaccgtcaacttacctgcgatgatctccttaacttaccccaatctagctttcacctccagcacacctaggaaactgctcaagtcagcatcactggcagtgctaacattttcaaatgcagggggctcctttttttttgtctcttgttttccttctgcttcactagccactccttaggtgcaggctcctcttttgctcagtctggaaatgttggaatgccccaggcctgtgtccaggatcatcttctacaattacatttactttacctacatgatttcatttagtctcatggctttttataccattttacagtcatgattgagaaatttttaacttcagctctaactttcctcttgggctctatatgcagtttcttaccaggtatcttcacatgaatacctaatagacatctcagatgtcccaagcaggcctcttgatttcctccctgcactctgccccgtcccctgtcataacttaaactggcctcttcccgtctcagaaaatggaccaccatagacccaggtgctcaagcttaaacgtagggagcaaccttgattatgcttttttctccccactccttctccacatccaatttttgagtcccgaatccacatgctttctatttgaatcttctttctcaggaacactgtggtagcctcctgtttggtctcccggcattcagttttgccctgtttcagtccaccttgtctgcagcagtggcagaggaatcttgctaaactgtagatgatttcatgtcatgtcctcagttaaaccttccaaaggctttacattgcatttagaataaaatccaaaccttttctgacctgcaggatcttactggcctgggccccactttcctccttgccctcatcccataacaccctcttcatgattcctatgttccagctgccctgcgctttttctgttcctaaaggcaagctcagagcagccacagttcttcagtctttatttttctcttcgtcgggaatgtttttccctcttttatttatttatttttttatttgagacaaggtctcgctctgttacctgggctggagtgcagtggcatggtcatagctcactgcagccttgaagtcctgggctcaagcaatcctcctgcctcagcctcctatgtagctgggactacaggtgtgcaccaccatgcctggataatttttataatttttgtaagagatggggggtctcgctgtgttgcccaggctggtcttcaactcttggcctcaagtaatcctcctgcctcagcctccctaggtgctgggattagaggcatgaaccaccatgcccagcctgccctcagatctttggatggttggctcctattagttattttagtctcttagctaaggggttgccttctcagatggcctctctgacctcctaagctaagggagcccctccactatcatactgttattttctctgtgacacttaacactgtttgaaactgagttgtgtacatttttattgcttatctccctcaactagaacaataagtttcatagcaactgagactttttcctatttactaggtgtatccctgcatctagaacagtgtgtttagatagtaggtgctcagtacatattgttgaatgaatgagtggggctgggattctaaaccgtaggccattagttctcaggtggtataccatgaggcctcccatattcaattttcataaacatagaaagttgacttttgttataatcaagcatagagcattttagagcattttgctgagcgggttgtgcagtgtgttagagagtggggaaaaacttgctgcaaattggtgataagaggtatggggtaactgcaagccagtgccaaagaaagaggttatgtttacagcagcatgcaagaactgtgtcttgtgaacacgacagaaaaggttcagaaagtaaacaacttctttcaaacagtgtcagatgttgaagggccgccaagtgaactgcgtgaagactatgaatgcatttctaagtaatctgagatattatgttagaagagtgtgctgcagtgttattactgacttgttcttttaatggcttcagacatgcctctaaaaattgtagtattcagaagtgtaccataagttaaatttaagattgcataaacattgtaagaatagggataatgtcagtatctcagtcctttgtgggtctttttctattgtgtattgtttctgctggttcttcttcatggtgccttgttgccatttatgtttggttcattttggctctgagctgctcacttccttggatagtcattcagggaacattcttcaagtcttaagataaagatgtatccttccagagagaattgtttgtttttgccacatggctagggatactggagaccaagaccatttgaaactaaattcacagcttggaattttttggacctcatggtgatataaaattgggctgcagtccctggggtggcatggttttatttttggtagacccattgtagccttatggagaaaaggtttcctattagacttcacaccttgggtgggccctagtctttgtcttctgttcctgtcaacccatgaggccatcaaagcccttagagccaaagtggcttccatgactaacttattcttcctgcttccagttttcactaagatcttgacaggccgacttctctcctccctcttccaactctttcatgccttcaagaagatgtttaagaacatattttattcaggacgcttacttattttcagtgcagagctgacctgaataaccctgtcagcagaaatgcaaatcaacctcaaagtttcaaaagagggaatccaacagtaagtgagacagtgagaagccaaagcatggtggcacttctgcagccttccagggatggatctgtgaggggagtcagtgggacaggaggtgggactgcaagaaggaagaatgccatttctgtcttccagaggtgatgggaacctgagcttgggcaggggtaacagacattgttggataaccaggtatagatgtggtagaagctgtgttgtctaagtggcccatagcctaaaaggtttgaagatactgctgtaaacaagcagacaaaggatgtgcttagagagatttcaggtagaatcagctggatttggtgactgttaggtaacaggaaggaatcgacagtgactcacctaggtcattttcttaccattcacactctccattacattattgttatttgggggctgttagcttctggcgggatacccctgcccctcttgccacaactgggattgtacacacagatactgtgagacagaagaggattaataaactgccctgggagagttagtggtaggctcttgaaattcttcaagaattgaattagcgtggtggatggagaagctggagaaaacatgttacaggcagagtaatgcatagaaaagcataaagggtatgtggcatttccagggaactgccaaacccttcttcaggtgcttctatacttctctccttctgattttatggttttattcatttccattcttatggacatgttcttatttaaattacttttgtttgtgtttctgtaggcttggtcatttaggcttagaaacatatttgcaagttgctagacaccctaacattcagagcttagtttatttgtagttgtaataaataagccttgcttttgttttttcagcctggactttgaggaaggtgttaggtattagtcaacccgagaatgacctctgtagcattctacatgacctgcacaaaggctccaggtggtaggggcaggtgggggctgacgtcagtattgccacctgcacaccatagcaaggggctgcattagcgggagacaggcaccctttttgtgagttgtccgcacagaggaggctcattttctgatgtgcacagaggtgcctgtgtgctagcagctgccctggtttgccttgcttttctcgggtcatgcatccaaaatttctcatgtcacgttcccaagcactggtgtctttggaggagcgttcaggtggtgttcagtctggacagaagaaaagaaagtggggtttataaagtccccttatagatttgaatctgctttagaaaatgcaccgttgtgcagtctttgctgctgctacatacatgcttctataatgcagattcacttgtatgagatcggtgctatcgggaatgtggtgtaggatgtatgaattggtccataagcagttttccttgagtatgccactgcctccaagtatcagcagctaggtgcaaagtacactaatacagctcaaggcagcaagccaaattgagaaacaggactgcataccttgctcttgtatccgttttcttcctcctgactccagcaggcttctgctcgatctcagaagtactcatttcagggttctctccaatctctggacattttctcctagtctgtgtaacttagaagcttggttactccttgtattccttccatcaaatgatcctcacctttgtgtttctaaagtccattatatatctattagaaattacactaaaatactgtttatttttctatttttaggatttttatttttaagcattctggtgatagagtttcatagtttttcagtggtctgcctaaaatctggattttagtgtctatgtagaacttagaaatttttcagaaatacatatattgcattacaataaaagtgtttgtatttacaatgtattttgaacaactatatgcccaggctgcaagtttcccaaagaaagatgtaatcgttggtttttttgtttccaaggataaccaggtatagatgtggtagaagctgtgttgtctaagtggcccgtagcctaaaaggtttgaagatactgctctaaacaagcagaacattaatttatttgtcggccctttgagttttcttactaatcctcttctggcctgaccatgtgcccctcccaagtttcgcacattcccaggtatctagtgtgttcagttgtctccctgcgctactcagcagctacctttttcagcattggccctagcttgcttctgtgcccaggaacaggaacagaagttttcttctcaggggtcccctgtctctcttagaccaagtccacaggcttttactacattaggccttggagtacatttcctgtagaatcaaagggccaacttacaaatgaatgtttggaacacaacccattcataaattaggttctgcctgcacccagatggaaagttaaatgctttggcatcagaagaactgttgggaaacagatattgtttctgaaattatgataaatccataaggcactttctttttggcacgttgcgccaaagtaggaggacaggagcaaattttagggacattaaaaaaataggttaggagaagctaatctttttgtctaattcactttctcttgcagttctggcatcggatactcacagatttaacacatgccaatgaatatttgagccaggaaatagccaatagtgaatatttttattatgtgttagataaagcttctttcttcttatgcttatttaggtgaactagaaatatggtttcagtgaaatttaagttctgataagtacagatacatagcatattttctgaaaaatttgaaaaacacacacaaatataaaaaattaccataaccattctatcaagcaaccagtgttaatgttttaatgtttctttccaatgtctttttaaaaaaatctcattgagactattctatgtatttaatcttactatgtattcttaacaattattttaaatttttgatcactgcttaataattaggttggtgcaaaagtaattgtggttgttgccattactttcagtggcaaaaactgctattccttttgcaccaacctaaatagtttaatgaagtttaatagtccaaacattggtcccagtattttgccaccacaaataatgttgctgtcagcatctccctgtatgaaactctttcttatttaggatgatttccttagaagagattctctttttggggaatttacttggtcaaagggtatgaatattttaaggctcttggtacatgttgccaagttgctttcaaaaagggttataccagattataaccctagcagtgtggctaagagctgctttcccacatcttctgctttcagggttctaaattgaacagcaaagattggaataaaaagatatccttttttcccatatgcttttaacccatttaaatctctttatagagattttcagcagtttgaccaaagatgtacgcacatgggcagtgtgggagtatcaggtctgaggttggaagatggcttccacataggctgcctggcccgagtctgccctctgaaaagagctgctttcaactgacccacttctcccagtttttcttcgtcggactctaagcagagagtgcctgcatcccagaagcaggtcgctgtccactgtctgtggttggttaatttttgctggccatagcccacatgatttatattaaactcaatccaatagcatttaatggcaggcagaattcttcccatgtaagtagactagtcaggaatttgcctttcattatcctcggtctgactgcttaacgttagactcgacctatggacgattcacatgaaccgtttcagaaaatgtaatgtgacatctgctagagtccacaattacagggtgtgtgtgtgtttgtgtgtgtgtgtgtatgtgtgtgtttaattttttaaaaaattttccgagatgcagttttgccctgttacccaggctggagtacagtggtgtgatcatagctcactacagcctcgaattcttgggtacaagtgattctcctgcttcagcctcctgtaatagctgggactatagttgtgtgccaccataccccgctaatttttaaaaacaaatttttgtagagatgggggtcttgctgtgttgcctagtaggatagtcttgaactcctgggctcaagtgatctttctgcctcggcctcctaaagttttgggatttcagacatgagccaccacacccagccttgctttttaaatgttggatgttaccatccctctactgtggtcctgtagtttggcttgaagcttgattctgtgcgctagccactctgtcaagaattatgtagtataaataatgccggtcacttgtgctgacctcacaaacattccgaagcctggcaaggcaggtgtggaagctcagagctttgccatctaactgagtactcaggcttctttccatttagataagacactcagaaaggaaaagcaatgcaattttaatttttacttaacatacaaagtagccttttttttttttttaagctgaaggaaatgaactccagagaacactgaagaaaattgaaggaaaaaagtagagctcttagaaagaaaggaaaggtcacgcttataaactgtagccatctagataaactgttatttccactttatgtggatgtattttattgtgacagtgctaactacagttgccaattttcaggaggcctaaattactgactattttagatgaattcaggctttaaaattagccctgggataatatatttcttttaaaatgggaccttaattgatccttattttttaaagcttgaattaagtagaaaattaagggtcttttgtaaaagatgataatatatatttaacttggatgattacctaatagagaattattccttgttctagtattttaaaatattaaatgtttgacacaaaaacagaccattctgaataggctttaggaagtaggtgacttttcagtatgaataaactatatgtaatttttcattaacttcaaaataagaactttaaaaattatggatataaatttttatgccctattttaagaaactaccctttttttcttatgagaaaaatgtctgcaagattgaaaaaagcttccatatagagtaatacattgaatgaaatgagttgttttctacttaatcagagtggccaaaggctatttcaaaacaaatttattcccatttctgaaccttcaaatcaagagaccatttaaggattcatttcaatttggttatttataagaagaaaagactattctgatggcatgtaggatggtcctaaagtaatcggctcagctaaaaacacacttataacagttgggcatgtcagctgaggagagacccttatagcctgtgtttcctacaaaaacaaaaacacagttcttttatgaaagtagacaagttgatggtatatttgggctaaataaaatacaatgttgacatatgttgaaatattctatagttgttacacatgttggctgaggtggttgtactgatccagacacatggctgatactttgagtgggaacatagccagtgtggttttaaaatattatgtccctctgaggagggattacagatgattttttgctttctacttacacctttttataggtttcttacaaaaatattgcgcatgcagtcttcttacaattagggaaaaaacccaagacatgctctaaggtgagatgagtggggggaagaaatctgtatacagtcagccctctgtatccaaggcttctgaatcttcagattcaaccaaccacgggtcgaaaatattaaaggaaaaaaatgaaaaataatataagtaaaagcaccaatacagtaaaacagctacttactgtgaccatacattgtgttaggtacttacacatggactagagatgatatagagtatatgggaggatgtgtgcaggttttatacaaatacaatgttttgtattagggacttgagcatctggggagtgtggtatcctggggagtcctggaaccaatcccccaaagataccaagggaagactgtatattgaattcagtgaggcagaaatgacttgtacattttggtttgtgaaataaaatattctcttcatataggggatttttctctctgtgtagctctcctaggaaatcccttgattaaaagaaatattgattgtactgggagaaacaaataataaatgattctaaaagttgtcactttttgtgagtttgggaaaaacaaggataaactgcagtgatgaccactaatttacctacaggtatccaagtttttattgcatcttagcagtgaaaaaaatcggagcatgtgctctcaatatatgaatttttatttataagttttcctgtgtgtactactgaattattttgtcttatacatagaagttttaaaaggatccactgacggtaaatattagtaactaaaacttgttttgttaaaaattattgatagcgtgaaaaattatcattagtgtgtagtggattttattttttcaaatgaaggttatgtggatgagtttgtatcactgtttttaaaaatggtgaatattttatgataaagcaatttgaaggtctggtcctatattcattttgctatttggttttaatagctcaaaaagttacctacaaagatacacggatccaaatgggtgaagtgcattgttgactgtgctttctaactggtgattctcattttcacactgtccaccagttagataaaaatttttctggtaaatttccatttttgtggatagcagtaagttctcataaaatgtgttccagtttatgttaaggataaagagggttgaaaataaaaaactttttacatttattgaaaattttaaaacagatgagaagtattttataagttctttgtacaaaagatacaaaagcacatctcttttcaaaatactttctgtacagtctgagtttcttttcaaaaaagcagttattttcttgcacttcttaaaacctcatctttaccttgaagggactgattaagtaaggtcattgaaaaaaacatctgccaggtattactgacagccacttgtgatcacagagtaggtcaggaaatttggagcaaattgtatttatgtaagggaaaaatgtgttaatcattcttaaaacaattcttctatgtattttgccacaagagaactggaacacctctgtatggtacaaaacatttttggggtcacgccccacctcattactgaaaggctttgttttttatactacatagatggtagccctacatgaataaattgaacagatgacagagggacccactgccacatcttgagttatttaagtggcatgtgacatctaacctgtggacccaaataagggctgtcagtgttggtaaaagctgcatttcttagcttttaaggtaaaattaagtgtaagtagacattctgacagtttcttcttgcactcagtagattgtcttgcttacccctcgcctatacacatcacttagattttcaggtacagtaaccccttggtatccccaggggattggtactaggatcctgcagacaccaaaatcctcagatgctcaaggccttgcagtcagccctgtggcacccaggggtatgaaaaggtagtccgccgtatccatgggctctgcatccagccagtaatgtatttttgaatcgcctttgctttaatccgagggctccgcatactcagataaggtgtgtaaatgaaggagagagtgactctggacttaacacctcttttatcatgctctcttcatttcttggattccattaaaaaaaatcataacccatcagaaccagatggtagttgtaattttttttttcctaatcccttcatgttatagctgagaaagctgagacagtaaaataaagaaacagtgctcagtgatagagcgaggaccagaattatgtctcccaacgcagcaccaggctgggtgtgtgtgttaaggtcatctgtgggtagtgtgtcgatgactaagctccccagatgggaactagtggagatctgttgatatctgactttctaaaaactaatttctctctcagatctctcggctctgttcttttgtttcttaaacatacggccttgaaatcatctttagtttttgtctttttgctttcttatagacacatgctttgtctagctattactgaaacataaagaatactcataaatagattctcatttcctgagaagttgccttctgagtgaatcaacatgccatgtagaatcactcttggactctttttagtgatgatggtgaaatccttgtatgtattactctccaaaagccttaaaaatgttaacaaagaatacataggtaaaataaagcaaaatgcaatcagctaaaaaaaaaatgaagttgtaaagatggggagagaaaaacacatttaccataaaatttttcacagtcctggttaaggaaattgacattggaacttgaaacttaggtttgaatttcttagcaaccttgacaaatctgtgatctaactatccttgtctaatgggaggacagatactggtttattttcaccccctgattctaaggaaaacttatgaccccaatcgattaaaacaggactaaaattaatggatatgcagaactatttgttattgagtcccatgaaagccaaggcaaaatgggacacacaccaggtatcagagtgaggcagcccagaggtacggctttctcccagcctggctgtaaacagagatcagccttgaataaatgattccttgacgaacattttccagtccagcttggtgaaaaattgagatcactattgagtgcctaaaggacatgttttctgcattgttgactgaaagaagattcctataccatagttaccttggtatgtaggtagtaaagaccttgtaccattgggtcaaatgagaacctcacttgtggtcttgtatgaagggctgttccatctctaagggaaggccgtaagtggggcctggatatttctgagaaaacatttgatggtagtactctattgaagccccaaattctaagctacagagcagaaaagacaacgtctaggaaaagagacaccaagtgcctacccctttcacagaagaatctagctgcagcttctgtaatatgtttatttagaatcacatcccaccctgccctagttctcaaataatctagtgtggattttagacaattttctgttgtctaagacagatccccaacccctactccacagatggaccagtagtggtccatggcctgttaggaactgggccacacagcaggaggtgagcagcgggcaaaggatcaaagcttcatctgtatttacagccgctccccattgctcacattaccgcctgagctctgcctcctgtcagatcagcagcagcattagattctcataggagcgcaaaccctattgtgaactgcacacgtgagcaatctaggttactcactccttatgaaaatctaatacctgatgatctgtcactgtctcccatcacccccagatgggaccatctagttgcaggaaaacaagctcagggctcccactgattctatatattattgagttgtataattatctcattatgtattacagtgtaataatagaaattaagtgcacaataaaggtaatggtcttgagtcatcccaaaaccatccccacaccaccccagtccctggaaaaattgtcttccacaaaaccagtccctggtgcctgaaaggttggggactgctagtctataagatggttttctattgcacagtccagactgacaatgacaaggaatttagaatctcagctattgttctatttccagcagctcttcctattgattaactatgagaaacatatttttaagaaggcttatttttgggaagttagagttgtgttgtttgaggtgtgctcctgaaagctgtttactcaaacctttatgggtcaagttttgtgctgggagcagggtttcccttgtagtgaggagcttacacctggaaacatagcaaatgacgcaatgggagagccacctcactgtggaatcaggtagggcatacatacagaaatgaattttaaatgttaaagtatttctattttacacaaatgatcatgtgaggacttagattttatgataaaaagtaaggaataaaatttgaaaaagctttataagaacttctggaaaacaaaagcaaaaacaagtctccctggtataaagatgcatatgcagtggaaggaaatgtactggggtggcaatcgagcatcctgggaggaggagaaggggcaagagtcagaataaacatagggctctgtcatgtataggtctgaagaaaagagggccggtatatggatgagcatttcgggccttttaactacagagctggaagataatgcaggttcccaggaggtaggatgacaaggacaaaggagggcaggcctgaactattcaggggacgagctctgggctgttctgaatcgcagatgccatcctgaattgcatttgtgtcaaataggctgcagtggttcatgcatacctttgcttctgtttggcacacaccgtctgaacctcaggcatttcttaagactttaccaaaaccattcagttttcttattgtaaaatcgagacaccaccacctcttctgtctcccttagggggttacgtgggggaccaaatccttttttctaccctggagcaagtgccagcacagggaggtggtagaaatgtttgctcaggtgcccacagccaattgatgccccactgctcttgtgtttgtattgaatccctttgttaatttttttcttgtttagaggaaatacatatggtgattttgcaatcaatgcagcattgcataataattaaagggctagccttggggccagactatttcagattctagccctcccatttgccttgcatgattacttatctcaagctcagttttctcttctgtaaaacggttatttcttaccatgctattaagaggacagaatgaggtaaggatgacccaaatgtcagtccatgtgcactcattgaatcttagggtttttcctccccttctttggtatttgtgctctttgaagaaaagagcacatatctcctcttgaaagaggagatatgttgggtttttgttactctcttccacaagaggagatgtaaaaacttttcaaaattttatttagtatttcagcttgtggaaaacacattaagatggcaaataatcttaaaataaattagtggagttaatgatttccaagtagggggaaccctaatgatttaaatatgtcccgatgctgtattaacttacagagtgtagcatagtgcctgagttcagatttaggagcctactggctggactcagcacttattagctgtgtgaccttgggcaagtgaattaatctctctgtacctcagttttattatttatacaacgtgggtagtattagcacctagattttgggattgttcccccaacctctactccaaaatagggtttttttgaggtttaaatgagttaatatacattaaacccttagaaccatgcctggccctgtttgctgttatttattattgttatgatgctgctgctgtagtgtgaataaagtcaagagtaatttaagttttgagaaatacttaattataataaaatgtctttggacaagcagttataaggatttttttttccccctgcagggctcaagtgtttgaaaagagtaagtacattccagccttattcagtgatgtccttacagggaccttgcttttgtgcatcagtcttttgtgacatgaaaatgttgctaaagaaaaacttgagcagttggtaaagacatcgcaaggtgttgtggcaacaaccatcagtttgcagtgattatgctatggttggttgttctcatatgtttccactttctttgcagtaatacctgtatgcattatttacaattccaaattgaagccatccattcctttactgtcatgcaccttgaaatctgtgtacagtcatccctcagtatctgtgagggattggtttcaggaccactccccataccaaaatcctgaagatgctcaagtccctgatacaaaatggcatgatgtttgcatttatactgtgcacatcctcctgcatgctttaaattctgtctctagattatagtacttaatacaatgtaagtgctatgtacatagttgccatactgtgttgtttagggaataatggcacgaaaaaaagtctgtacatgttcagtatagctgcaaccatggtaggcctagttacattttccatcggatgcggaacctgaaaatatggaggacctgttgtgtgggcttcatctaggtgattaatgacatagcagagcagtgtttttttgttgttgttttttaaaaatatttttcaatgtacaggcctttattaactgagtgctcagaagtaagctcagtgtgtgtcacaagcatggagatgggggattgctcccaaggagaagagagggggtgaggggcagcttggggagtgaggaggggaggaaggacagtgggaccagggctagtcccccacctccgacaccctagctcctgaagagttccaccagacccacccttgtgctcctcgaagaaaaatctgctaaggaagaagaaaaagataggttagtgtttttaatgtgacagacaaatgaatctttaagtgattccttgcatgaatctaattcttgatgatagccaattatttgagatgggtgataaattataacaagcccagaccttttacccttggctctgggtatgcatatatgtaaggaacttaatggtaataggaacaccccgttatccagtctaataataaaccactaattgtaccagataaaaaatattatgaactgaagacctaatattgttgaaatgtcacaacttctgtgagtaaaacatttcagctgggcacggtggctcatgcctataatctcagcactttgggagtctgaggtaggaggatcactttagcccaggagttcaagaccagcctaggcaacgtagcaggaccccatctctatgaaaaataaaaaaattaaccaggcatggtggtgagtgcctgtagtctcagctactcgggaggctgaggtgggaggatgacttgagcccaggaggtcaaggctgcagtgagccaagatggtgtcagtgtactccagcctgggcgacagaggaagaccctgtcttaatcagtcaatcagtatttcatgcttttagatactttgtggttttcccaccagatactgtcactactatcaaagaaccacgtaaggaaattctgtaaatggttcttaactttgtgccagacacctgagaatgtgcgcaggtttattagctatagtccttcatcttgagtctgtatagaatcctgtcctctcctgatactgtacgtaagttactcagtgttaccagttttcttttttcttcatgtcgctttcttactgtattcagaaaattttcttctttaaaaatatttcagattattgtcactttggtggaccctttactcgtctctaataaaatgtgaactgaatacattttcaggtgagatgtttcagttcatgctgtggggtctcctgtctgtgtgaagatttgacctatggtgtactttctcttcattttttcccctatttctttttctaaaattaattttactctgtatatttgaggtttacaacatgatgctatgggattcacagagataatagtgactatagtgaagcaaattcatctatcaatgatctcgcacaaagtaggccctttgtatctgcatgttccgcatttgcagatcccaccaaccacagatcgaaaatacttgggagaaaaacaaataataatgtaacaatgagaataatacagattttttaaaaatgcaatataactattcacatagcatttactttatatttgggattatagaaatgatatagagtatccaggaggatgtgtgcagattatatgcaaagctgcgtcattttgtatcagggacttgatcgttgcggattttggtgtcctgagggattcctgcaaccggttgtccactgatctcaaaggatgatggtagttaatttgtgtgtgtgtttgcatgtgtatgcgtgtgtgtgtgtgtgtgtctgctttcgtaacgagtaactaaaacctatttatttaacaaaaatccccaatacagttttatgaactctaggcctcatgttaatacatgaggtctacattagacctctaaacttgttcatcctctgtatctgctattttgtatcttttgacctccatctcttcatttgggcctccctccacctcggctctgataaccattgtttgattaaatgcatacctgacctttttaaaaagagtccacatataaaatcatgcaacatttttctctctgtgcctggcgtatttcacttaacataatgtcctccaggtcacttcgtgttgtggcaaatggcagggtctcaggaagggtttctctttcatctgaggtcgacatttccttcatcctttttttttttttttaatctgacttattcttgcctacttgaattgcagattagtatagtgtcacatagcatgccgcatcatgagcatatcagaatatcacatttaatgtataagaacttaatccagtaaaacaaataaggtctcatttgctatttacgagtgagcatgtatgtgctaagtaactgtggagcaggagacagaatgtgcgcgttcttcagctgcggaatacctctcataacagacggccctaaatgcgcttctggcgtctccagacatgaaaaattcaaatggtctaatttagctgcgtcagcgtgagaaatttaaaatgttgaaatgttacctactttgtaccatactctactttattcctagattaaagaaaaaaatagaggctgggcacggtggctcacacctataatcccattcctttgggagacaaaggtgggaggattgctagaagtcaggagtttgagaccagcctgggcaacaaagcaagacctcgtttctactaaaaaaaaatttttttaactaattagttggtgtatgcctgtggtctcagtactcaggaggctgaggtggaacttaagcccaggagttcaaggctgcattgagctttgattgcaacactgcactccagcttgggcaacagagtaaaaccccatctcttaattaaaaaataaaaatccaataagaagaaaatagagcttgctttcttcaattattgagtgacttctcaacctagtataactaacaggaagaaaagtctttttgatgcctactgatgtcagttttcagaaccctgaaaggaatccaggggtttaaagtcccctctctcaaatggtttgtggggtttagttaagacgtaatttgtggaatctattgggagattacatttccttcaggagagaagaacaactatctaggagttcaagttgtccaaggatttggccaactgcctttgggaataatgagtttcctgttcctgaaattatccgaaatgtgccggttcagcatgtttccaagttgttttccacagtgatagacaggatggataaacactcaaaagcacagcagactcccatgggcactgtcggaagtttgcagcaatcttgacacgcccagtattactcgatccctgcctcacttaaggcgaatattggaatgagagggagaggatggcgtggcattgaatctactcacattcatatataaaaagtaaattagagaactgtaattgttattaaattacaaacaacaaaataggtaactgagtattgcagtcaccagtgtgaatgactggaggtgttgtctgctgacctcatggcctgccattgctgtgaggggcatggcaccagacgagtgataggactaggtagcttttctctttctccctccctgccccgccgccacccccacttcttctcttctgttgtctctttttttctgagacagtatctgtcacccaggctggaatgcagtggtgggatcatagcttaccacagcctcaatctcctgggctcaagggatcctcctgcatcagccttagcccccctgggtagctgagactaaaggcacatgccaccatgcccagcgaatttttaaagtttttgtttgtttgtttgtttttttatagaaaatgggtgtcactttgttgatcaggcctgtcttgaactcctggcatcaagtgatcctcctgcctcagcctcccaaagagctgggatcacaggtgcaagccactgtgcccaacccttttcactttcttaaccctgagattttgattctgtcatgaccaaaatttcacaaggaaaattgtcttaatgattcgcctctcttctgaaattttttagtattatgattcattaatagtatgacttgatgctaaatgtccaaaacattgtttaataaaatcagttgaagagtatacactgggactcttaaactccttttaaaaattatctggatataatctcttatgctgtgtaattataagttgtacttcttatctcataactttaaatactcaattcaagcagaaccattttcagaatcaaagtcctattgaaaatgtaaacattagacttcttgaaaaaatatatacatggcagatctactgtggttgaaattaaatgacaagagtgtcaccagtaatgcggtttctgttattgcacgggttccacaggtgtaaaaataacccttactagcaccctgttttactagctggacacttgccgaaatggtcaggaacacaaaagtgaagcagctgtgtatcggacagctgtggacaagatgtccataagcagtgctataaggacccaccaaagcacaacttcagatgacttggcagggcggtgacatgctgggaagcaacagtcatgggctgtgcattttcacagaagtgttcaaggaactccagggtaatttacaaatggccactttgccatatgcctgagacactggaaagatttttagtgggtggcatcctatagaccagggattgttttgatgccagggagctcgagctgatactggacattggaaggtgtgtcaggttttctgatagacaaattatgtttcactaatagaatgttttgtttgaggtagggaatatttttaagaggacaaggaaagccaataggtatatttttaaaaattatgaacatatatgtataagaaacagtataatgaaacaagcgcattacaaagaataatgataaaacacattgtgtgttagcttttggcagaaggaatataagcttaaaagttttttaaacaactttctttggcaaaagaagtagaggcagtggcaatcaaagaaaaaataagggattcagacaaagcgtacctagtattaactgttagtaccacagatactaatgctggtttttaattaaaacgacccaatcagtaatgtctttgagattgcctaaatttacattttgctctcaagtatttttaagtcataaaacagcaagccagtggggaaaataaactgaaagatggtttgccacaggcctgaaactgtgagtggggaagttggcatactaaattgtaatacagacagatgtgaggtaatgcatttaagggggggaaaaagactacattctacacacaaagtaatgggctccaggcttcttgtgagtatttcagataggaatcattcagtttctaatgggtatttggccgatgtggtgcttattgtagccaggaacgttccgggcaaggaagcgctgggcgattccaggagagatataaagaaaatatttcaagatctgacacactttgaattgtgtgtgtgtgtgtgtgtgtgtgtgtgtgtgtgtgtgtgaactgcttggtaggaaagctacaagagagactgggaaaggctaagggaggggcgactgaaagaggtaccaaaccatgagaagaaattacagtcaggagggacgctgcagtctggaaagatgaagctgtgattaaaaaccatgataaacacgtgctcaacagacttctttatcaaaccctgcagaagggaacagaagaaagcagttgctgcttgagggggaaagttaatggaagaagaaaataacttgttttcgacagttgacaaagcagtttcacctttgtcatctcacctgacctgtacccagcactgaggagaaggctggggacaagtcattattcacatttgacagatgagcaaacagatcagagtaagtgactcggctaagtccacactgtcagctctgcggtcaggatcaaacctggctctgactcaggtccccttgcacttggcccacctctgagttgcgaaaacttggggtctgtaccacagcatggaagacttaggatcactgtgaaaaactgtgacttaagatcacagtgaaaaacggcaaatgcaaatactgttaaagccttgactcggtggtatgagcagaactcataagagttgagtcagagagcagtccaggtgtcttcagctcagatagctgcccttgctagagaggctgctggttgaacagtaatttatcagcttgatccaacataaagtttcttcatttttatttatactgtactgtcgtgtcagctgtttttgttgttgttgttgttgttgttgtttttctttttcttttctttttggcttcagaaatggcctcagctacgcaaaaataaagaaggatctgaaagatcagtcttgttgtaaagaagacagcaggtgacatggtagatgaccgcacattgttcattcccaaggtcatgggtagtgccaggattttcagacgcaaatgatgcatatgtaaagatgactggaccatctgtgtctcttcagatcctgttgcaattaccaagtgttcccagcaagggttaatgtggtgtgtgaacctgactaacctcaggttctagttctccctccctgagtagagagtctaggagccaagttcagactggctcagtctggaggaattcacaagtgaggcaggtttaatggaagaacagatactctgaggttttggagggcctgtgatgtgcttgtcagcgggttcctgcttctgccacccccaccacggagcaccaaccatgtggtttgttctttgtgtactttgttagctaaactctcaagtgtcaagttgatggcactttttttttaggttcatggacactgttactgtccaataatttgtaagtcagcaatgctttgttttatcagtaaaataaaacactatattaggaatagcatgatcagaacagggtggtttcctaatttttagattgctggccttttctagaaaataaaggcaaggtgtgcatacttgaggtttgagggctaccattgcctcctggcagaggaaatgagtaggcctgatagttgctaggttaaaaagaaacagtagttgaaatactgagaaaagtttaatgaaaagtaactttggctcttaagtagaacagtttgaggacagtgaaaaattcagtagctaagggttgtgtgctctctacacagggatggtgtgtggatttgtggataaggtatgcaacagagtactcctctttgagcatttttatatcttgaattaactatagcacaggagttggcagactatggcttgtgggccagatctggcccgctgcttgtttttgtgtggccacgaactaaggatagtttttacgtatgtacaaaaaaaaaaatggttttctaaaaaagtatttcataatgtgaaaattctatgaaattcaaatttcagtgtctgtagataagtttgattggaacagagccacactcatttgtttgccagtttgtagctgctcaaacagcagaggtgagtcattgtgacagagactgtgtggcccgcagagcctagaattatttactgtctaacccttgcagggaaagttagtcagtttctgctacagtaaaatattgctggtagctgaaattaggagttttcacctcttttcctgcgttttattttttaattttaatttaattttatttattttatttttttttagaaatagggtcttgctctgtcacacaggctagagtacagtggcgccatcatggctcaatgcagcctctaccccccaggctcaaggcatcctcctacctcagcctcttgagtatgtgggaccacaggtgcatgccaccacacctggctaatttttaaaattttttgaagagacaaggtctcactgtgttgccaaggctggtctcaaactctgaaacttaaacagtcctcctgcctgggcctctcaaggtgatgggattacaggcatgagccactgtgtctggctgagaagccaggtcttgagaagccaggtggctcagaaggcctagctgacagtgtaggggagacagaggtcccctccaacctccctttagctcttagtgggctcttcagctggatctagaagtcaggttgacatcaggcagattaataggagaaaggaatacaaattttcttagtgttacttgcacctgggaatctttaaaagagtgaaatccaaaggaattggccaaagcaagacacttttatgctgagaacgatacatttgagaagaaatgacaagaaaaaatctggggcagtacatttctaggggagtcactgggaggatacatggggagtataaaacaggtagaagataagggctacttccagaaatttccttattcaggttagttgcatcttccaaaccctagtctctgggataagggctattttctcgcctgaataggtgaggggcccctcccaaaggaatctttgtggcttgctacatgcaggaagacccaggtcacctggcttgttggggtcaagttggaatctacaactttttcagtgttttcagctcacactaatcaatataaaaatccggcatattttgggatggcatgtccttcactctttgaacaacatcaccaagacctcaatacatgtgtagggtcaccttggatcaccagccctcgctgagctgtcgcaggaacacaatgttgagcctccttgagttcttgacccatgtcattatgagccaataaaatggcagtggttttaagccatgaagttttggggtgttttttacgcagtgttacttaactgaaaaggactagggatgatgtatgctagcctttttattgtcattcatgacagagggaaaataccctctcatccaggatgttagtaaagaatgtagttaaatccttctgccacttgagttcctggtacgtgtggctcatctaagacattaaatgctatttttatgattataaaaacaatgcatgcttattggagaagatttagaaaaggatagaaaattctaaagcacaatatttaaattactcataattcggccatctaaagataatcacgattaataccagccttttctttaaaaatatattcttgttttataaaatttatttatagttttgtactctgctttattcgtgtagtaaacaagcatatttcaaaaacataatttttaatgaccacagcagcccatttaagtggatttaaaaatccacataattcaaaagtagtgcatggtcttcattttttgtttctaggtttgctagagtatttttttttaaaggaatcctttttaaagacagctttattgagatataattcacatatgatataaagtgtacaattcaaataccatttagaatatgcaattcattgctttttagtatatttactaaaatgtatatatttttatatactatttaaatataggggttgtataaccattctcaatctaatcttagaacattttcatcctctctaaaagaaacctaaaccttatttcccccaacccctacccccagccctaggcaaccactaatctgcttcctgtctctgtagatttgtatgtgggcttttgtgactggctttgttcatttggcataaggtttccaaggttcatccacattgtaccttgtaacaatacttaattcctttttatgggggtcaaggcatattctattgtgtggatagaccacattttgtttatcctttcacccattaatggacctttggattgtgttcatgttttggctattacgaataatgctgctatgaacatttgtgtagaagtttttgtgtggacccatgtttttatttttcctgggtacatacctagtagtgaaattgttgggttatatggtacctctgtgtttaattttctgaggaatggccaaagcaactgtataattttacattcttactagcaatgtatgaagtttctaatttcactgcatccatgccaatacttgatattgtctgtccttcttcttatagccatcctagtaggtatgaaagagtagtatctcattgtggttttgattcacatgttccaaaggactgatgatattgaggaggtatccatatacttattggccatttttgtatcttctggagaaatagctattcagatattttgcccattttttaattaggttgtctttttattgaattgtaagagttctgtatatattttgagtaaaagtcacttgtcagatttgcaaatattttctctcattttattagttttcttttcactttgatagtattgtttgcagcattaggtgtaaattttgatatagtccacttcctctagtttgttgcttctgccgttggtgtcacatccaagaaaccattgcctaacacaagtcacaaagattttagagaattttttaaatgttattttattcatttatcttacactttatagctcattctgctgtatttttaaaaaggcagatccttcaaggacaatacatagggaacacattctttttcatagctgtctaatactctaggtataagtagaccttaatgtattcaaccatttcctattgatagacataacctatttccagttttttgggttttgccacaaataagactgcaaaactgtgtacatttattattttgttctggtgtctttattcctaaaggatacattacctagggcggaatgggaagcttccttcggaatctaagtaccaagatttgtctgacattagaatttgagcactccagtctgctggctaggaaaaaaataggaatctgctggagaagagttttcatcacagcaaactcatttcataaagctgggttgccttcacattctgttgctctttcaacagcttatttttatttatttatttatttattttttactgtcttcaaggaagtaaaacagacttttccccatagaacgacaaaggaaagaaatgcagaaaggtttgggaaatagccactaagaaaagtatgccggtgttcattctcagtcttgtatttggagtgtgtgtgtatgtatgtgtgttctctttatcatgcactgctaaaaagaattcagggaccacatgaagacacgcacatgtgtggtgccgtatctgctggtgtatgaacctaatgggatcaccgagaaagtggaaccctcctggctctgctctggtccctggtatctcatttctgttgttgaaaggggggttggcaggggtaacactgagaagacaattgtgacaaaatagagattttttttttaaagtccagcaattaaaattgaacataatttttatatcattcattcctcatggtttaaaaggagtgaaaaatgtacaggagctttaactgatgtctgctctgtaaaatctgtgttaatgtgattaatggtcagctattcatttagaggagccaaagtagcagatgagtgttttcgtatttttagattctttttaagagcccttagtggcctattatatcgactcttccttagaccacacgcagcctccctttagcaaatctccgaattgttactttcatttaaacttcagctagaaggccactttaggaccttactgactgattgagatgctagattatattttagctgcatcttagaaacattttctgatggtttgaagaatctgtgttactgcttgccatgaactaagtaagctaagtgaatagtttgtaggaaactgacaagtggaagtggttttgaggatttatttttttcttgtacctttttattgagggaaacttaaaacatttcaaaagtagagggaatacgcatgaacccatcactcagtttccacattcatcctctcagagctcattctgtttcatcattctgcaggatcccacatgcagccacgagccacgtgtggctgctgaatgcttgccttgtggctatctgcagggagttgtgccccagtgtaaaatgcagcctgagagcctgttccagcagcctactccctcttggggtctcctcataactaagcagaccctcgcgctagccctatctctgtgtaagcccctcctttctttcctttaaaacactttgaaagtgccactgtttaattatttggcgtgcccattaagtctcagtctgattccctatgataatacagtctccagaaggggtagggcctggtgtggaatcggtgcccggagtgcacccagtgaatgagcacaccccagtaggaattctcaaccccagctgggcccaataccttctttgccaggtgatgcaaacatgtacatgcaaaacatgtacatggtaacctcctttaataacttgatatgaaattcacagatgatagctcttaaaaaatgaatataatgtcctaagtataacaggaaagagaaatataaggaaagtaatttgcaataaaatcatgctttttcttctcctatttctagtattggtggcacagattgtaccagactaacctactagcaggtaataaatattgtaagcctcttaggcaaaacagcatctcccagtattcagctcttgccatccctctgagctaagcctttctcccctgtggcacttagtactgagtgacattctggttttttaattgttggcttcctcctctgctaagaagctccatgagggaaaggaatgttttctgtttcattcagctctgtatcctcagcacccagaacagtgcctggactatagcagttgcccagttaagcagatgtaccttttacttcttgttctctgattcatcagcaggaagagcctatgaaaggtctcccttatcagcccatcactgagccagatattccctctggttagtctcttgcccttgttcctctctgctggatgagatgatgtagcagctgaagactctccacctataactgtatcgtgccacattcagatttttagaatgcccctcttgatctggccatatctacattaaatgctattttcttcaagcagtgagacaaagctgagagacgataggtttaaagattggttacaaattctgatgaagactggtccttgaagtctttgggctgttacatggccctttggaagcaataggtcatcactgtgaacaacttctgtaggtactggtttccatacgaagggaatacatcttgatgactttacatgaagtcttaactttatttgctgtttaatgtaagttggtcaagggtcttattgagcagaagaaacttgggaaatgaaagcactgttactgggaccacagtttttgagcctctgctgtcaatggaaacagacacttcaaaaatgctctccacggaggctcagagagatgaaaagacaggaaaaggagccgaaaagatgaaaagacaggaaagaaaagacaaaaaggaaaaggagctccatgtgccatcatggagcacagggacaaagaaatggcaacagtgtgtctgtttccctgttaatggttgttgagaaatactagccacagtttccaaagtatttaaggaataggaaatgtgcaataaattatgtgatttttttgtggatcagtttccttcttccaagtcgggaaatgtcagagaaacactgtgttgttcaaggatgacagccaggaactagtcaggcttcagcacctcctgccattgaccctcttctctgagcattatgtagagtggatgtgagggctcattcatggactgtgtcaggagaattgtactacattgatcatttaagggaaccattctgcttgttcaggagagtcttttcattacttataatggcttgtttattgacatttcttatttactgtttctcctcaacagtgtttttgtttgtttgttttttgagacggagtctcactctgttgctcacgctggagtgcagtggtgcaatcttggctcactgactgcaacctccacctcccgggttcaagcgattctcctgcctcagcctcctgagtagctgggattacaggcacacgacaccatgttcggctaatttttgtatttttagtagagatggggtttcaccatgttggtcaggctggtctcaaactcctgatttcgtgatctgcccacctcggcctcccaaagtgctgggattacaggtgtgagccaccgtgcctggcttctcctcaacaatgttctaagagataaagcaaaagtatcaggtaatatgtcattgtaatggtacctgggatagaagaatttcatttgcttgctactatctccactcttacatgaatacaaatgttcccaatttttagtcaatgtaccaatcaacattgaatgaatgatatgtaaattacaagaatgaagggccagaaagatgtcacgtatcagtgatgactgttctgagctgtgccctcttaaagcaataaagtaagttctctttgattaatagttacgttggctaccttttagctgcccatgaaaaatatagatggacttttttttgttttttaaagacagaatcctacggtcttgttttgttgcccaagctggagtacagtggcatgatgatagctcactgcagcctcaaactcctgggcttaagcaatcttcctgcctcagcctgctgagtagctacgaccataggcacaccaccactcctggctgggttttatttatttatttatttatttatttattttttggtagagactgagtcttgcaatattgcctggactggtcctgaaatcttggcctcaagcatcctcccacgtttagcctcccaaagtgctgggattacaggcatgaatcactgtgcctggctggaaatttcttagtaaaacaaaattcgttagtggttcaaatatattttcagtgctataaagaatataacatttctacctattgtcagctaaagctaagagttaaagaactacacctaacatagtgactggcataaagtagatgtacaataagtatttgctgaatgtgtaactggatggctggaattaactttgagtaggagaaacagctggtctggtcttctttttttttttttttttttttttgctcccaagtgtcttgtctcttgtctcttctctgatcaccacagcatggttcttaggagtcacagtgtctggtatatacggaaagagtgtttttggagggagaattcaccaaaagaacatgatacaagccaaaaggggttattattagagaagaacagtgttgatatgaaggctagttaatgctttgtgaatacccaccatgcacaagacagtgtctgctggttgctggaagtccaagatgatcagtttgtgtccctgtggctaaatgtttggttgttagtctgcatgaaatagatatgacaccaaattagaaataggagaaagcagcagaagaaaagcaaaggttctgtgtataaccaagacaatggggttaaaaaaacacacacacattgctgaagaaagtaagttaagtaagttgagctttcatttgcaaaatgactttttatttggctgtaatattcctctgggatggctctgtgaattcagtaaaacaaagctaaagaaaaacctattctgtttgagggaccgtataattaaccatagaaatgagtgccatccagtgtattactgaagaaaaaggattaaatagtggtatgaataaaaatagtatccctttttattctctctaggctaaaattataaggactgtcagtcattttgttaagggtctagtttattattggctgtgttgggaatagtgctttctatcttcctattatgtaatagtccacaattacatgaatagtgggatttttattttttttattttttattttttttcctcagaagagcctggtgttgaggggctgcaggagcagaacaggaagttatggttgttttggaattgtgtgtggtgtatgtttaaattgtattagaataatttttattctttttaaactgtctttctggttgtctcatgctactttgagtttaatataccctgggcttgatgcaagaccccgggccagggccagagcacctggttctagttctaggtctacctttgactgttgtggtcattttaattaattcatgcatacatatttattgcattttcctgcactgagtcctgcgcatacaaaaatgaataaaacccagttccttcctgtaaggaatcagtttagttggaggatcacagagataagcataattataagacagcttagagatgtatatggagtattttgtgatgtaagggaaggaacccaaaccatccttggcaggaagtaatgggaaagacttcctggaggaggtgatgcctgaattaggtagaagtcataaccatggggatcaggggctttgtagggcattctggctagaggttatcaaatagcaaggcagatagaccccaagtgtgttcagagcactcacctgtccaggaagtggccctggacagggagacaggaaatgaggctgcaggaatgagagagatcactggatctccgtttccttacctagaagtgaagctctgttaatactagaaggcttctcaggaactcactcattttctggaaagctttcatattgctgcttgttggagaatgacatgttaacctgctgctcacctttttaggacgttgagggctgggtattaactgtcttgagtttggcagtattttgaagaaggacatcctaaattacggttggtgtgactcatgtgagttatcagatttgtatctgttggtctttttctctgcgtctgtctggttgtccaggcgtttgtgcttctccaccccttcttaataggcccttctggaattgatctctgcatccatctcctctggacgtaaatattcatttctcttttctctgacccttcaccagctcccatgccctttgtgtgcagatgccccacagatctggctgggttttccctatccctgtatatattcacaagtacacctgtgacattcaagtattgtaatttaaaaatcagcattagcaagaaatatgcacatatcagaaactgaagtgggcgtgttatccagattaaatcactatagacaaatctctttatccatttttttaattctttggaagtggttatgaaggtgtgaatagttcattgttcaaggacagtgcattggattctgttttttaatctcatccgcctccaacaatccccccccacactgtccccccgacccagagctgtcagggcagccagagggaaccttgttttcaggatgctgatgctgatatattattcatgatgtagcggcattaaatgtgttagatagctggcctcctttttttcatttaacaataactgcctattgtacatcggtctttttctgtagtaggataagaattacaaagagtctttggaggaagaaccagtgcttcaggttatgatataccttatattgtttttgttgttaggggctatatgtaaaatatagctgcatatttgtctaatagctttgacttagactgaaacattggttgccaaaaacaaattatttcacattaacaaatattatattattagttattttaataatttattcctctcagtgggtgctagtccagacattttttgtgtttcttagtggtaatgggcctgtctacttcatgaaagaacaacagcgtctctgcatttcgctagaaaaatattcttggaggagagtcctagaccacgtgtgtgtgtgtgtgtgtgtgtgtgtgtgtattttccaagtaaatcagaaaattcaggcaattaatagtgaaaactgtcttctcagtaaccttttcttcaagtcttaacataaatgacatttctttgagagggccccctagatctggttgtacccctttgcctcccagcatcctgtgttctcttacaatgcccctaatgactcgcacagcctcggagctccatgtggcccatgtggcaggacccaggtgggcagtcttgtttatcgcagtgccaggcatcaggctgccaccttccagcgacctaccctaggagtgtgattctgaggattcagtgaaacggtttaggcaaactcctcggagcagtggctgaccagagcaagtcattaataagtgccagctctttttaaaaattcatcaggtgtactctctccacccagaagagactagtagtttaggcttaccaggtctttcttcccacttctttctctgcattgttatttattcatatttctttctataatggtttattgccaaaggcagtcaatagtatgttgaattagctatttctataatattttagactgatatatgtgtgtgtatatataaatatatgtaaaggtatatatatatgtgtggacgtgggtgtgtgaattatatgtatataatatatgttcgctttccctggcttttcactaagaaacatgaggatttaccacagtgtctcttgggtactcagtgaagggaaaggcatttacatcatagccagtagttactggatgcccgatgggatgatgccaatatgatgactgcttctctgctctttcttctctgagccaatttattccaggaactttgtgctcactgcagctgtgactataattgcaatcaaattatagtttctagtgtcacacttacatttgccgttttttaaaaaaagctagaattacgttactgtccatagcaggaatttttagtgcaaagagataatcaagtgtttgtaatgattcatatcaactggttgtaatatgtgaaaaggctacagtatttttaaatatttctagggtgtgtggtgaactgtttttgaatactatggagaaatatataagtttttactaaattagctttaaaattatgtaaataacatattatggaaaatgcagacgatatgggtgagacaaaatttttgaaattactattattaattgcactattagcccctggaatcgattttgatgccctgtacgtatgcaataaagaattgccgagtaagagggtgaataaatgaacccctgtctttgtagtgaacaccccatagaaggaaggtcacagctgtttgcatatggaagaagtttgtcagtcaggtggaccttaaggagtgtgttggctatcatactgttttgtttttggttttgttttttgcccaggctggagtacagtggtgccataacggctcactgcagcctcaacttcctgggctcaagcgatcctcccacctcagcctcccaagtaggtgggactacaggggcgcaccaccatgcctgactaatttttgtagtttttgtagagatgggatttcaccatgttgcccaggctagtcttaaacttctgggctcaagtgaccctcctgcattggcctcccaaagttctgggattacaggcttgagccacaacacctggcctgtcatactttttagttgtcagaatgagttgtaaattacatgtggtatgattattaagactgcaattaatggaagcactaagaaacacaataggtcatggtagcctggggctctaatttatgtatgcatcatgctgaggtcccataatgtccagatgaggtgctctgcttctagtggctggcccagcctggctttctgtaatcatggtcagcttgtgaactaacaggtcatagtcattcattttcactgagattctgcaaataaacaaatatgcagactagaaatcagaaagacattcatattttttgctagcaaaaaacggttggtaaaaaagtgattgcacaaagtcttccaagctccactgccccattgcctgcacctggaacttggcaagtcgcagaccgtctgtatcctgcatccgtggtgtcctctgagtgtgcatggcctctccagtgggcacgcccgcaataaacccggtgtccatagcctcagctgcattaccctacagggtttgctgtcttgactctgtggagaggacttagtggggagaagtgctccttttccttctttctttcatagcttggtttttgcttctgacagttttgttgttttttgtttgtttgtttttgtttttttcatttatgcatagtcatgtgttgcttaatgatagggatatgttctgagaaatgtgttgttaggcgattacgttgttgtgtgaacattacagagtgtactcacatgaccctaggtggtgttgcctgccccacacctataatcttatggcaccaccgtcgtgtataggctgtgtccttgactgcagtgtcgttatgcggctcataactatacatacctttccttctttccttttttgatcttcggtctcttctaatttcctttttactcattctctttgtgagccaaaaatctcccctcattatagttgcaaagcatatggctagtactgtgacacttccctatcaaaggatttcagagccacattatttttgaagcaaagtgagacttgtgaatgtagtgttcttagtccccagagctcttgaaaactccatagacatgttcaaattatcaactagcaacaaaaaaagagtattaaaaccaggagtgttttattaaaaatgaaatgtattaaaacagaaaattgagctaacagaaacaaaacatgaagaaacatccccaaagtttactgttaaattatcttatttggtattttttctttacaaaaacagcccaaaccatgttttgcttgaagcatcaggcttcaagagaagtacatgtttcttatataaattcccattcgtgttttgtttggtttaatatctactgttgctagtagactgtgtattggaaaggaatattttctagtattttctgcattgatccacatgcatagtatttcatttacattgtgggccatatagaattttgcagactagttcagaaaaccagcttctatttataacattgaattttcaggaaaatgcattctgagttccaaataatgagcttagagctttacttttgaaatacagcccaattgtatgttgagagctgcctaccctgtaagccaatgaagggtttttattttgtatgatatttcaatatgatccagaagcatctggtttatctagcataccattaaaaaacaaacaaacaaaaaaaacactgtgctacttagccaggagaggtcttagttttgctttgacttcagcccattgtctttttagttggtgatagtctgtgatgaaaaggcctactgggaaacgttgagagaatcttttaaaattttaatgcagggaattttaaagaccagtttaaaaaatactacttaagattgggcgtggtggctcacgcctgtaatcctagcactttgggaggccaaggcaggcggatcacgaggtcaggagttcaagaccagcctggccaacatagtaaaacgctgtctctactaaaaatacaaaaatcagctgggattggtagcacgcgcctatagtcccagctactcaggaggctaaggcaggtgaattgcttgaacctgggaggcggaggttgcagtgagccgagaccatgccattacagtccagcctgggtgatagagtgagactctgtctgtctttctgtctgtctctctctctgtctccctccctccccctctctacacacacacacacacacacacacacacacaacagaagttcactgaaaacttcaggattttctgtggctaagagtcctttcaatcatgaaagtattatttacttctaaaactttttggaggacttttaaaattgttacaaagtttttttcaaaatcctctttttacaagtattagtttctgggaaaagctggaagacatctattttctagttaaaaaataaaggcaaaggattcattttctaagagaattttaattttataacctcccagattaatgtcttggtgtataaatgtgtatctcatggaatgtgacatgagaagcacgtcatttgttaggtgctaaatttgtttttacgattatcgattttataagtgatcttcagtttgttgaagaatgagtaaaaccacatagatattactttcccactttaatcttttggatgaaagcaacacattcaaagccaaaggacttagagtgaaatcttaaggtgtttgctaccataattctaatttggtattcataaaaaaattatgtaatatttcaagacttaacgtgctctgtttgaatacacacatcaaaactctgtggttgctttcttttttccacttgagaaactaaattaatttaaagctagtttgtggaatataattgaacactagttattttaatttccttgctacttgatcaagatcttgctcttttaagcatcatgtgaaaccgttagtacccactttcacctggcaaaataaggcattttacatgatcagggcaaatatttttctgactctgatgaaggacttctgtgccagtcaacacattattatttttacaaagttatagtctgtgagttggaaatgtgggtatttttttctttccatgttatttgctatagttattaatattaattggaaagtgattgttattaagcaggtagtgaatagattcacctgccctttttacatgtgcctcatagaatggcatcggccaatgattaactttcttgcagagatgtggatgttggttgttctgatgctatattggtatattattcctatcggtataggactattaaaaactttctacaaatgtaatgggaaaatgtacgttcggggagcaaaggggtagtagggcttatcaaatgcaagtgactactgggagagtgctgtttcagatgaagcctgcagaaagaaaaaaagaaatgtaggtgccggaaacagtgcagggagaacttaagaagaaccgcagttggggtttgtgcaggctgaagaaagcatttgatgataagccagctgcaggatgttgacacaggggctgtgttagcctgggtgtttggaattgccttctgagtagaattttagagctgttccttggttctacttaagtatttgataatatcttttgggatcgataatttttcaaaacaggcttcctaaattaatgccttcctgctgcataaaaagctgttccttttctttggtagattgggaaaagagcattgaaaggtcatggtttctcccgtgacttttatatgagggtacgtttttctccccctggagtttagatggccatcataaaaactggttgataatcagtaagttatacaatatactttaaaggcattgtagctctcaacatttctcagatatttattttgaaattcatggtggaagaatttgtgtaatgtattcttttctgtgtttccctatgtaatattggtaaaagcattattgggaaacaaggagagtaatgaaagtagcatcaaaacttattggagttaggggaaaataattaaaatgtgttgtattagattttttcctaaagataggtggcaaggcaacctttccttggtcaagtttattagaaacctatttcagacattgtagagaatgttgtatgtttatatagcattcctggaaagccatctgaaaatagtaatcaaaattaatatatatggcctttgatctcacagtcccacttctgataatctatcccatagaactaaaagtactgattagtaaaactgtgtgtgtgtatatatatgtatatatatgtatgtgtctgtgtgtgtatgtatatatatgtgtatgtctatatatataaatatatttatagcatcatagtatattgcatctaaacattggaaacaggccaggtgcagtggtctcacatctgtaatcccagcactttgggaggccaaggtgggaggattgcttgagcccaagagtttgagaccagtgtgggcaacatagtgagacaccattacttttttcttaaaaaaaaaaaaaaaaaaaaagccaggtgtggtggtgcacctctgtagtttcaactacttgggaggctgaggcaggaggatctcttgagcccaggaggttgaggctgcaatgagccatgatagtgccactgtactccagcacgggtgacagagtgagaccctgtctcaaaagatacaatggaaacaaagtgaatgaccttcagtagtggaacagctaaataaattatagtgcgttcactctctgaagtaatataattaaaagtgagctagaccagttgtgtaggagggatctgtatgatgtagtttaggaaaaggcacattcagagaaatatatgtaataggatttcatatttttaaaacgcaaagcatttctcttgttgcttttgtcatcacacataccaaccaagctgcgcaccttggcttgttaaggcttgaaagtcacaggttggttagagggaaaaaagtaaagtgatgaagacagacatcatagagccagtttttcatttatgtaaaaatgtatgtgtgtgtgtttgtatatgaatgtattaaatatatccataaagatatgtatacaaaaatcaaaatattgtggttatcttgggtattgctattacaataatgttatgtttttttccttatttttctctatttgaatttttttcaaggatcctgtgtttatataatgtgaaaggaaaataaaacttttcatggagtgggggacaaaagaacaatgatgtccagttttccattttgtgttattagtattctaatataaacctcaaagttttaatgaaatctgctaattcacccaaacagagttctcactttcaaatgtaatatattttaagacctagaagatgtctgtggctctgtggtagtacttcgtactgaaagcatacagctaaatgtttcttttatgttgaaactctaggacattatttattagcattaaaaaataaaagtaaaacattttggattgtagaatttttgtttaaaagcatgtatataccaaatagaaaacaaagggcttaaagactaatagatttaaccacataagagcgaaaacttcttttatcaatgcttatcataagtaagatcaaaagaaaaaaatggagaaaaattggcaagcataaaggcatactattgtgtgtgatcaccaagaaaaagtaattctgtagaaaatggaattaaaaaaaccatgaagaggaaaaaccacagataaaaaatataaatagccaggaaacataaatatgttcagtcacagtagttatccatgtaaattaaaacaacagttacacattgctgatgagaatgtaatttaatagtctttctgaacaatagttcgtgtatgtgtgtatgtgtgtgtatatatatgtgtgtgtgtgtgtgtgtgtgtgtgtatatatatatgtatatatatatatgtatatatatatgtatatatatatatgtatatatatatgtatatatatatatgtatatatatatacgtatatatatatatgtatatatacatatgtatatatatatatatgtatatatatggagagagagagagagccttaagtgggcatacccctgaccctagtaattcttcctctaggaatttattatgatttagctaattaggaatgtctttttagaagaatgtatatacagtgatatttatcatgcaactctgttgataatggccaaaatggggggaaaattgtgaatgcacaacagtgagattaaatgatggtgtagttacacaattgagtcctatgtcattacaaatcatgtgactgtgtatttatgtggaatattaatgtagaattaatttgcaaaatagtatgtttagtgtgctttccgcttttataaaaatatttatggaacactgtatagaaaaatgtctagaagaatatatatcaaaaacatttatagtgactatccctagatgatagtcagtgatttttattttttctcttcgtattcttttagctttctgatataagccccaaacttttaatgaaatatgctacctacatacatttgtcagtttacaaatataatatataatttgttctttctgcaatgaacatgtgttacttttataattagaaaaaagttgaattggctttgttcatttgagatattaagaaaaagccaaacaaccaaccatatggaaattatacacaaaagatttctccaaagttagaggaagaggagaatcaaggtagtgaacatttattaggctctaattgtatgccagttcttggcatacattatttcaactaagcctcgatttactaccttagcaaatatatatcagatacctcttcctatgttacagtcacaacaaagagtcatttatgcagaaaaagaaatagtctcagagacgtgacctttgagatcacacagctagttaagtggaaagccaagaatttaaatacagctggaattgtcaggatcctctcagtttactgctgacactaagctcaaatgactgatgtaccagaggtcaccatactgtcactaggagtggcagagcccaaaagaatgtgcatctaattccagatttttggattcatcagttgcctcctctttctcctcaccctggggcgacacacaccagacgttgcagaactgtgtgggggctgcattgctgcattaccccatgtagatgtgtgcatatctctgtaagcccaggcttggagttctcttactttcccctagcttggctacattatcagattttatgggaagggacaatttgtatcatagtctttgggtgtcctcaccattgtggcggggggagttttagttaattccttgcccctgtggtgtctctagatatactgtgctagtatatttctccattttctggtgagtgcctgtgagttttttcaaccattcaagcagtcatcgggctaaaagtttcttttatattactttactcagcaaataagcttttaagctagctcaagagtatctttttctcccagataaacagtgatgtaccctgtatattaaagggcaaagctgaacactgaaggcaagtacccttaattatgtgcaaaacgttttcaatcaaatctattgtcatacgcacaaatatcaaatttagaggttggcctttggaaaactcacagcacaacatttcagaaatcttcagcattcagcagagtctccctgaaatgttacacccaaaccagagagaaaactcttgtgatcttacaaaaggttcttgattctttgaattatatttgggataaaggagaagaagaggagttggagtgtgggaagatagatgtaagtgatggaagaatgcagtctggtggaagaatggggatgcctagattaaacaattggcatttgtaaaaatgaaaatgaagtggaataggagcgtacagaatctggcaaataataggtgatgcaaaattcagtatcaaaaataaagacagcttttcccctctgcttcctgcagtataaatggtgggtacatttttgttttcttgtcattcattccttgcacccaacttttcagagatggatttataataaatgatcaagggtgttgttttgactgttaagatccattttggtatccagctaaattttacagaattcctttcacatcacaatcttgttcctcatgtttcacagtgtttgtctttgctttctctactgagacttgttttctaattttcagcctcttctctctggtccttcatcctagaatttgcatccggtgtttctaacttctgctcagaaaccgtgaaaataatatattcatttaccgattgattcatccaaacaataattgggtacacactacataccaggtatcgggaataaagagcaatgaaaagcaagtcccttgtcctcaaggagcttagtttaacttaaaagtgttctcctatttaaggccagtgagtggctcacaccagtaatcccagcacgttaggaggctgaggcaggagaatcatttgaggccaggaatttgagaccagcctgggcaacaaagtgagacattgtttctacaaaaaaaattttttttaaaacttagcctggcacagtggtgcgtgcctgtggtccagctacccagaagactgaggcaggaggatcacttgagcccaggagttcgaggctgcagtgagctatgactgtgctactgcactccagcccgagcgacagaacaagaccccatctcttaaaaaaaaaaaaaaaaaaaaaaaggcagcatcatcctcacagataggtatagactagtatatacaagtctgaatcaaaaacaagatgaatttggaggataagtgttgctttcatgagaaaactccatctgatcaatgtttaggcacttggagttaacagtggtttttgtcacactgtgctttgcaactgcaaagatgaatacatggtctaagttaaaacatttgactctaacaatgtggattaactgaagtggtgttcactttttaaaaatcagctttatttttagagccattttagtttcacagcaaaactgagtggaaaatatggagagattctgtataactccctgtccccagacacacacaaccgctctcctgttgtcccacacctgagtggcttgtttgttacaattgatgaacctacattgacacgtcgttatcaccgagtctgtaaagtgaccttaaggtttgctcttggtgttacatgttctgtgggttttgacaaatgtatgacaggtatccaccattgtagtttcatataaacttttttttttttgctttaaagtactatacattttcttgagttctagaagtatggtgtattgattatttattgatgtcatagagttaggaggctgtacagattattaaagaaaaatgtaaggaaaggctatatttgaaattaaggttaggttcttggaaaatattagcaagctgaatcaaggtataaatctcatcttttgtgcaaagtgagatagggctgtgcttggtatttgtttaacgggatcctgtgagtcataaagcacatggatcacctagattcttgcatcttctttcctgcctgcctttcaggaaaaaaaaaattcaggattcagtaagcgtttatttattttttatttttttgagatggagtctcactctgtcgcccaggctggagtgcagtggcgtgatctcagctcactgcagtctctgcctcccgggttcaagcagttctcctgcctcagcctcccaagtagctgggattacaggcacgcgcttccacacccggctaattttttatattttagtagaaatggggtttgaccatgttgcccaggctggtctcgaattcctgagctcaggcaatccgcccgccttggtctcccaaagtgctaggattacaggtatgagccaccgtgtccgtcctcagtaagcatttataaacactgattatgcgccaggcacagtagcaaggagtgggtgctggggatgtagggggaagtgagacggttttcatgtctactaggggcccacatctgtgtagcaaggcagaaagtcctggaaacaatcaaagtttgtgggggtggttaaggacacaatgtctgtaccttgcagccaggagggacccagagctctgcttcgcaagacaagtgataaatgacgtttaagctaaattaaagatagccagccctgcctcagtctgaaaacagccctaggaagagattcctgatagacctgccctttaggctattaaatcaaaccctattttttttgttgttgggggtgggaggaggggcgcggagtgggagggttggaatcttgttctgtcgcccaagctggagtgcagtggtgcaatcttggctctctgcaacttccacttccaggttcaagcgattctcctgcctcagcctcccgagtagctgggattacaggcgcctgccaccatgccctgcccccattagcatcttgggggaatcaaaccaagaatctaccaacccttaaggggcaagttcctatcgatctgctctacggagcattaatgtctcaatgaccccagaccttgctaccgtcctcctctcaactcctgtggcacatttaatgaaataatatagaattactcctaagtgtttcatctcatgttattgttattacaggcaccatgcccagctaatttttgtatttttagtagagacggggttttgccatattggctaggccggtctcaaactcctgctcaggtgatccgcccaccttggcctcccaaagtgttgggattacaggcatgagccactgcacccagccaaatcaaagccttttgtctgtagtccttatggtgcttgaatccttttgtggccataaagacgtgttatgagtatattcagtggtatgtgcctaggaaaagaaaaagaaaatgactgaagactgggtaaagctagctttttcctatggaatccaagtgttagccagaaggaaccagggtgcattcagtccaacctgttcatgttatgcagagggacctgaggccagaggggtggtggtttgacaaaccaagattactagtcccaacctcggagccaaggcagacccaagtttcttggattctggtgggggtacattccgcagccttgagctgccccaaggggcctggagatttgcttaggaaccctatggagcccttatcagaaagatgtgtaaagctccaggctttgtcatctgatagtcatgggattgaatatgaccttgtgacctcgggtgagttacgtaacttttctaaactcagttttttcttctataaaatggagacaaaaattcatatccaccaatggaattgctctgcagactttttgagatcatgtatgtaaaatgcctgtgacattcctgggcttaggataactgctggagagatgttcacattctcattcttatgggatcttttgctgcgcagcaaccatatgatcccactggattgatgaaatagagatttggtaaagatctagtctaagaagctttacattttttaaaaaagcaggtatagaatagcttctaattgcagttcttgaattcactgtctccctgtattttgaatgtttggtagtttaagcctattatccttcctgctttactttttaatttatttgtatcagtttaacaggtagtattttaagttctcagattcttacagttatatgaaacattaatataccgtggtccctttctccaccaatacatgtacctcaagtattagagatggtgttattttgtaaagtatttcagttctttccggtaataaccttgcttgttatccaagtatttcttccgtttcagtttatgtcacattcaacacttttagtctccttttgttaactgttaacattttctatagtatttttccaaaatgatttgtattgtggtgtgacattttgatgccacatattcaaagtagagcaaaccttgaaattctactaattctgagaagatcaacaaaggaagtttttaagaaacattttccctgtggggtgagtaaagtattcttgcattttattcatagctgattgcttagaaaaaaattacacgtttctcttcctgtctgtacttctggcgccacatatttctgtagcagtgatctcagtagggtttctagcctgaaaaaaacaggtcccactttctacgtccagctaaaaaatgatttcacaatagcattagtttatatccagaaaaaaaactactagatttgaaatttagcgattgcacccatattaaaaattgatgggatgtttaataacagtgttcttatttactgtctctaattccatgcctgggcaaaatgggtttcagtttttcaagtgggcaggccagctacacttcttgctttttcaagtagtcacatggataaggacacatttccaaaattcaagctatgacatcaagtctttgttttatttggtgaagcatattctttcagaagacatttatatcaaggctaaagactctttggtttaccattgtagaatctaaattggtttcagcctgtttttttcgtgtcaaagcagtgcgtctgtctttgctttggaatagggagttgaaaggcatccttttgaagatccttcaggtgaaaagaaaaatccaaaattgctctaggaagacttgttactgacccacaacagtcaaaaataaaattgaagaagttccttgaaaagacaaattttagtcccttgaaatatggaataccttttgataagggctgatggaagactggtgctttgttcctaaacgtcattcattatcttaagtgctttggggttattcccagctgtctcccatggatgtctggaggtgaaggcatcccattgcagagggaggaaaaagtactgcgttgccaacagagttatctccaccagctgtctggggcggttggtgcttctgagaatgttctgttccaattgtggcctgagtgctacaaagtaagacacagatgtttgatatatcaatcacagtattagatgttggggcagatataaagcaaaataaaatatggccctagagccaaagtgtacattaaatgctgaacactgctcttggccccgttgggaactggaagaggcttcctcaagctcagggagtttagaatctaactggcgaatcatttaggactctattttgaaagtcagttttgaaagtgacataaaataactcaaactgacttgatcagaaagagaacttcaagtataaaaaaaatccaggtgtagttctacctagagtctcatatagtttaccatggcctggctctttcttttttctttgctttttttttttttttgagatggagtctggctcttctcacccaggctggagtgcagtggcacgatctcggctcactgcaacctccgcctcccaggttcaagctattcttctgcctcagcctcctgaatagctgggattacaggtacccgccaccacacccagcaaattttttacttttagtagagatggggtttcaccatgttggcctcaaactcctgacctcaggtgatccacccgcctcagcctcccaaagtgccgggattacaggtgtgaaccaccgtgcctttatttgcacccttgtagcagcaagatggtctcagcagctccagccttaccgtgttcaccactgagtccagcaagacagtgtctcttcccttaacagtggaatgaaagtcttaggcctgactgtccttaccccaaattgggtcatacgtctgtccctgaagcagttgtcgtgtccaggggaatgggaagtgcttattttttttaggcacagttcccctctcccacttctggagctggactgggaattcgagaggggccggtgccccaggtggggacacaggacactaaccagaaggagctgagtagatgtggaggagcgggaacagccggtgtccctcacacgggagtcagaactcatccatgaggaaacaataacatgagatgaaacacttaggagtaattctatattatttcattaaatgtgccataggagttgagaggaggatggcagcaaggtctggggtcattgaggtcttaatgctccgtagagcagatcgataggaacttgccccttaaggattggtggattcttggtttgattcccccaagatgctaatgggggaatgcctggagttggaattgatgcccactccagcgctttgtgcccctccagtggaacgatgcaacactacacaacacacccagcacaacacactcagctcttaaggctgacacaggaacccggaaactccactcttgcacaaatcacagatttggtaaaaagccagggtatgcttcagcaacagtcaataaatgagtaagtaagcgaatcgtggtacagatgcatgtcggaatgttttctagccatccagtcatgtttacattttaataaatagttgttgagcacctactcattaaaatatttggaagaatttttaaatgagaaacgctgagctgcagaattgtttacaggatgagttcagccatctgcaaacaacttagaacacaaaagcctagaaggaaatacatcaaaaagatatgtggttgtttctgttctttatacttacctgtaattttaagacaaatgaaaaagaccgcacagctgtgaactggctaaatcaagagacagcatttgaaatatggggcgtcaggcttgtgcagagaagaaacataaattaccatggttctggaaggcagggcagcagtcacaaacagacctccacctcctgccgagggctccagctctgaagatctcatcttgtgcatggctgcatagacagggatcggtgcctgttacactgggttaagagcttcagcttttcttaaaaatcttcagacctctgccttagagatggtattttgcaaagtgtttcaattgagtcaaattgttatttttccacctggtggtatcccagggcttctatcaatttaccttgtgtatgtcctctgtcctgcctcttgaggcacaatttcctttttccattttcatttttaaattttaaattttcttttttagagacagagtctcactttgttgcccaggctggtctcaaactcctggccccaggtggtcctccctccttggccttctaaagtagggattataggtgtgagccaccctcctggtgcactgttttttcagtccactcatttctgtcccctgcattttccttgggtaaagccccaggcccacttttgccgtagccttctttgatttgctttaatttgaactttcacaggtaaaacctttcataggtttcaaagcagtcgcacacatctcatttgctgccttgagatatagctggatgatgccatcatccctattaaaatatgtgaggggagggctcagaggtgttaactgcccagaattatacaaccctggtctcccaactccagcttgcagggcttccccaccatgaccagcagctggaccagaccctttcttgggaatgcacacttgactacccctgaatcactttaaaactcacctgtctctgaagacattgtttctcagcgacagcttcactagcactgtttggtcttattaacccctttcccttctgttgcccttttgatcctgaaatcttagcccatgttaagaacgcctttcacagatgtcgttgttactaagattctccaatttttagctttttgtacttacgatttggatcatttgcccactctgagtatctatttttacacgtcttttttttctccacacatggtaaattcttggaaagtgagagctgtgtttttcatttccttaatagtggatatttctgctagggggaagtttaatctgagtgagtgtccagctcaccttgaggaaataaaataattcaaccttgaatattttcatagcatttttaaaaattatgagattaaattttcctgaaaaatttacggaaacatgtgtttttcaaaattaagttggaaatattaatggccttgggcatctgcggccagcaaagtcattgccattccagaacccctcactgcagggtttcctttcgtccatttattaaatctaagccccatagtgaggagagacactgctgcactcaccaaaaaaccactgtttataaaatgcttgggcacttcagagacagcagctgttttctcttggtattaacaccgatctgcagattgccagttcttcagaatacagacctttcccaaatctccactaattttgtttatttatttatttattttgagatggagtctcactctgttgcccaggctggagtgcagtggcgcaatcttggctcactgcaacctccgccttctggattcatgcgattctcctgcctcagcctccgagtagctgggattacagtagagacaggatttcgccatgccggccaggctggtctcgaactcctggcctcaagtgatccacccacctcagcctcccgaagtgctgggattacaggggtgagccaccatgcccgatcccaaatctccactaactttaggtgcgtaggatggactgagcaattttggaaattccaaagcaccagggccctacctcctttcttctgtctgcctcccctgccttcccagtgtgcatctgctgaattgaatcattaagagaaagattaagatgagtggaaggtgagcctgttgttgctgacagttcactttccccagtgaaactgtcaggaagacaaagagatgttgaagttttagagtaagtggcccagggtcttacggtatcctgcagtgtgacactgggtagaaagaggtggaggagaaggaaggaagtggcctggcttggctgtcatgcactgccttccttcatttccttacctcccacgtactgccccccacctgaggcaagaggggaggagttttcaccttttccatatcttcttctttattctttgaaactatttttcttcttagagttgtctttggtagagtggcccttaacttagtgtacagtatgattcatacccccgggggtggtcctttctcataaacccttctttcttttttttgagatactctgttgcccagaccggagtgcagcagcaccatcatagctcactgcaacctcaaacttacgggctcgagccatcctcccacatcagcctcctgagcagctcagactgaaggtgtgtaccaccactctcagcttatttttgtggttttgtggagatgggggtctcattatgttactcaggctggtctcaaactactgggctcgagtgatcctcaagcctcagcctcccaaagctctgggcttgtaggcatgagccactgcgatggacccttcataaacgtttcaagcagcattgaaccagaacaaggagcagcgttttcagttgggaattcattgtgtatttttcattaagaacataacatttcttaacttagatgtttgtgtaacctgagttgcaagatgaatttaccacacagtgacagactttaaatttttggttttaatacacatttgcgtattttaaaagcaaatgtaccttcagcctgtgaaataatatgctagataattacaggtactttgacttcagttatgtcttagatttattataactacagtgttgattactacgaagacattgctttgcagagggagatgtctcaaaatgtcacaattcagtgttttattatcagacagttgctaaagtggatagttaaaaattgaggcctggcatggtggctcacacttgtaatccctgtactttgggaggatgaggcaggcggatcacttgaggtcaggagttcaataccagcctgggcaacatggtgaaaccctgtctctactaaaaataccaaaaaaataggcatggtggtgcgcacctgtagtcccagctactcgggagactgaggcaggagaatcgcttggcttgaacctaggaggcagaggttgcagtgagccaagaccatgccgctgcactccagcctgggtgacagagcaagagtctgtctcaaaaaaaaaaaaaatttgtgtgcagtttgtcagttatttcatgactattagtggttattcaacacaaattaagcactgtatcagttacagggttcagttaaataatacagaatctacaggagctgatttagatagcaaggcattaaatgtactagtgagtattaatagtggctcagtctctgcaaatgctgaaaaagcagctctggatagtgctagcaggtggggaatcattattttatatccagatcactagtagcaaggaaatctgagaaattaattttcagttccccagccaaagcagcacaggaagtcacacaagcagtgaggggtcgcccacgcatctgtccttggcaccctgcagccactgagctgcctcccgggcaccagcacagacctcagtagtcgtggccttgctctcaccggttccactgtccgggagacagatgtcagatacatcatacaaataccaatgatgacaactgcataaggctaaaagacaggttcacaatgcttagaagtaaataataaggggacagagtctaaagtggaggtggtgtggacgcctaggaagtctcctggaggaagatgcatctaagctgagagctggccaggagaagcagagtgagggagtgagagaattccaggcagagttgctgcgtgggaggccccaggctcgctgggagaacagagcaaaggccggggtgatcggagtgaaaggccacagggcatagagttggggacaaggtggggtcaggtagggctttgaggtcaccaaaaggatttttcctaagagcaattggaagtcatcttttgaggctgggaatagtggcagatgagtgcttttaaacaatcacagccgcctcaattgggagaaaggcttggaggagggacagagtgaaaggcaggagaccagttaagggtctgcttggtggacagacttagtgagtccagatagctggtggggcttaggaggtggagagaaactagacatccactcatccagactcagggcatggttttctggcataattaactttgtggtaagagtgcctttttagccctctaaatggagatgttaagaaagccattggtcgtggaagtctggagctcagagagtgggtaggagctagagctacaaatctgggagctgtcacttccagatgagatttaaagtccggtggtgaaccaggtaggcttgagaggctgtggcctgaggtggctcgagccagaccacttggacatgtagaagcaggctagagcaggaacagccagccagtaaaaggtaggggaaaaaaaaaaacccagtagatttccaaaaagaagaaactctccatctagtttaggaagtaatctttttgtttggaaatagaccatttctagaaagtatagaagttggttcatgtatctcatcctgctagcagctaggctgtgcctggagaagttaatttaaaataaagaatgagtttatctctgttgagaacattaactttcttgctataccgcgagtggcacctaagtgagagtatatattgaagcgagaagtccagcttgttcacaatatcacagtaaaattgagctcaaataggttctcttgtttatagagtgctctgtattttcatggtggactacatagggcagatattccttcttccattttatagttatgaaaactgaggcagcctgggcaacatggcaaaaccccatctctacaaaaattagctgggtgtagtgtcatgcccctgtagtcccagctactccggaggctgaggctggaggatcccttgagcccgggaagtcgaagttgctgtgagctgtggccatgtcactatatactccagtctgggtgacaaagggagacccagtctcagaaaaaagaaaactgaggctaaaaaacggtaagtgatatgactgtaaaaccttcacacctgcttgtaaatacctctgatagatcatcagagctgggtcacctgggaagtccctaagggagtggcccacaaggcaggccacttgggattctggaatagcctagaagatttttggacacacacttagttttattggtcaaatgtttgagccaaatcccatggatgggttctggggagatacacagtccctgtccccaaggagttgatggactaatgaggaaggcagatagaaccatgaactctgggtgttcctgccattctcttgcagcgatacaggggaacttttgtacctggtgggatgggagagggatatgaatggccataaaggaaatagaggaaaaaagtagggctgatatcgtttgctgaagaatgaatctacataagtatttttcctgggggcaggtccttccacctgcctgtgctgtgtaatttagcgaggagactgatgtgggtatggccatccctcttactgagtaaatctgtcccattatgtagctgtccaccccgttcctggtcttgccgctgagggagcatgcccctcccttggaggtgagctaagtcaggatgttcgggttaaccatgagcctgcgtgtgctaatgctttcagacttcttccttccttgtgtctgcagtgtcacccactagttattttattagctcctggaggacagggagcatgttttcttctcctggtcttggccccttgcactgtgccgggtgcaacttggcgcttaggtggaaaagagatggccgtttgacacgtgttttggctcaggggtttttctcaagttcaacagtaactccactcactcagcccttttatgtggaagatgattcatttgacagccaagttaatattttaaaagtgtgaacttaaaacaataaagaaacttttggggagctggaaaatctatagtcaaaggagaaagaaacagacattatagacccatctgatcgtggaatacaggaacatgttaaattattcataagttgcttgataactggtgaataaatgtatgatggaacatttagaatctggcgaagccttctagagaatccattaaacaaatgcatgcaacagcaagaagttttggataaatttttattcttataaattgatgacatatagctaaactcaaatttgaactattagtgaaaatattccagtgcccagattagtaaattatttttattagtgctttctggctctaaaaactggtattttatgggaaatcagagggttaattcttgaaagtatgatactgatgtcctagaatgtgctttctgccctcaagcaaatggcatggctttgggctacgttctgatgatcacaagtatctctgaattgctttctgtttcaggaatgtgtatcctctctagtcttcattggccaaattgatctcttaaagacattgtggtctggcaaagttgcttcttgctcattaagcttgggagtatgttttaaatagttacattcaattgtttccttgaagcgtgtgaaggaaatgtgcctgtttcagaccacaagagccagggaatttttttaatgtctgattgtggttaatcagttttctgttcttcctggagataaactgcataagaaaaggtcacatgtttcagggctcctcctgcaaaatcagagatagtatgaaatgacaggaagagtgttttccagtctgaggaaaatacttggaaaaggcaaaatattcattatctgtaacaagtggttaaagattttcaaagacattcataaaaattgaagaataataatgaagttgtcccatggaagaaatattcttcagattacttttcctcttctttgatactgtaataaccagagggccatttaatgtcagctaataaaggagtcacagagtaactactaagcagacttaaggaattaactctccccacaccgtccttaattgagttttttggttgtctgaatattttctgtacatattctcactcattatttggtactttttttttctttttacttagcatattttaagatacaacctttgcaggaaagaagagagaaaactgtatatttaaacagagtgaattttgtgttaactctgaaaggacagagactggaaggaagataagtcagggcttgaatattccaggaaggctttgaggaggaaggaaataaagtctgaacagccttgaagaatgggtagacgtaggaaaggattcaggaaggtctttagataacaaaagtagagatccagtggctgagatgttgtcgatgttttatttttatcttctaaatgcttttcttggaagatcttatttcttttcacacattgtttttcttttgtttttcccagctctctgcttccagggctaatggtgagttttctgccgtgtaaaatcccaaagggtcgcttgcatgtacttgttgccagtagcctgttttcattgggtcatttactgtggtttaatatgccacttccccagtggacctgatgtgaagaaagtccccacaatcctgtcttctgtgacctttctgaggccttttccttgttacttggaacaaagatgtgatagctgattgggaggagagtgtttcatgtcatctatcacaccagtcactttgtttttccatgttgttgaatgcagattgagttactgttgtggcctatgttattgttgtccatgttgtgtagatctcatgactctctgatggtgtttaagatgggatgcctctgccatcaaatcccaggagagcctgtttttctccacctcggtcctttcactttcttatctgcttccctgcctcctcctctggtcccacaagcctttcacaaaatagttaacatatttgctttaagacagagcttgaaaacacacgcacacgcgcgtgcacacacacacacacacacacacagtatttagagactagatactgaattgtctgatgagacttagaatttgattctcctaccctgtatcttgctaccaaaaatggcacatgggcacacatacacacttttaataggcaacttagagcccatgaaataatgagagtaataataatagtagttacgaagccttgcatttcctattctgctttggccagagagcaataaagcctcatttaaaaagcagctttccatctttctttgaaaaaactttgtagtagaagtaaacaattctgtttgtttcagtgagagaaaacacccatggatcagccaggttgacagcctagtcagcttgcatcctggtttgtttttttttgttttgttttgttttgtcttgaagagtttttgctgaaggaagcattagagttctacttaatatgcatacaatagaaagtagtaattaaggaaaaggatatatcagccaacctatcttaagaaggatctaactagataaactttgtctttaagacagtcctgactctcagactccacaggtgggtgcaaacaacagtgctccccactggagatcctggggcccactttggcttgccttcagaaagggaagacaaagtgtccctcccaagttacaaacgcaggttgtatactgtggcttttactctctgataaccaaattagccttctaaacaactattctcagcagaagtaagggtggtcttgatttttgtgttttttttgccatccatactagtctgcttcctgtcttttcagagagcaaggctgtttgtaagaaaaatgtgtgaactgaaaaccaccactaccacctattagatgagtacaagataaccagaaaccaaatacgaaatgagctgtcagagctgttgataagctctcttgtgtgaaaggaaagaataaaaatgcagcaaaaggccatgagaattatttttaaaagtaagactatagacaaaagtccaaggaaatcttaatctccctttctctattcctcttgtctcattctccagccaactttagggacaagcaatgtcttcatcgagaggcacatcacatccccaaaggtgggttcttggtgaccaaagtacctgcctacagaaagcagagaagcctgttttcttccttgtgtctgtaggaaagttgtctttcagatgtagtcttctttgttcatctgttactgtgcactgccaggctgaccccttttctcaggcagattgatcatgaaattaaaaatggtttacctgagttaattatattattaggctgggcacagtggcgcacacctataatcccagcactttgggacgccaagatcggtggatctcttgagcccaggagttccagaccagcctgggcaacatagggagaccccgtctctacaaaaaataaaaaaattaatacaaataaataagtagattagctggtgtgttggctcgtacctgtagtcccagctactcaggaggctgaggtgggaggatcaactgagtccaggaggtccaggctgcaatgagccctgagctgagatctcaccagcttggagtgtagaccctgtctgagtccctgagtgagaccctgtctcagaaaaaaaaaaaaaaattaagtactatcttcatgtttttcaagacattttccacttgttactttaacaaagtttacagtattctacttgttttcattccttcaaaactaatctttttctttcttttcttttcttttcttttttttttttttttaaagaaatagaatctttctctgttacccagaactggagcacagtggtgcaatcgtatctcattgcaacctgaaactcccaggctcaagtgatgcttccatctcagcctcccgagtagctgggactacaggtcctgccaccatggctggctaatttttaaaatgttttgtagagacagggtctcactatgttgctcaagctggtctgaaactcctgggctcaggtaatcccctcacctcagcctcccaaagtgctgggattatgggcgtgagccatcgtggctggccctaattcatttttaataactaaccagacacactagtggtgttatacgtgagcattaatatttttttgtcatcgtcacccatttaaaaaaattgcgttttcaaaatgagttgcttcaacctagtgtggagaatcaaaattttaaaagatcaaaattttggtattttaaaagtcaattctgaccaattatagtgatttggttctacctgatagtttaatatttctttgctcttttagtaagtccccagcatagggggaagggggtaggcagtaagtcttagaaaactgtcttgcgaatttactgactcttatggattgggaatttctaggagtatctggaaattaaccgaagcagttctttttcttctccagttagggcaagttgccatgaaacaaataatggtgacttggttggttcatttagttcatttatttattgaatatttatggcctgtccactaattacctggcacaagtgtaggtcctagaagatacacactagggaaaaaatagacacacagactagatccctactgtcctgtcttacattctaggaggcggagagaaaatgttaaaaatgaacaaagtaagttgtcaagtcaggtgctaccaagtgctagggaaggagattagagtggtgggtgccatctggatagggtggtgaggggagccccatctgctaaggtggcatttgagaggagacttgaggtgagagactgggaagtgaggtggggaccgaagcctgacagactagccatgggcaaaccaggcaggagtttagccaaggtgaggacttgtagaggagttgggcagggatgtgaaataattagcttgatgttctgcataggatgccctgggctgcaaggtgtggaactgataagccaagacctcccaggaggctttgccgccatctgcagaatcatgctgatggctttgaagagagaggcagtggtggagagaagtggctgatttggggcatgttttgaataaagagcccacagatttgctgaagacttgactgcagggtgagaggggagtcagagtcaactccgggagtttgggcccaagctactctgtgcatggaggtgctactctgtgcgtggaggtcccactggctgagagagggaggggtgagcaggagctggttgcaggccaggggagaacaggacttcatatttacgtgttgtttagttttggggatgcttgttagagatccagctggggatggtgattagcaggagtttagaattcagtggagagattagggctagaaatgttttaaaaactgagagccattgcactgcagatggtggggcaggctgggttctggaggatgataaaccctccaagggaaggggaagtggccaggagccttccaagaggcagaggcgtggtgtaatgtgatggtaggtgcttcagaggggatgaccgcttcagggaggaggagggaatgggggtgtgggattggtcaggaggagcacaaggcacctaccccatcttctggttctgtggttcctgcgcagaagaaaaaaatacttgaggggggctgcaagggaagtgtggtccttggggacaatcagaatttggctggcatgaaaagataaaggttcagcgttaggttaatttttgctgatgagaaattatgactcttggagagccccatggagggatttgggggcctgggatggcaaaggttcaggtcaactgggtcaggttaggcaatctttggaggggaatggagcgagctggtggctagaattcttgtaacatctgaattaaacagggatggaaggcctggtgggattaatctgccttcctaagacagatctaagggtgagcaaactttttctgcaaaaagacagtaagtattttaggcactgtatttaggccatacagtttctgtcagtgactcaaacttctatcatagcacgaacacagccatagataacacaaatcaatgggcctggctctgttccaataaaacgttattgacaaaagcagccagcggccagatttgcccataggatgtagtctggcaaactgtagacaagggagttagtaattggtgagagagggatgaggagatgggtgggaagaaggggcccgagacttggagttgggaaaactggagctccaggagccaagtcctcagtctgtccccatcctgatgaggtgtccatcacccacagggagaactaggtgtttccactcctcctccttggtgctggagccttttgaaaattgcttaatgaaataggcaggtaatcccaggtctcatattcaggagcgtgatgagcttctcctcatctccacagcagacagactagaggaaagagacttaagatgtaatcagagatgtttacattgacaaaagaaaacttcttggcaggaatgaagctaaaatacatgaattactatctaggaaggtctgaagattgttggaggttagaatgaacaagaccaatttccttctcttacctggaccacagagactttgttggtcttttccaagccctagatcttttcatgtgaatgtgtcattgtcttaactctataagaggcaaacctgttctaactatcgttttgatgtgctataaatacactgttctattatagatctgtttataaacagatcagtgtgtgtgtatatagagacacacacactgatctgtttataaatacacatataaatatacatacagacacacatgatctgtttataaatacactgttatagatactcctaatttaagaatatatatttaaaatttctcaagttgcaagtggtaaagttatgtttaattatttatcttaataaattgaatacctattagtgacattctgagtgacaaggttgatttttccagcctatcctagtattctttgttggtatgattttatttgccaaaataaattggtttgcctcaaaccacacactaggtgctaagtatcttcaaagcaaaattcaatgaaacttgaaagtgctataggactgaggttgtaagtgacagaaacccaattcagactaagcagaaagagagctttgtctccaggatccgagggtgcattctggaggcccgagctaggatgtggagcaagggatgtggctgagcccacagtgcagctggaaccagggatgcaaatgccgccaggacctctctgtttctcacctctgcttccatccgcatctctgcctcctccaggccaaattttggtgaacagtgactgtgtccattctttatatctcatcattaaattatgggaagagtcctgcgtgaaagtccgaaggtcagatcctggaaagaaaactcattggtctgcttgggcttggggccagccttggccagccctgaacaattctggctgcagagtagagaaccctgtgatggccagagaatagggtcacagacatatagaatcatcactcctgtggtaaccaggtagatctggggttcagggaagggtgagatgtgggtggtgagctgggcattcaaaagagaaggtaggccgggcatggggggctcatggcagctcatggcctatagtcatagtgctttgggaggctgaggtgggaggatcacttgaggtcaggagtttgagaccagctgggctgatctcagaacccatctctacaaaattttttttttaaaaaaaaacctatctgagtgtggttgcacgtacctgtagtcccagctacttgggacattgaggtgggaggatcacttgagcccatgagttcaaggctgcagtgagctatgattgtgccactgcactccagcctgggtgacagagcaagaccccatctttaaaaaaagaaaaagaaaaaaaaatgatcaggtatatgttaagtaaacatgaaatctatataacagaacaaaaattcactcttatgtcaatgtcagcgtgttaatgtagatctatttactgagacagactctgtagtggcagagagtggccttgttaagccaggaccctgttctgcaggctgtgggtagaagctaggaagtccctggagtttcacccagcttttccatgaatgaccttggcctcagtctcttcatttataaaatgagggggttagattaggtggtctccagagtaccctccgagtctaaaactgctctgtctgcagcatcatatgtcataggatataatagactctacaacaaggtttaagatgacaaattttaaaaatactgctgctacacaagcatatattaccatttgttgagctgataaggcttgataatgtaattggaggcattaaatttttttttcaaaatggaatatgaataaaattttatatttctcccaaatatttctctcagttcttagaactgtttattacttttttgcctgttattttcccactaggtctcattgggctccacatccttgctctatgtttatgtagaatattaaacatcattccctttcatctcactgcaactgcttctctgtttcatccgcactttatttccactttgcattagggaatacaaaactgagccatgtttaagcaacgtagtgtcaatcaccccgtttagattccattttcccaggcggaggagaaggtaaataaattggatccagtgagaagcctggatattaggatgtgcccatcattgtctctttcagcagaactccacacagaggacaggcaatcccctaggctctgcacgggtcactgggcactccaccctgctacacagcatcagcataatccactcccggagccctttgtggggcggtgggtcttggccagcctgttttccccacagctgctgtccttagaccccttcatgcttcacatgcattaaaaggacctggtgttgacaaacaagctgaggctcctgtgggatgaatctcccaactgggaggtgctcttctgtgtgcagaaagagcacctgattgttgctaaggtttcttttggtaccaaaatagtaccttgtgctaccaagggaaatactgtaggagtgaatttcccagatgcaatagccgtcatccttctttgatgatttatgagtccctgttaagtcaaacattttctttcaatattctaaaattaacaatttcaaaaatctagtgagcttcatgtagaggattgtgttttaataaaagtgatcattcaaaacacctgtttaactcatagctttcaattccaatcaaagctctgttaatcctttgcttgggatgtcttgatttttctttttctttttccttaaaaaaaaaaaaaaaaagacaacacatccatgcatccattggattgatatttgattcttcttggtaaaccgccagttttaattaagtttgcacattgatatctggctggaaattggatgaaattcagcatagtaatttccttcacgtgttcttcgtgttctggagcagggagtgtgaatttacgtggctgaagacattatgtgactttaattacacctgcttttgtgaatgaaatacaactttttagttttgatggtgttcataacaatccttttatgcttcttgaagggaagggatcagtaaaaggatattcagttttaagctatggcaacttttattcactatagcaaataagttcacatagggattttagttaggaaagcttgcggcattttgtattgtgaaaaaaatgtactctaattttaaagaaatttcaggatattccgtgaattgtgcacactctatgttcttgacaatttgtattcttgagtatattacccacttttttccccactcatttttaagtcaatttgaacctaagaaaagttggacatatacataccttaaaaaaaaaaaacctcttaatcctaattctcaaatggagaaattagagaactatatttgttttgtgtctctaagttaatcaaaatgttaattctttttttttttttttagcttcttttgatttctcaagtataaagtaaatgggtgtttctggtaagctcagctggtgtttctctgagcactttttggttttgttacgtgcatgataaacatgcatggtaaaggttgacagttacctaaatggctttcggtattccttcttggcttccttggattttattggctaattgatgtgctttaaatgtttttttctgatgtctttgatttggtggatgctctttactgaggattctttctgtcccatttcctaaccaccacatcttgaccatgagtcattgtttttctatcagtgtaatcaaattaatttgatttagttgaaggtatgggctagggcttctggtggccttgagaatataccttccaattttgctgtcatggcactgttagccaaccacatgctcagggtggtgctaacaaaaacactgtctgaagaagactttaacaagtgctaatattaagattttaaccaagtaagaatcactactaagattcttacacgggcataatacttttaatcttacagaagaactgtaataaatattctaaggcaccatgatttttggactttgtccttcactgaacttcaaggtcctacatacttaaaaacaaaagccaaaaatatgtcaatgaatttctttccatcaaacatacaataacaatagaaaagtgggtttttttccctcccccttcaaaaattgatccctgttcactaggagaataatttccgtttaagatacttattttgaaaattacttagatgggatccagaaaaagtaaagggaaaaagaataaagagtaaaaatgagtagttctgttgtactcttcctgctctttccttttggttacgtatttagtttgaataggaatgctttaagacatacttaaataataatttaagtcaggaagactaattctgggaagaggagaggagaacagttattgagagaggctataaattgaggtcagattaaccaaagaatatggccatccatatagaaacttaatatggagacagaagagattgttcaaagaaaggggagagtgtggcagagaagagtggagttaatttactatgatatacttaattttatatggggtattttaatcaaaacccaatgctttctatatttattttcattataaattttattcattcattcttagcaagtacactcaaccaggatgatcaaacctgcttcaacatgtaagttattatccaaaatgcagccttcctggagccccattggggatcattagtgcaaattccactgtgttctttggtcctgggggactgttcaggaggaaggtgatgccagaattagccgatcgaattgcggcactcagtatctccaaagagcagattttccagagatagtattcacttatacatccattacagaactgtcttcatacttattttcagattatccattcagaatcattctgtgactctgaaaaatctgttttagagtatacttgctgagatccttttaagtaaacaagtactttttacattgtccagcttgatgggcatcaagactgttgaatgaacacgttttgtgggattttacactctttgtggccgagttgctttgctttggtggcttgtgtctgagttgtggtttcgtctgggcagcatggttgctgcagccttttggccggtgcactttacactgcttgtcttgctttgtgctgtttgccacctggatgattccatccagccattgaacctcactgcacaaagaagaaaagaacaaataacccatgtgtgttagggcatgcaagatgctggctttcttgaggatggcaaatctatgaatagagtctggataggctaagttatgcagcatgtgttgttatgtttgggcaggtttccatagtccaaggcacatcagctgagcagtagcaggtctagcttctggtcttgatgctaaaagtaatttcttgtgttattttagtaataagtcacttatttggcttcagtttattaatctttttgtcatctttaggtcctttaagctcttaaactatggaatctgtatcttagatcgttatggatgggatcaacagatgaggatataacggtttgaaaagagccatactgacaaaggtgcttagttccagagagaccaacctaggtgtcaaatcatggggccattttcactcttctgtgggttttaaaatatacacttccattccagacctaaagcttgtttgacgtttgctcttccttgctaccctacatagacatacattgcctccatctttaaaatgctctgtagtacttgtttattgctattaatgtataattggcctaaaacaacaagtgtttatttgctggggattctgcaatttgggctgggctctgctgcgcagttcttctggtctcactcacgtggctgcagtcacctggggaatcactggatctggggctgttgtaaccaccttccagaagaacaaacccagggctcagtgcttgtcaggcttgtgcttatggtcttgtttgctgattgcccactggccaaagccaccctcgcggccagtaccagagtcactgtgggaaggggctgcataaggatgtgaacacctaggagtgtgattcatcggggaccgttaatatgcagtcgtccacatatttacacgctgggcttgtattttgaaagtctgtactacagacttgaaggacatgtctctattccctgtcctaggctgtaaactttcagaaagttttgcttgacagtatctacacccctacagcgaatgaggtgagtgcataataagttttgactgtgtatggcagctcatgcctataatcctaccactttggggaggctgaggcaggagaatcgcttgaggccagaagttcaagaccagcctagagaacatagtgagaccttgtctctacagtgttttttgtttgtttgttttaattagctgggtgtagtggcacacacctgtagtcccagccactcaaggggctgaggtgggaggatcccttgagcctgggacgttgaggcggcagtgagctgtggtcataccactgcactccagcctgggtgacagaatgagaccctgtctttaaaaactaaaaataaataaatttgaaaaataaatcagttgtggtgacagaggtgggtgtctgtacttccctgagtatggccaggagagaacgtttcctgttccttctggttctttctccagttccttttcaagactccattgtggagtcctcttcctgaagattttcacaatttttttctctctgaatccctttgtggcgttatcaattcctatagctacgcttttcctaaagctttaaataaaatctctttgccgattacttctaaatgttttcagcctcagaaccacatttgtggctgcatgttaaacatctccacatgaataatctgtggacaaaccaaaataatgcatcttctacgtaccctaagtcgacttctctttctgcgtttcctgtttttggtaatggcttcaccactcttccactctcaagggcgtgaaacctcttaagcattcctagcacctgttgcttggtcctgcattgtgattctggcctccagtcctcatccttgcttcaaattatattccacacactgagctccttagagggtcctcgtcatagaaccccccggctcataactttccatgcttcctcgctgcccacagaactcggcctggcactgaagatccccatcagtttgggccttttaagttcttcagccattttctgggtgtaatgacatgctctcttgaataagaatccaaatccaagtgttttccctccttcagggtctggctccaacatttcctcctcctcagacaaactcagtgggtaacagtctcttccctctcaatactatcacagccttttgtgctgttagcaacttttctttttatttaaaatggacattatttttttacagaagttttaggttcacaacaaattgagagaactgtgcagagagctcccacaaagcccttccagacacacacattcagcctccccaccactgacatcccagttggcaccagagcaggacggttgttacattcgatgaacctgccataacatttcattgtcaaccacagttcacagttgacattagggttctctctgtgttgtacattctgtgggttttggcaagtgtataatgatacatacccaccattatattaatagtatgatacagaatagtgtcactgccccccaaatctgtcgtgcttcacctctgcctccctccctcccccaaatgtgctgcacttctcatactcacctcactgtttctgttgctcacctatgactctctccaccccatcgtagtcttctgttactatatagatctctaaaagatgtagattacatctttgaaatcccagttaaagtgcagtcattatctcctaagacccaggttttatagaaattggaaattttctttggggacacaagccactaaggttagtggttacttaagatgaaacttgacaggggagacattttacagcctagtaaaggtcagtaagtatttggtgacattagagatgatttatgctttatgtcatagttgtgtatgctccctcctaaatggtttctctatagattaaaaaaaatgtatgcttcctaaaacactttacacctctgctatggagagggagagagagaaagagagaagaattggaccttggacaggaatacataagtgcatccttctttaaggcagtctccatttctaatgtgaataataacctcttaattggttttctaaatttggacttataaaagatcctattataagaaacaagcgagtaaatgccaaacaggttaacagtaacatatgcagaatatggtataatattgctgcaaagaactcggccaaaacggatacagcgttctaaagttgttggaacagccttgtcagcaagtgtctaaatgttcccccaaatctgtaaccgctaaaggaaacaaacttgaaaataaacaagaagtaccataggaaaggaaggtgatacaccagagcaagacattacagtttcctatagcaaaaggtgtgatgcatgatagttttagattggccagcagtaatgaaacaggcaaggccacttctgttctgtcccgtcctctttggctgggctctttggtctcttctgtgatttgtggacacagttttcacaggtgctcagggtggcattgcctctcagctgctctgtgaaatatcagctgcaggttctatgttgagttcatgttcatagtgactctaagtcccataatcatattttgatttaactacattttgttttcaataaaagtcagcaaagatctattaagcgtctactctggggcagccctctggggacagtgatgacaatgacagtgaagtgcctgagccaggcactgttgtggactccgtttttcctcacagcagctccacgctcctagcactgcatctgagatgccttgagaagccgacactcacttttctacctgtgaattcgcttgcttggcctcccgcttgcttatgcccagttgcctccatactggggcaaagatccgagaaaacaaaactacatgcgagtgtttagcatttattgtttccttggtgaccagttgtgtgaagcatttttggaacatattgcagacagctctgggtgtggcgagaaggaatgacggtccgggtgagaaggactcagcgcctgccatgtctcggatccctttgacctgggtttcttgccccaaggtcccctcccctgcctgtaccctttgctcctggctccaaggagcaccccaaagttccagcctatcctgaatgatgaagataattatattttttccctctccttactggtagctgggacaaagttgggatttttttccatgaaggtatttttactgtgggtaagtgggtaaaataaaaagagcagaggatcgcatagacttacagaaagtgagtgtgttctacagaaaggctgtgtgtttgtttaatctagctcccatctacctcgtaagcagctttccctccggctactttaagtagttgagcaggtttttctttttcttttaaaaaattatgtccctttcatttatttatgtgtttataaaacaagaggcagttgagagccatggccaagagcccaggttctggagctgtgttgcccagatctgaatcccctgcgccatgcaaaggtctctgtgaccttgagccatcacttaactcagcctctgctttcctactgtaaagaggggggctgtgtaatagttgtgcccatttcacagggttaaggtggttacatgggaggctattggggtggttagcagatacccgatgtatactaagccttaaataaaagttagccttagtgatgtattgttatgggccattttttgaaatgatgaatgttgaggatgaaaaggggccatacaaatagaaaaccaaagaatataaaacaaaatatgaaactcaaccgcttcctacaagtaagatatttttttcttttgattggaaattatccatcaaatttgataatgtaagagagtcaagaatatattatgtcctatttccccctaccttttttccccataatttttatttcaaaataagctctagagattcttagctggttcagcaggtcatggagtaaaattaaaaaataacaatgaaggggcactgagctaggtgccagggatatgagtgtgcctggtggcctacaccggaggtcatgcttcttgcacatggaatagagcagatgacattgcttatcccagtggggtgtgagagaaatactccaattaattgtatgtaaggtgcattttgtggcataaaaatgacaaatccagctaacaccaacttgtcaactttagtaaggatggtgcagattattagggagaaaaacaatgttgtacatactatactaaaaataccattttaatgtttgtttttattttcattttgaaacaatttcagacataaaaatgtagcaaaaataatacaaagaactcccatatggccttcacccagatgctaacatcttatataacaaatagtacagttatgaatatgaggaaactaacactgatacaagatgactgcgtaataatagaaagctcttatttacatttccgcactcattccacttttgttttctttcttgtccaggatcacctgatgcatttggttgtcatgtctcttagtctcctttaatctggactatttcctgtctttgtctatcatgacctttacacttttcatgaagactggttattttgtagaatggctctcaccgagagcttgcttcctaatgattacattcattatgcagttttcacgagaataccagagcgttagtgttgtgtccatctcagcgcacgtatcagaaggcgcgtgatgtccactgatctcatcactgaagctgttgactctggtcagttggttacggtgatgtcagtgtcagctctctccactgttaagtcactgttgtttccctttgttcttaagtatgttgtgggagatacttagagattgtgtaaatatcctgtttctcagcatacttttgctcaaaaaaattgaacatttattgctgattcttaatgtgtaacagttattactgtggtatttgcaaattgctgattttttaattttcattattccttctacatagttgaaattgtactgtaaggaagagtttcctcttcttccatagaacgtgaaatcatagattcttattctatggctactgtattagtctgcttagacccaccaccaaaatgccatcagttggacggcttaaataacagatacttattatctcccagttctggaagctggaaagttcaagatcagggttctgacagggttcggtttctggtgaggggtctctttctggcctgcagatgaccaccttctgcccctgtcctcacatggtgggcctgggctggggatgggggcattgagctctttggtgtctgtacttaaaaggacattaattccatcagatcagggcccaccctgatgaactcatttagccttaaatacctcctaagggccccatctccaaacaaagtcacactcgaggttagggttgcattgtaggaatttgggggagacaaaaacattgagcccatgacagttacagtctgttattatcactatttacaaaaaggttattaaaaaatatttggaagagggattattgctaaagcaaagaaactctgtattgaccatcaatacaaagtaaaactgaacgtcgtatcctgtggtgtgttagtataccgtgtgtggcctgttgtgctgctttctgggcagggtgcatgacttggctcctgatcgcgagaagctgtcattttagttcctacctactctcttgtccctgttgccatgttcctgtccattagtatttagtcttgtaagaagaataagagaattgatgtgtcaaaccttgcctgagtctgctggcttaattgggtggatgatgatggaaggtgagaggacccagaacccaagtatgttgtagtaattgatagatggtgagtcatccctgcaatttgcatatcctgtcccagctttagaggactgttggggattttgaaaccaaaacttaacagaatatgaattctgctgttgctcaagtttttgagtttgttaccctttgtggctcattctgaagttttgctgataatcatatatttgctaatgtctaaaaacagaacggttgggtcactgctgtaaggcagataaatacagcagttctagaacctgctgacttggtggattcacatctacaagggaaagcagttttcgttgtaaaaatccccatttcatgtataagaaagatgattcctatctagtcatgtttttaacagtcatctagtaattctgtattttaacatctaagtagctacttatattctgaatagctacaaagcagagcacttgaaacaatctttaaaacatagggctagaggaaaaaatataaaccacatgattaaactgttatggtgatcatcagggacagtgtaaatcattatggaaattaggtggaggaaatggcattgtatcattaccagcttcatatcaaacaaaaaggctgtttgatatgaaaccccagccctccaaataactgggaccacaagtgcatgccaccatacctggctttttttttttttttgtagtcatgaagtcgccctgtgtttcacaggctggtgttaaaactcctgaccttaagcgtcttccctccttggccttcccaacatgctgggattacaagcatgagctactgcgcctggccttgggtgtgcttttggagtcagatggaaacttcttgagaaatacagagagcatcttgtagctagtccagtcaaccaaagacatttttggagaacatctaataccgcttccttttgtcatctagtgaaagtaaaatatctttttttcttaatcctgttttgaagacatcttatagaaaggagggctcccctgctcactccttctttagaattgaacacttttattatcacatgtatcatgtatctacatgtgctaataaaaacaaaaactacagcaaagactgggttgtctttggttggaataggaaatatatttcctctagagtgttaaaaagggtaagagaaaactagtgaaactgatttagctaatttagtcaacaagttaggaaaatgacatttcctaaagttctgatggggttagctctacctcctcagtggaaatagtaaaccacctggaattttacttttagtatatgtcattatttgtattttaaatttatcttcagtgttgtttatatattactttaaagtcactcttgatttttttaattataatacagaactttgttttcttttaaaaggacaacttattttatagttagcatagattgctttcctcgaaataaaaattgtcattccattctagcatcctctgccaattgcagtatgactcgaggtatgactgcagttgtcttagaatcataggtctagtgagtgctttaggcttccacatttttgaaaagaatgcaagtatggtggacctttaaccacataaaagtaaaatattaaatgaagcatgcttttaatagccatcctgtcatttttaaggtttcaatagtgtatgtttagaggcagtgaatttaaaagtgtttgtatattaaagcttaataatccttaagcattattaagtttctggtaaattgttctgtttgatgggctgtcaacaaatcatgtggaaataagagagaaaattgttgttttggatttttttagcaaggagagttatgtaaaccaaaaacaaaattctgaggtccccaaaccatctgaacggacccctcctgtaggccaagggtgttccaaagttaacctgaaaaacgtgttcaggccatgatggaagagggggttggacatgcctcattctaccattttcccttttggaattcaggagaagccaaccagcattaacctcaacacagatcttaagtctgataagaagcatttacagtctgttctttctgaagcttgctacctgaaggcttcatctgcatgatatacccttggtttccaaaaccccttatcctaactcagacattgctttctatagaataactctttgaaccagttgccaatcagaaaatttttcaatctacctatgacctggaaggcctgccttcccctgcttcaagatgtcctaaccaatgtgaatcttacgtgtatctgatatctcatgtctccctaaaatgtgtgaaactaggctctgccccagcctccttgggcacatgttcttaagatttcctgaaggctctgtcatgagccgttggtcactcatatttggctcacaataaacctcttcacattacagagtttgactcttcgttgacgttactgtttcctgagtatacagcaacaatttaaagcatttagggtacaattttttctgtgatttttgagactttttctaacgatcaagattcatactataaaaaggacttaaataatggatatgaacatttataagtttgagatgctgtgcacatttacaaaaacaaacaacttcttcaaaaattgcttggctggtggaattagtctgtggagaatattttattgaatttattttatgccagtaaaataatcttttagtaagtcatcttgtgtttaatcagtctaaactttggtaacttggtaaacagaaacttaatcattggcattgtagcttttgggtttctgagagatcattatgaatatcaggatttttctttgctagatataatagtaaaatcactttaaaagtttataacccagggaatgagtttaaaatttggtcaacaactgtttcttgtagttggttcctgggatgtaccaagtgtgcaaaaatgaatagatctagtccccacccttaaggtagctgtaatattgtagggaataatgacaaccataggccaacttttctctcattaggaaaaattgtgttttatcctgttgtgacagctaatgcttatattcttacattctccctagactgtctttacataagaaattactagagtcctcaaataaagaatatcatggggattcttaaatttgacagtaaaagaccttgcacacaggcaaagcccttgcatggtgaggtggcagcaatgaaagcacaatgtgtcatgtatcccagcaggtttgtacaaagccacagccagtggctttccttatcttttttttttttttttttttttttttttttttttttttttattacatattagcttttggttaaacaaatgcaggtctattttcagtatttctttcacattcttgatgagcagggaaaggcaatgtattagagtttatgtaaaagagatatttgtgagaaaatattaaagaaactaatacgctatttaagatctgtattattcacctaataacctttgagagatcacttagggcaatctatgctgttcctaggaatatgtgtgtgatgctgggtggtttggtgggagagactgtgagagttaaatactcacagtctgcattttatcttgatgaaaactgttagcctcaaatgattcagaagaatttttagaggtttccaggtttaaaatgtagtgagaactgcctggattaaatctgggtagattgcatgcttgattcatgttcatagcatatggagaatgagaaattaatgttaattgatctaattaggaattaggattctctgacgtctaattctctggtttattttgctcatcttttttttatagttgatagaatacatagaatgcgtgggaggagatggggagaagagagaattatttatgcaaaactcatgtgatggcaaatgccctttttcctaaagtaatgaaaacaactagtagcagttttgttctcttgacagtttgtgaataggaatatttgtgggtaggagatatatattaattggcatgacatatttttgaaaatgagtcatgaaactgtgacagttgttttttactaggctaaaagaaagtacttgttatttttgttatttgtaaagctaaagtatttttttgtgagtatacatgcgtctaaatatagatgaaaatatcctgttttcagctatgaaaaagaaattgagcttatggttgttttataaaccacacccctatactttacattaaaatatgaagtaaatttgtatctataccgggaagtgattttctgcacttcagtgtgatgatggaatataggtgtgctaaaacctaaagtgaaaaatctttgtaacaacttactgtactgggtagctcatccttattctcctcaattttcagaaacattttcaggcacaaaagaaaattatgtaagaaatgtagtgtggtatgtcttataaacaatatcctcgtgttctgaatacaatagctttgaaatattacttgctaaacaattatttctttagacaaaacttgagttgtctcttggcttttattcttttaacaacatgcatttttagaaatagtctcttaggctaaagaacataactcaccaggaaaacatgattaattcagtatatgagaaaagctctgagctcaaaagcaagttactctttttttttaagcagaatatattttagaaatttgggtaggagaaattaatatagaagattgggatttagatatcaaaatgctgagtaccccatgcagtcatctgatttatattccgaacttgcatagtttttgcaggctcctggaatgcagcctcccaccaggccatgggaaagactcagcgggaccacgcaggatggctataatgtcatctctgtccatgtggcactcacttcaagactccagagtccagctagaaaggactctggagtccattgtgtaggtgacattggtgtaagcacaggcctttatcagaagtctgaatctaccttttcttcttgtgacccaagagataagaaaggccatttcccctccctcctgagttatttaactttatttctcttctgttcagtgagaataatcttatttcagtgttgcgaaaaccacgtctatgtgaaaggtttttgacagtgtttaaaacatgatattgctgtggctaagcgtgaatgctgttgtcgtggccctgcctcctgcctctggccagcctgagtataagaggatcactttctttctcagcactgccaactaaatgccaggagcatgtagaagaggagaggatcgtatcacaaatacctggggactgttttgtttttttaactccaaagcccaccgccaaatatcctgtttcctcatccctggggtaatagatgcataaagataggtgtattttgaaaacatctcccttagaacaatagactccagatttttttggatcacatagctgtgtttatgtgaaatcagggcatacgaataacatgtattgtgatgtatacattatagtcatatagaagtattaatgttctatacattttaatgcatatttaagactgaaaaaggtaagattaagtattttcagtaattttaacactacagaaaatcttttgctctccgttagagattttttcatgaaagcagtaaaactaatttttgaattttctgaaaatgttgttttaatagtgattttttaaaagcctagctcttaagtttagcatattttgattgtcagttttaatggctttcattgctgaaaaatacaccccacaaagatttgtaaatacaagtggaagaactgtatcactggccatttttactaaatcatacgaaattattatgctccttttctcaacacatctcgccagttatacaaaggtttttagttgactttcagatgataaaattttattctgaaacttattggaagtttattgtgtttttaaacttttaacaaatagattcaaaaaccattaacaaatgggtttgaaactctctggcaagatttctaatacactagaatattctatttccaagttactaagtgtgctgatataaaagttttcataggtgacacagtttcattgtttttggcaaaaagataacaaaacagtggaaatattttcaaacatctgtttgtataatactctttcaaagctttggtttctcttgaaaagcagttaatttcttactcaatgttgagtctcacctttactttgaaaggaagcgtaaagtgtgctgatttttttttccccctgctaggtaacatactactgagaagcacctctgacccctgcaaaggtccatgaatttggaacacatgttttataagggaaaagtgcatgactcatctcctaaattccacaacttttttttaaagtgcttgcattcttcttccctctcaaccatacacagtagttctttgaatacaggaaataagttagcaaatacccgaagcagagaaatgttagaatcatctttactttgatgcaattctaaagcaaacttcataggctgtgtaatttattctaatccttgagtcttcaaatattgactggtgtttctatgcctctgcccgcagtatttgctgacaaaggaattcattcaaatttgatgccatattggtttttacatgctttaagccatttttgccttggtagaaatagcaagtgcttctccagtaatatgtggtttttagtcttttcctagcagaggaacccagaaagaagcttctacatgttaatcattaaattaataaaattttgtgaagtactgaatttgtagtgtagtactgcccaatgttaaacatagtgaagaaaactagagttgtttgtcttcaggtcctgagtgcttagattttaaatgacttgcgcattttgatagctctggagtatcattagctggtatctctaggcacagtgtacacttagggaagctttatcatgaacaaaaatgaatggaagcccacattttaaataaagtcttcccagtcattttaattgttgtgaactattcttttcatatctgatgaaatcatcagtgctttgacctcatcatgtgactgatagcgagaaccctgggagctcagggctcagtcttaggcctgccacgtggcttcttgttgattggtcctgtgtgtttaacattagcttcagcccatgtggttgtttttcaggcatcctcttaagcacttacctgttttgtgagcgttgctttagcttagttaaagccagatggtatgatctgcaaatccacttaactgggcacatgtaacctacaattggttgcaatgcactggacctgagcagtgcacggacgtcccctgccaaccgccaacctctaagctcctactgttcctgggggtacctcccttccaatatacagctcatgacgctcacattggactgaggagggcattcgtcagacaagctgtgtaaaggcagccttttagtataatgtacatagagaagctctgctgtcttctccccgaggagcacaccgcccttgtggaagacccttgcgacccttgccttagagctgcggtctgcccctgagttagacgcttccttcgtgagcactttggtttttctctccatcattactatgaaaataacaagtgatcaagaatttaaacagtacggaagctcaccattacaggtgagcttcacccccgaccccagacacctaaacttgatctttgtgctttttttgtgctttctcagtgagtttcatagacaaacacatgaatgtgtaaccttttttttaaaaaaaaaagtcaatggtagcacattaaacgcatctctatctcgcttttctcactctgcactatttcttagagaatgttccatgttggtttacacagctatacataattatttgccccggtgtttgctaggtaatatgcttgtgccattatttatgaatttgtcatgttaggcattttcttttgagtttctgccaaggcagatgatgctggctctctcacaccatctcttttctcccctcatccttcttttttttgaaataatgcatactttttttggtaaaataatagcattcaccttactgtgactcagttatttttagtactttgtgaagtactaaatttggcgatttagtattgcatgatgttaaatagcattgagaaaaaaattatagatttgttatagtctccttcatgctaaaggctttcctcccatgtccggtggtttgttgctctccagtcaggttttagaacgaggtgctggaagacagacgacttgtcccgggtatgtggagtggcggtgcccgtccactgacagtggggaagaggccagcctttgtgctgccgcccactggcggaattattaatatttctagggcctttccgccagaatgggaatcctccagtgtcccctcggggagtgacccaggccaaaggtgcgattgcagcagagcaggggacagcggcagagggcccaggcctcagagcacagatggtaactggctcctcccgtgctccgtgacgcccagcccagccctgtgtgagctgggtcttcccgtgcccgaagcttcttgggctggggtttctgaggaatcagtcctgtgcctctcatgcgatgggatggcatggacagcaacaggcagcgcaccgtctttctgccacctgaaccccagctgtggagcccctcagcatctgggagcacatggcattgagtggccaccggcacagaggtagcagctttgtctcctcttctgtctgctaacaatcctctactacttttctgtctttaaaaaattctttgacatttctcgttttctattgtctgctctccaatgttcttgtcatgtttggtggtggtgtttttgattttcccccaatctctaacttcctttactgtcatcttagcagagcttctggaaggaaaagagataaaaatgcatggtcaggtcatctcttaaaatgggaatccgggaaagcagtgtaaacggcagcatggtacccttcctctcattgttctttcaggatggatgctgggcaggaaagcaggcggcccctctgttgtggtcatggaaagaaaaacaaaagttctggtgtaacagaattaggatttcattgcttccttctggaatcttaacgaaggtcccaactgtgaagtctgctgaacacatctcagttcaaaatgctgaactgtacatgccatccccttctccattgtcttacaggttttattaatgatgtgtttcagtgattgattttctgaatgcacggctgtcactcactgcttactttttcagtagatgtggttatctggggtacccagggacacctgtattacataccaaactcctccccatcttctccatggctagccagatttaggtatgagatttagggcttctggccagcttggtatcatctagcaccttctggaagctttgccttcacagcttacttggggaactctagttttagaacatccttatcccaggatgaatggaaagaaagataccagggaagtattaaattattttagcatattaaatatctgactaaaaagtaaaatgtttatttgaagttttcaagatcagtttcttagagtgctgtgtgattgctagtggtcatgccatttggatgagtgaagttcttatttgacatccattaagtatttgagtgtcttcaattgcaagtggcagaaatttaccttcctctagcttaggggattgattggtttctgtctctggaaaggatgttggattaggctggcctcaagatcccccgggtccagagattcaaatgatgtcatctgcacgtggctcttatctgtcttatcccgtcttttctgtgcatcaatggtgatgcttaactttacgtggctgaagacatggttacaggcaactgcaggcatattagcttcatttagcatctcttccctgtcccctgtgtcagtttcaaaagaagaccaggaacttgcaatgcctttgattagaatattggagctgtggcttttcttccagtctttgtccctgcactgccacatccacctaaatgaaacacttaaagaggttatgtgtgtcttccaggaattaagtggatctctggaaagttgttttgtgattcatttgaatttgtgggaatgtctcccaagtgcaggcaccagagccctgtggtggctaaagccctggaatgggccaagtcatccaggcaggagactccagggagtggcaggaactgtgcccagctggagggtgtatccccacagctactcagcaccagatgagtgatgccgggcccggtgccaggtcttcccatttttaaaagaagccagaaatccaaatttgtatgtaaatgttctcaagtctgaaaagattggtgattaattcaagcattttctaaatcactatctgggccaaagcacacatcactgtgatctcttctcagactcgttttttaaagtataaagcgagatcaagagtgctggggcactttgctcaaggccagagggtggtgacgtggctgaccagggctcagtcataggtctcctgactccctgagcctggggcccttttgaatggaccacgttgtaagctcttgttttcattggcaatgtctttgtttgaatttttaaaaaagccagtattacctctgtaccagattataaatttttggcctgaattcagtagttttatgtcagattctgtggttcatgggaggtagaattttaacatgactacattcttttgtatgaagttgacagtgggccagccggcaaggatgtccgtaagagtctgattgagcttgcagataccaagttgacagatgggagagtttgtgtctatgttataaattaaagtaagattctaagcaaaagtttaaatatttctgatgacattttaattttagtcaagtagccattaatcaaaagattgacttaatgattcttgtttaattgaaaaatctgctgaagtgaattaatttaggcttttgagtttatggaccctggaaaggatgacctttgtgcttttattctcattcctactcacctttgatatcagaataactttatttggcttgtcaaaaaaagcatttcttttctagatattggaaggtagctcagatttcagaagaaaatgttaattaaaatatacttggatctttgatttttgtcttatctgcagatagacatcaacttttgagaaatggtcttagaaaatgaatattagctgggcgtgttggctcatgcctgtaatcccagcactttgggaggccaacgcgggtggatcacctgaggtcaggagttcgagaccagcctggctaacatggtgaaaccccatctctactaaaaatacaaaaactagccacacgtggtggcgcccacctgtagtcccagctactcgggaggctgagacaggagaattgcttgaacccaggaggcggtggttacagtgaactaagatcatgccattgcactccagcctgggcaacagagcgaggctttgtctcaaaaaaaaaaaaaaagaaaaaagaaaaagaaaatgaatattgatgaagcagctgtagaaaattgacctcttgcctcaagacaaataaaagtacatttcccagacattttcagctgcccgttttttcctgcctctgtaactgattctaatttgccctgcctgtccctctgaaacctcagaactttcaaattgctatttggtttgcagggtaggttgtaatgagagccacagcattccaagtgtgggctacatgcctgaatcatattagaacttcatttttttttttaaagttcttaattgtttcaacctatattcattgtaatattataaaaattatttccaaatgagagctggtgctcaagttggtgatttttttcccccagtacaaaattaacaattacacatgaatatcagatagtgaaaatcagattaaaaatgtttaggtaatccctcattctcccaataagacacttagtagaaaaaagtaagaaagaattatgcctttatgatggtctttgttctaagtatgttctggttgctaccaatacacatcaaaaatatgaactttggtgtataaatagtcgtagtttccccattttacaaacaaattggacacaactttgaagtattctgaaggagaggtcgtaggtattgcacctaatgtgggtaattctgtgtcagccaggcagcctactactgtgttcctgcacatgattctaaccctggaagctgtattgtctctgcttctcagctcccagccaagccctctgcacctctccagaaataaattgtgtgcagatagctctggagagagaagagcatggtgtggaggggattgtgcaatgtgatggccttttttaggtgacattatggaaaatattttcttagcaatgcacctgaggtcattttttaaacctttgtggagaacaagtgaaagttctgatcacaactgcagggcccttctgtttgcgggacagggacaaaacaagtcagaacttccagctgtgagtcacttcaatagctctggataccctcaactcttatctcttaatagtcctaattttagttctctgttcattcacttcttaaagcgaatgaacctcagggcagaaattgttcaaagtcatttgtttggtggaaggaatccttgtgtgctttatcagccacagagtcacaaaggaattttgttttcttaggatgagtccagtaagtggaaagtatctattttaagatactgataggaagggatgtggggaaagagaggagagatttttatctgtaatgttgaactcatatcacattttaggtcgtgaacctagcgagcatccatttgtagaagccagaagcaattgcaaaacttgcagagtctagggaatctggtatgacatatttattgtttgatttccctatgaaattaattacagtagtatctagaatagtcatcatatcaagttatgcgttacacttcttcctgttgggccctcattgatcttgaaccctttgtgcttagctcgctctggttatttttgttattgaattatgttttaaaataggccctcatatttaagtagtagaaatgtatcttgggagataaagtgagccctttttcaatctgtgtcttgagatttttgaggagggatgcacgggcctttcaagataattcccaacccactctcgacatctcctgtcttcccccatgctcatgctgccatgaaatagctccccctccaggccccctgccacttccgccagcctttatacccaacaggggctccacacaaggggtgcttcctgtttcatctcaatatgtcataatttgtagggaattgtcttcattataatcagattaagtatctcagtgtctcctctacatgtgagaggcttttttggtactttttgcatattcttggctgaatgaaaaccaattactaattatgtattagtctgagaacatagtgtttagggtgaatatatctgaattaattaagtgccattaataatgcctctcaggatttatgagcatattctttgcttgacttaaaaatgatataaattagtgaggtttattttttaaatgtcacactgtgagatggctttgtggggacacccctgtatgccgtaatttcagaaccgttaccagctgggtctcacttatttattccttgtccagtagctatttagtattcccatttttgcagcttaattgcaacctctcttttcctgccagtgtgaatttagtcttacatctgcaggagtgatactcattgcagtcagccagtctcacacgaaaaaacaaacctgtgtgttttgcagtgttggagggaacttgcatgtgatgtaaatgtcaatgccttgctcaggagaggaatcaaggtaccttttctgagttgggctatatagtaatttaaaaggaaaggcccacataaatgttactgtgttttgtgttaattatatttttcatgaaggaaactgagacaattggctttaataaataattggcttagaagtagattttacatccttcaaggatattgtgtatgattcattaagatttaatggagctttgaggagtatttattttcccttttttaaaatgacaagaaatgttagatgacaacttttcagtcacacagttctttccagatttacattgtgctattataccacagctggtgtaattgtagtagcccatggtacatattcagttaagtgtgtattttatcatctgccctaaacatgtacttaattactttttttttttaaataaggaatcttttagaagtttttttgaacacaatgaagacttaaatttcaggcagatatcttatgaagttgctaggaatcttatctcactggctgttaggaatttgaaagtatcttgggctcagccagtccagctccctgaattttatattccaggtaactcatgtgagttatgttggcagaagatttaagattggactgagttccaggtacagctctactgtttaatagcttgggccttttctaatctcactaagcctcaatttccttatctgtgtaatgggcatgataatagcacctctacccccttgggttgtaaagatcagataagatactgtgtgtggagtgcctcacgtgggtcttggcacatgtgcacctagcatgagccataaggttagtgccaagtgtggcagtgagttagggtaaagctgagccaagcctgaggagctctccccggcttcctccctctccctgccacatgtcagctccccctctgctctctcccctgcccccactcttgagtcataccataatcagggacattttggcgctctgcactagccctctccgccccgtttgaccctgtttctattgatgcagacaacaaagctgctttattttatgtcatctttggagccccagcatgggcagctttgatgcccaatggccgggcagcaaggcagtgcagacccacacctgcaatttgggggtgactggcacggcataaacaggaacaagaagtccggcataaacaggaacaagaagtcgctcccaggatgccctggggccccaggctccagccactctgtgtggggcggggaatttctaatacacttgttttacaggcctgtgagtgtgaccagcagtacagagagaactatactgtgtttgccaaaggggattgacaaccattaagtatttgacaaccattaagtgtaaagtgatattgctcttttgctgtgagaattttattgaatatttgcaacctgaaggaaccttaaaggtggcctgtatgtgatagtataactggtgctttcactttgttcagctaacctaagaaaattttaataaactcaaaaaccactttcatcttcatgaattaaaaactgtttggatttcacaatatatgcttattcctataaagggtgtatgattctttccttcaaaacagtaatggttaacacaaatctttctgtttcctttatgaacattatgtaacatatagatagaactatatgtgtgcgtgttcccaatataagtatcttagaaaagtgtcaattctttgtataaaaaatactgatgaaaggacaggtgggatggttcatgcctgtgattccaacactttgagaggctgaggcaagaggatctgttgagcccaggcaacatagcaagaccttgtcaccacaaaaaaatttttaaaattagccatgcatggtggtgtgcgcctgtagtcccagctctcagaagactgaggcaggaggactgcttgagcctgggagttcaagactgcagttggccatgatcatgcccctgcactccagcctgagcaaccctatcttttaaaaaaaaaatcctgataataagtgtaaaataatgatgataaaccactgttagttatcaattttagggtagatcatatagaatggttggtctaggtaggatgccaaactaataatttaaagttttctaaaactggagactttgaaacccaagaatctttattttgaaatctgaaagttcacagcccagagcgctatataaaatattgaagttaacaaataggattaactcagccttcttcaatctgggagctcattgccattacctgcatttgcaccaaaatttgaactagagacaagcaatatattttagtttgggtaagagcaaagtaacaggctaaaggagagagtttttcaggaagttaaatgtcttttcagttattaagcagctctgcaagtaatccatttcagtaaaactgacgaatgatcactaagcctcatatacaacacaataaaatgtgttgtagaaaaaataatatagaggctcatgggtacactattgaaaaaatagtttactaattaaaagcttctcttttaagtagtagatcctctgttttgtgaagtgtttgtttacaagtcattaaatctagctaccacctgacgaagaagttttctggggggaatccggaggggaaataaagccaaaagcaatgtgatgcaaatgtaaagaatgaaaggccacctggaagaaagataaagtagccataaagtagctgtcagatctaactcagtatcctgccgcactactcaattatgaaggtatagatactgctgtaccaggacatattacaatctgcaaaatgagaggttagactatatgatctccgaaattctcttttaatttcagcatcttatgattccatgtaaaccatttgatttttcttcttgtctcatttcttgtcttcttagataaagaggaccaaacattctctacctcttggggtagtctggttttggaagatggggaatagctaaaagtttgtgtttccctgacatttaaatgacacagtagtcagaactctccgtccctcaagggccatgtagggctgcactccttccaagaagcccgtcacccacacccgtgaccacgggctcctgctctgtgcttctgtggcacttgttgtctggcttcagcatttcttctgtgctgcttggtattttactacatgtgaaggtcttgcaccatcgactacagtggaaaactccttacagtcagggatcttgttttgtactgactttccatttccaagtgatggtcctggaactcctttcccctttatgtcacactcagccagcaaacaccctccatcctgaagaacgcctgtcatcctgtctctgcacctgcaccctggggttgagctctgccagaatgaggaatgtcatccacaagttcacttggttcctgtacgtgaaccatcacaaactgtggatgacgctcagctctgcccggaagcccagcctcctgtctctatttaaacttgtccatccacattctgcagtcccctttttaagctctctgtgttctctttaacctttgaagtcctcagcctgcttctcactcttagcaggtggccatggccctaatccccagagaaaataggagccagtggtcgggagccccatcttccctccatcagttctgctccctccccatgacacctatctcttttccctcctgtgaacaggaaagtcgcttccctcctcagagcctctccttcctgcatgcctgaatcccatcccctcccactttctcgagaagtgctacggaatgtcccttctctgtcaggtcctccctctgtccctcatccctcttcatctcgctcctgtccttccctgccaggctccttagaaatcagccctgtgcagtgccagcatttccttaactcaacttagtctgggttccattgctacactccaccgaaacaactctgccaaggttgccaaggacctcctgtgccgttcaatctggctgacatttcccagtccctgccttctcaaaagcatcatgatcatcccatagcatgtttgaacccccttttcccttcactcccattgggtgaccctgtgctttttcacttcctgcctcgatggcagttttcccctttctcatcctcttctccaggcttggaaacattcccgttcttgaagactgcttctccgccttcctccccatcacaccggcccctctccaggttacctcatccactcctctggggagctaatgtctgatgcacagatacacacatttttatctcttgcccctgatgcccctgggaacttcagacccacctgtccacggcctacctgacattgacacttagatgtcccaagagcgcatgaagtttaacaagctcaaaactgaactcttctcttaagatgcattgtgccagtcgttggacccaccagcttcccccgcatgcatgcagcattccctccatctttccctacatttctagtctgtcatcatcaagccccatagatttcagcacttcagcatgccggagtctctctgcttctttcgtttctgctgcctcctccgccctctgctgagctgctctcctctgtctggtgcaattctacagcagccgcttcccggtgctcctgggcctgctgttcatccctttcatgccacgcaccttgtctatttctgcactgttttcccattaacagtgtcccctcctctctaggactcgccttcttcctggaagccctgtccacctgccctctcctttctccacgagccattgctgcccagggaagcctcacatgcctcccccatctggcctgggccttttccatacttgctcgtagcccattgtgcttctccctcctgactctgtcattgttagagttcaacacttggggcagttcttcagttaatgtgtctgcccctctggaccataagccccaagaggacaaagactggtgtccgagctgtgcccagcacagagtggactcttaaaggttgtgctgacgcgaggatgggtggggaaggaaaatcaataaggaaaattctcagtttactcattccatgttggctgaagttttcatattttctccacaaaacatgttccagagcaggtaccataaagcaaaaggatgcagaaagtttctggtttcctgtttcctgtctgagaagactctcttaagtgatactgatttaagcagcctgaggaggcatcaaagctttggaggatctgctgaacacatcacgcgcatttaaataatcagtgtctgatcccacctccacgttgggtttcgctttctcttgttccacaagatatcgaagtgctgattgagttggcatccagcttcattcgcattgtgtttattatcacaagacttggatttccattatgattttctttttctgttatttttcaaactttgatattccactgatagcataaggatacataaactttaatttttcatagatatactctgggaatgacttagtatcataagatgcttgagtaaagtgaactggagaagctatatgacgttagattcctgtttttgttcagtgggtttgagaagctagctgtcagctgtcactatcattcctctgttgtgtttgccttttctctctggccaccattcctttcttctctttgcatttggccttctttagtttaactacagcgtatctaggtatgctttgagtattcttacttatatattgctttgagtattctgcttttttttgtttttttttttgttgttgtttgttttttgtttaacagacatggttccactctgtcacccaggctggagtgcagtggtacaatcacagctcactgcagccttgaaatcctggatacaagtgatcttccttcatcagcctcctaagtagctgggactacaggtgcacaccaccacgcccagctaacttttgttatttttttatttgttagacacgaattctgttgcctaggctggtctcaaagtcctgggctcaagcagtcctcctgcctcagcctcccaaattgctgggattacatatatgagctgctgtgcccaactgtatctacagatttataacgtgcattaattgtggaaaattctgaatcattattttttcaaatataatcatcttttgttcatcttctatttctgtataatttctcacagcttaaaaaattctatatctgatcatcttagtaactaaagtcttgaaaatattaattagtcgttgctgtctctgtgagctcatgtttgattgatcttcatctgtgggaagcctggaggcctggcaggggttgctctcctccggagatcatttacatttacttccaccaggtgttggggccactttcaaaggcttccttcaaggatctcaggttaacgttgaagcctttgttgagctcccagctttcgtttggcccaagtaagtgttgaaactggcatttgtcctcggagtccctcctttcaggcttgcttaatggtccccacactccctgtggattaaactcactttgggggaagaaaggtgtcttggagattgcctctactgtctgtgaacccagcaatgtgattaaaaaaaacaaatagctctatcaagcagctcattcttttgttgtttgcttgttttgtttttgtaactgagaatccttcagcgtacctgccttctatcctactggaagcataaatctttgacatggtttttattgctagcaacaaggaaagtcaacatgcaaaaatagttaaccaagagaaagttcaggtttttcaaaattgtgtccaaagctgtccctttcattcactggaacttgatcttaccctttgtcctttggaaacacatctttgcttttgttcttgactcatgtccaacccacctccttctcttgtagtcctgggaccacgtgtcttcttccttccctgaatggaggttcttcttttggtaaattcatgccccaccccaatctttatttttaaacttagttcctgtaagggaagtaaagagcacacagatgagttcaatatataaatcacgtccattaatccaacaaatatttacatgaaaaatttaaaagctttctttctcagataacattttctttacagaaggaagttgtcctggacatgtgaccaaagggtctgtgggatgaggttgtggagggaaggtagggagagtggatgggcaagaagcagggacaggtggcatgaggattgactctccctcaccactgccgtccggtggccaccatggacccagcatcagacagacataagaagtgggaatgaggaaggcaggaagagagattatgatggcagagggaaggagggtgggttggtgggtgggaagagaagttcctgtgtccaccatgttttttttcccaaggtacacattcaagtcaagtcctcctcacctggatagtaataacccatgctatttattttatatttttccagatcaatgaactgagccatgttcaaatccctgttatgttgatgccagatgacttcaaagcctattcaaaaataaaggtggacaatcacctttttaacaagtaagtacaagtatgacctttcataagactagcgtggctgctaggagtacaagttttgtgaatttttgtaatcacataatttgtcaatgggtgggagtaaagttttgctgatgaagttaatcctgtgataaacataaccatctgtcatttttagagaagcaacagcaggctctctgggataatatcctttgccatatggcatattgttctctatgaatatcttatacgttgaaagtgatattctcattataattcaaatttttgaagctgtaaattgcttggatttttgagcagttatgaacctctgctcttgtacacagaactttgaaaatgatgatttatgaacagcaatgactccatcttagaacaataaagacccaaggtacattttcataaggcacaattagatgccatgttgggcattgataacattcctccttcatttgaatgttgttttagacgtcattatgaagcacctattatatgttaggtggtccattgagagctagagatgcaatgatatagaagacacggccctgccctcaaggggctcagagtacaaaaactgacacatatacaaactgctatagttcagtgtgcaaagtatgataagggaggggtgtgtgcatatgtataatttaatttatctggttgtgtgggaacacaaagagggaaacaattctgaatgattagggtgaacctcaaatcactcccatgtgaggatcattatgaaatttttttttgagacaggatcttgctctgttgctcaggctggtgtgcagtggtgaaattatatctcactgcagtctcaaattcctggggtcaagcaatcccccttcctgagccttctgaatagctgggactacgggtgcaggttaccatgcccagctgattttttaaaaaactttttgtaaagacaggggtctcactatgttccccaggctggcctcaaactcctggcctcaagaaatcctcccacctcagtctcccaaagtgctgggattacaaatgagtggtgtaagccaccatgccaggccaattatgaaatttcttcagggggccattgtccttatgtgaagctgatgttaatttttctcataacagtgtttagaagctgactttcagggaatttcctctaagcaaatttagaatgtggcatttatataaaacaggccttttaggggggtgagggagtggccctcctttcctcagcagtagctgagagggaaccttgctccgctgcctcttcctaactcactctcccgccattgtgcttttccctcactgctccccctgcctggcccgttccttccccacctcttgttctttgaggaatggctgcagtgtgtggccaggatttaaagaggtcacatagtccaagcgtgcctgtgacaaaggagacagacagacatccgtctggccccctgtgtctcctggatctttctgcgggttgtacctggttctaggaagcacacctgtgcttttggtaggcagtgaactctgaacccttctttggctacctgtggaactcagtggtggcagatgcaagtctgattgactctctctgagctttattccacgctgtgactgtttcagagaaaacatgccgagccatttcaagtttaaggaatactgcccgatggtcttccgtaacctgcgggagaggtttggaattgatgatcaagatttccaggtgagttgcgtttgtaacatttgcttccagtaggaaatgggttttgccatgacttttgctgtgtcaattgggatctgtatttttgtcaataaaagtattatataatagtaattttcattttgtgtaagaagtttttaatgttcatgctgaagtaaagtgttctcttgattggggacctctatacatatgataccggtataaaagtcagtaggaaaatatattacttttctttggaaggagactgagcatgtgagggttttatataatactctcatttccaggtggaaattaacaggctagcagagctgcctgttaatttctgctgtcagacatgtcagtagcctgtgtgagtgtgcatgttttgtatcttcgtagaggctacttaggactctcaggaatctttatcttgctgatttgctgcttttcaagttggtcagactcttgctgcagcatttttgtcaaagggcaccctttgtgcactgcagtgctggactgtggagtgaccatagcactgtggtcagcaccaggaacccaacatcctgggcgtgtcctgtggtacatcttcctcttcatcttgattcccaccacgtaaaaatgtgcactgctgctctcctccccacactggcctggtccttcattctaacttttaaacatctgttttaactctttaaataactgttgagccatgatcatttttttctgagaaaggatttgacattggttacccaagtttcatatagcgagccagattcgtaaatgctaaggattttttttaaaagtggaaatccaagggacaggttgagtatcccaatcagaaaatctgaaatccaaaatgcttccaaatcgaatattttctgatcatcaacgtgatgccacaagtggaaaattccacagttaagtgctcaacacagcctttgtttcatgtacacaattatttaaaatattgtataaaattacctttaggctatgtgtataaggtgtatatgaaatagataaatttcgtgtttagacttgggtcccatccccgagatatctcattatctttgcaaatattctgaaatctgaaaaaatctgaaatacgactggctgcaggcatttcaaataaaggatgctcaacatatactgacttaagtcccttcaaatctagtcctaatctgccctcaatttaagatctgaatttatcctgcattaagtgacatattgccaccctgggtgactacagattgagtactgatacagcttaccctgtattttcctctgaagaatagggtccctcaggcaaactgagatagttagcacactttcctaaagatctgtgctcccactgccctctctgtaccattgccaaaaatttccaggaatttttcatatgtttactcaggcatgagagaggctgccatgtttggagaaagcagcgctgaccaggctgccggtgacattgtctcatgatggcctggggttgtggtttacatggaggtccagaccctgagctgaggctctgtgtacacagaagagctgagggctggctagtgggacaggaaggatgtggttgctcatctgctattaaaactgcgtgggagccaacactcctgttagggcgtttctttttttttcttgatacaaggtcttgctctgttgcccaggctggagtacagtggtgtgatcatagctcactgcagcctcaaactgctgggctcaagtgatcctccgacctcagcgtccagagtagctaggactacaggtgtgcaccaccatgcccagctaattttttttttttttttttggtagagattggggtctcactatgttacccaggctggtctcaaactcctggcctcaagccgtcctcccagagcatgagccagtgcacctggccttggggcttaatttttaagagagaacttagatcacaattatggacttgaaatttactgctgtaaaaataattaactttaacagaaaattattagaatagtaaaaagcatttctctgaagttaaaattaataattctgtatcactttagaaccattactaaatttaaagaggccacctgaaaatgaactaggtgcttttttttttttttaaaggaattaacagcagatagcttcagtgtcttaagaaaatctcctctgccttaagaaaagctgaacaccagtgtgttcctccttctctccacgtcctttttttgtttggctgggttttgttttaataaaacaattccactggcatttcacagaaactgacttttgagggcccatgcatctatcttatcttgttagattcctcaattcattattgaaatgaagtctttctatttcttgtcataatcaattctgtcaaatgagatccaaaatgaacccattacggtctgagttctgcactgcagcagagaaaagtagtttttaaaatttcctcaaatgaccaatttagttgctgaaatgcaaagacatgaactggttttccttccctttttttcgccctacaaagaaaactacgtaagttgatattgaagtcagtacaaattgctgagtacaaactttgaaagaaaattaggcaagtggaggatgattcacaagtaactaattggcaagtccgttaaactcttcacatgagagctccctgttggggagagtggtgtgagtgtgattaatcattcgaacactcctcctttccttagctctgcctgctgctttctctttggcaactgtatttctattaaaaaaagaaaaaaaagaaagaaaaagtgtgtattcagagtcacttcagtactgcagaggtatactcttcttccctcctcagtcgtatatttctttcccagtgtctgtacctcttaaaattcttcagtagggtcagggaccctgagttccagctgaaaacaggatcgtaaatctggggctgtatcccagtcttttggctacttggtttggaagaaaggagggtcgttgtgacagctctggctccagggtcacctcgcaggcccctgtatactgcagggattcaggcggcaggcgggcaggggccaggacctggggcttcagctgcctggcacattgttactgcccagacagttcaatcctcatgcccagttcaagtaacaggtatcatttggcacatgtggcgccaaatgactaaaagcaaccttgttttcctctcctggagcttgccaatgtgcctttgctgagtagagtctcccaccggccgcctctgtcactcctgggtactggctgctgaagactgcgtatatcggaaaaaaaccaactctctttctgagcttatcaatgtgagctgctttttgaatactctttcccaactgacttggaaagtaggatcagtgacctaggctctcatagtgttttggaggacactggatagctgaaggggaacaggcattgcctgctgtgtttatttttccaaactgcttgcattttggacaagcggctctaaatcaatgtggtggttaggggctccatcgtctggtttatctcgtattcagacctttccattcagccaagtgggtaaatggtcccgacttgtcttgtttgtgtgaccacctttttgctacacctgaaaaaagtaggtattggtctgtggagaccactctgattaaagtagagcatggttaagtagtaacctatgcagttgacccctactggtgaatttaaacttcttaaaaagtttttaagataaatgaaaaggataatgaaatgaaaaatgaaaacattcctgctttctcagtaaacatttgtatctttcctctggttttgatttctggaatatcttttaaaaatgacttttccttgttgttaaagacaaattcaaagaacaattctagaatatccattgttaataacagtaccacagtaccatgtaacatacatatgtaaacctctgtgtgtgtgtgtgtgtgtgtgtgtgcgtgcgcgcgtgtgtgctcgcgcatgtgtgtaaccagtgcttctagattcagaactttttccaattcattagggcatttttaaattgcatgataggtttgtaatatgctcagggttgaatcagtgtgtcatcaaggttctgatcattgtttggccagcatgatatccatcgtcatactttaaaggtgtgtttcaggatgaatgctgcctgggaggcctgttctgtgactatagccgcagtcctgtgtctaccattaccactgcccccttaaaccctgatcaccctgaggtctgggatttcatgcataattatccagtcaaagtatttgtttgtacctaccacatgtcaggctctgtgctagccgttttagggaatgcagagagaagaaagggtgaagcatcactttctttaaaaactattgcataccagattctgtattagatgctaacgagatttacagaaacccagcatcttgatttgtaatgttcttcatgaaaatctgcacccctctttccagtctcttatactcatttgatggtctcttatgtttatacccagagagactggacaagcacggatgcagattttcatgaagaacattaaacagccctgggaagtcaaacggaggcttcagttacatttagtagctgccagagagggttgcctcccagaaaccaaaaagttatgcaggagggagctgatgctgttaaacctaaatagaccacacatttgaaagtgaggcctcttgttcactgtggaggataataccaggtttgcttttcccctaccgtgactcctgaattagaatccctcattattgacatctgatgccctttcttctttgtgtttgtaacagagaattctaattttaaaataattaattttaagagctaacattttaaacttttgatattcttatttcaagtttagaaataaaattctaaagtgttaagaccttcagtgtatactaaacttgaagtggggcagcaggaattctgcctttatctctagaatatcaagtctatcctctgaaactttcacttgtagatttctcacttttgactttaaactgcctgagggcaggagcagtgtttgtgtttgctggctgcctgtcacccgttgagcacaatgctgggctcagcaggcacttaagaaatatttgcagtcaggacagtggccacacctgtaatcccagctactcaggtggccagtgcaggaggatctcttgagcccaggagttcgagaccagcctgggcaacacagtgagacaccatctctaaaaacatgaaaaataaataagtaaataagaaatacttgtgaaagagagtgagggctaatggggactttgaagagaagtgaactctctgggcccaagcggaaggcaggagagcccatgaaatgtgaaggtatttggatggtggcagaatagtgggagataaagatgttaaaatagcaagaaacacaaagacaccagggacactgggccgattctgctgccagcgagcagccctgtgggttttgctcaggggaatggcaatgtcatgacatctgtattttcttttcttttcttttttctttttctttctttcttttcttttcttttctttttttttttttatagacagagtttcactctgttgcccaggctggagtacagtggcacaatcttggctcactgcagcctcccaactcctgggctcaatcgatcctgccacttcagccccctgagtacctgggactacaggtatgtgccactatgcccagctaagttttgtaatttttgaagacacagggttttgccatgttgcccaggctggtctcgaactcctgggctcaagcgatccacccaccttagcctcccaaagtactgggattacagatgtgagccactgcacccacccgaggtctgtattttctaaagataactgcattgtaatttatagaatgcatagaagggagataaggaaatcaggagaccatgaaatcccagtgagccaagcctccgtcacccaccatgtaaagcacggagcagcttgaaaagacattgagagaagtaaacccacaggttcagtggccagtggcaaaggacaagagccacagaggcactgggacctgaaagctaagagagcagggatgcgggtcacagagggagggatgtttggggctacaggtggatagaaaggaagatggagttgagtttttgacctgttgacttaccgtagtggtaggatacctggtgaggcttgtggcctgcattgggcattctgggtcacaactctgaatgaggttggagcagaggtccagctgtggtgaggattggcacagtcgtgcttgtgggactcctccttggtccaactctaatgctcaacctacaccatcacccctgtgcttgctcctctaatgcctaagcactgtcattcctttatcactagtagttgcctgttgggtttgctccatttgtcctcacagtttagctgccctggaaggaaactccaccctgctcagagacacactgaggctgagacccaagggaggcccctctctgattggacagcctcttgatagactgggggaagctccctcacagcccatcagggtcagcaggcatttcttgcactgtttcaagtcctgtttatgaactgagcaaattactgttcctaccaccacctgcccccacctgggaccccaggcttcctgttagcctgtgtttcccgcctcaaacctgctttgggttttgcctcgtggcttttgacagagagctgacagccagtcatccttgctactgggtgcttctctccaggttaaacgctgtgtttaccgtgagccttggggacatgttcctggtttttttttttttttttttttttttttttttttttgagacagtctcgctctgttgcccaggctgggtccctggtgttttaatcatcgtgaaacagcagctgagatttagaagatgatctcatggcactctgtgaagtttctgcaactctgttgctttctctgttggtcattgcctttcatttttatattctttttttctgataagttgtttcattattgataagtgttaaattgcactgtgtcttgctcccctctataatgaaagctattcttcgcttgagatcacagcttagattttctttgaaattccccaagagcttaacacagggctttgaacacagtgggcatttaataaatccttgatgatgatgttcaagttccacattggtcttcaactctctggcggggtcagaggaccatctgtgctcgctcagatatgtcaactgcagacccagaaagcagccttctccagacaagttgctcctgtctcctgggccgtgtgattcgaggcatgtaatcataatcctgagctgtcagcagggcagtgattggtttccagatttcaagtccatgaaacaggtagccagggttggggaaaagaatatttccgggaagttaggaggcctggttgagtcttggatcttcagtgactgatgctgtgaccatgagatactcactcacccctggtgggtctcagtttcctcatccataacatgaggagagggacacagtgctctctccggccccccagctgtcaggtctctaaatctattactgtgccaccgtgaggagatggctgtcacgtgagttctgcacggtattggcatgttcccttatacgagggtggctttacacatttgagcatggcaaagtttaagtggcccctctttcaaccaaaaatgaaaacttttcatacatgatttttagcagaatgtatacaaacgaccatcaaaatggaaaaaaaaaacaaattatacaagacttacgtgattagttcaagagaattaaatatgcaaaatgcttggttgtttaaaaaatgcagggaaaagtaactgttactaaatgaggacacttttatgagagagagaaaagattggcggtaagaatgagctaattaaattgacatttatgtttccttcccccttctgggggctccactaatcctggacctccgactgcggaaataaacatcttcagcgcagacgtttagaggaagggggaaaggacagcatcgttaatccttttcttaagggaaaggacaataaatttccagttataaatgtaaaaaggcattacagagggagcttcatctatcattgccttcctttatttgctgttgagaggaccgagatagcaccagagcctcaaacagcttttgtggtttgagctaggatagtgtaaggtaggaaaggtatttggctatgggaaaagtacatttattcaccacgttgcaaaataggcgaaaatgaactaaattgtcatactcttacctgccctgcatcatacagctttgccctagaacttgaatgtttgtccaactgttcgtttttctctagctccctatgctaggagcaaacttagaagcaacatttattggctgtgatgtgtccactgcaatcgtgtatgggtgctggcctgagtagagagcacttgccaggtcacctcactcatccagagacagcctcatggtggatgagtgtgtctaggctagggcacttgaaagatcaatgtttgggccagtcacaaacacctgtgtaatgtatggttacatccatatgaaatgtccagaatgggcagatatatagagacaaagatcagtggcctttctaggctgggggataggggaaggaatgggagtgattgcagataggttcaggtttctttttggagtcatgaaaatgctctaaaaatgattgtggtcatggttgcatgatttggtgaaaacattaaaaactgttgagttgtatactttaaataggtgagtcatatgatatgtgagtcatatctcaaggaagaagaatgcttggagtttgaaactcgtttaatttattcagtaagagacgttttttcccaaaaggttgaaactagtttaatttattcgataagagacagtttttcccaaagttgattttggctgttgttttttttttgggatgggttatggtatcagtatttttatttagaacaggtgactttaactaatttcgtaatttataatatgaaactatcaaatgtatagaaagaagaaaaggaatagccaatgaagaaagtgtatttttgcagtttgtgcatgttgattattagatttttttcccataaactaatagtaaatcatcgtccattccctaagtctctacaaactgacagcagaataataattagaagaatgagcaggaagcttagagaccattaagtccagctgtctttctttgcagataatcagataacagagtaagggaggtgggaagggtgagttggagggaggacgcaaagccctgacttcagcccattgctgttgagatggatcaccctgacactctgaggctgcttcctgggtccattctgttttgtcgtcatctatgtcctttgcccatgtctggtttgagaggtcacagggaagtgagcaggggccagcaatagaaggaagaccttgtgggctgggaattttcaatctgaaacttccttgtgaaattttaaattctccttttaacatgtaagttattattgaggcctttaggaaataacttactgtcacttttgaactgataggtgcagaatccccaattttgtctgtttgtttttattttttaacagagtctctgtctgtcaactaggctggagtgcagtggtacaatcatggctcgctgcagcctcgaactcctcagctcaagtgatcctccaacctcagccttccttatagctagaactacaagcacgcaccaccacatccggctaattttttaatgctatgtagacacagagccttactatgctgcccaggctggtcccaaactcctggcctcaagtgatcttcccacctcagcctccaaaagtgctaggattacaggcattagccactgtgcccagcccccaattttgaatttaaataatgtcactttattgcagaccatataactctccaagtgtgtccatgacaaggaatttgatttttaatgagagtagatctctccaaagcctgggtggatttcactgggtaattttatctggctgctttctcctgaagacagacaggtagataagggtaagtgttccagaaagtgaatattttactttggagatgaagaggactaaaccagccctctaaagggtgtttttaaggccttaggtaggatcagcttcatctcagatttgcccttttaaattaggtgattgagaagagaaagaatttttctaaatggtgtcttctgctaggcttttttttttccatgcagagctggtcttaacttgcaaatttcatcttaatttctttttttcccttctcgttttttttaatcctcccagcttagtagtatagagagtgcatatagaatatagagtaacccagaattcagcactcccagtataaaagattgctcctttcaactttggcattctttgtgaagaaaatctgtggagttgtaagcagagaaagtggatgggacagtcttctaaaggcagaaaccagtgacaggaggaaaacaagaacctccgacaattctcagaccacataaactaatttaaatagacatgatgcagtgtgccacatggtcagaaatgtgaagaattcttagggttgacatcgtcaccacagtcaacaggactcacaggaaatgctaagtgctggtcctccttcagccctgtgttacgctgtgtgagtgcctgactctgggcccagggctcagcagcacggtcttcctgtcccaaaggcttattccacaaacacatctgtctcagctcctgcgtggagagaagacagctcctactcttcctactcagttaatgtaaagtaatgaacagtcctagaatgagttcagatagctttgtacacatgttaataaaagtgtaaataacagactccggactgcattagcactgtggctgttactgatattttctacacactttacttggcaaaatcgaaaacctgaagacaggtttggttttgtgccagctggctcacactctaaattggcattagaaggtgtatgtcactatagaaaaatgactgtcccttcataatgcccaccatactctggagcccaggcagggaagcagcacggcagggggagatggaggctctgggcagggcccctgcagggccctccatgtacaccagcccacctgatgttggagaactgagttgggcaagtcatttctgctctctgggtctgttttcttatctgtatattgagtggtttggaatcatctccaaggttgcttccaactctaatgctctttgaggtttatttatacatggagggacccctcgggggcacctgaaggtcactcccaagctctgtttccatcaagggcctcccaacttgtccaagcatccaacatcatgctgtgattcctttttcctttgcaacaaaacaaagcacactgaggagtttcttattcagtgtcagtagatagactgttttgaggcagcacagtgactgtgttgaagatataagacctccttccctgagctcatgtgctcgttctagctgacgttgtcctgaatacatctggaatctgtgaagtgttattttcactgcatgttctctttcatctcagcccaggtgtcctaaaccatcattaggcccctgctgagatgatggttgtactgtcttctgatcggactctgtttcttgggacggttgtcctgagtcaccttccgaggcccatgctttacagcatttcctagagcaacgagtcgagtcttcgagtaaatccttttttttttttttttttttgagacggagttttgctcttgttgcccaggctggagtgcaatggcacaatctcagctcactgcagcctccgcctcccaggttcaagcgattctcctgcctcagcctcccgagtagctgggattacaggcatgccccaccacgcctgcataattttgtatttttagtagagacggggcttctccatgttggtcaggctagtctcgaactcccagcctcaggtgatctgcccgccttggcctcccaaagtgctgggattacaggcgtgccccactgcgcccggctgagtaaatccatttttagagtcataaaagatccaaggtagaggtctaattcagcctgttctctccccaagcttattttccatcacttcatagacccggaaactaaggctcaaagagactaaatgcaatctacaagaactgatgaatgttctagatctcagaccagtgccctcaccattaccctgtgctgctcaggttggagtgcagtggtgtgatctcggctcattgcaatctctgcctcccaggttcaaacaattctcgtgcctcagcctcccaagtagctggaattacaggcatgcaccaccacacctggctgatttttgtatttttagtggagaccgggtttcaccacgttgcccaggctggtctcgaactcctggcctcaagtgatccgcccacctcagcccccaaagcgctgagactacaggcatgagccactgtgctgcctttaaaaacacatgtctgctgcatgccttggaagaaggcaagaaagtaaatgataataaaaatacataaacaattttactttattttaaaggctacaaaaagtctatgattatgatgacagaagtttagtcttatctttgtaaatcgccctttttggttagttcatagaaagctttagacaggaatcttaggcacattgcttggctccattgtacactagtttctttatcttgaggtgggaaaaatggatctagcttttcctctctcacaggaatattgtgaaaataaatatgaaataatgagttggatttttccaggccttagaatcattccaaggatcaggcgttttgtatagaattgcatgaactcttttgatttcctccttatcagataaggcttttaatacacttgatttatgtatttttatattcatagtgatatgaaaggtacattctatgttttgacacagtgttcctaacttcattggttatttcatgttcatgaaccttaaaaatattcagatagtgtgggttggggctactcacgtggattattaaaatggtgatttgagacagaatcaagattcgaatttttaaggttttatatcccagggtgaagacatggctgatatcctaatccagtgtctgcatatatgattatagtaatgcctttgaaattgaaagaaaaggcacaaactggggaagaggtagtatctgagctaaggagttcctacattatttgcttttacgtttccagccctttataaacccatatgttgcgctgggcatggtggctcatgcctgtaatcccagcactttgggaggccaaggcaggcagatagatcacttgaggccaggagttcgagatcaccctggccagaatggcaaaaccctgtctctactaaaaataaaaaaattagctgggcatggtggcacatgcctataatcccagctactcaggaggcagaggcacgagaatcacttgagtccaggagatcaaggctgcagtgagccaagatcgcaccactgtactccagcctgggcaacacagtgagaacctgtctcaaaaaataaaaataaaaaaccctgtacattgtcctggtactggtacatagtattattaaacccttctttaattagtaaagtaaatgccatgaattattattctgaactataaagtttcccattttaatcgaactagaggtgtagagaatataatgggaaaggcatgagtgccggtaagtctgtaattataatgtacttaatacgctagactttacgtgctgcatgccagtaaaacacagggtaaacaccattctgtagaccttggttctcatgtgtggtctgcagacccactccagcagcagcatctacttctgaaaatgccccacccctgacctgctggatcagaatctgcattttcacatgatccctgggtgattcagttgcttgttaagtttgagatgcactgactatgcagcttttgattcaccctattggcccatgagaggacgttatactgtcctatctaatgtgcataagaaaacgatctatgaaactgaggctgctggaattctatcctgtgctgaatacagttctcctttactattccccatcccccaaaagttgttttacacgtattgtcagtttgacagagtttaaggtctgttccacttggtctgctccacctggctttcataaacttgattgttcccactttgattttatgcccaaagataatctgcaatcttacagttcctagagttcttgttttatttgaaagaaatacccttttgcaaattagtgattgcaagaaaaaagtaagaccactaacaaagagcaataattgctttttgggggctagcatttaaaaccccacaaggggaaattcactttgattttcttcctttttgttctaagtgggaagtagtataaaggagatcttgttcatgttttaggaaagaaaaatgtaattaagaattaaactcttgttaatgtaggcattttcatcctgaaagtcatttttatcattctcagtctatctaataaattttagttgtcttaagaataactgaacactgccaagtcttgctatttaaagtcattggggattatgtagatttttttttttccttctctcaagttttctaataagctaaggaaagcaaattcagttacttggtggcctggactctgcatctggcaggtgcgcctgcttgccttcagatcaaggtgtgctattgcagaacgtgtgatccaccacaggggatgccagggtggtgaggtgagaatcctggaagatgaagatttgctcatgggccacttttctcttcaggcataggtagggcctgcgtaaacccctgcactgctgcaattgattctacctcaggtggttcagtcctgttgatttcatctagaaaggaaggaaaggataaagagactggaatatactagacagaaaggcactctttcttttgcaaattcatgggcagagctatctatcacctgcccctctgaaggtatctgtgttcccttaacttgacagcatttggccactgaggcctttgaatgcccacttcagagagcaagttaaagagagaaagcatgtttgcctttgaatcccacacaggccatcccgcagggccaggcaaggagtgaaagtcactgctcaggagcagtcggcaaggatggagacgagactttctgggggccaggggtttgctagaccccatggctggacggccattgtcaagaggttggggcaaggaggaggcttcttggaggatgtaagaaagaggagatctgaacggaagagtcacatgggaggagaagggtagacctacctagccagtgtcactagcatgaaccagatcttggagtgaatgatgtcagcagagcccctactcagagcccgtccttgtccaccctccaggagatcagtagttctcaaaaatggtggtagggagtggaggatggaccaaattcaaatcgcctaaggaggagctgttttagaagacactctcccaggctcctgcctcctcctcctggggcacacaggtagcatagtctgcaagttaagtactttactagttgagtagtttactagttgagagtttggattctgagccagccacactggagtcagaattctagctcttcccttattagctatatgccctttgcccagatactaagcctctcttattcccatctcctcatctgtaaaatagtgatgatagcaatcgtaaccattgcatgggaatgttatcagaattgggggaaataatctgtgcaaaatgcttggcacgatacctgtcatataaggaaatgctcagtgactgtaaaattttcttttatgactggaacctaattttattcagaagaaaactttgagagcttgtccaactctgaaaagaactaagtgattaaagttactttgattataattctagacattagcctgctttaaagatattagaatcatagtacaattcaagctgttttcatttcatctgaaaggcttgcaatgtgagttatgatgcatgtaaaaatgttgtcatcctacttatcaatttatcccacacacaaatgtttttgaaaacttgcaatgatgacaaattatctgggaatcggaaagccacacctttaactagttatcttcccccgccttccttcccctcttaccccacccgggaagaattccctgaccaggagcgcacccctccccaacgactcccaggcccgcagtggagctcgttttcacacttcctacgacaaaagatacatcatcaagactattaccagtgaagacgtggccgaaatgcacaacatcctgaagaaataccaccaggtaatttttcttgatctttatttgaaactccaagaagattaacatgcgtagcgatttctcaccaaggccagagatttaaatatatagttagagaacaagaagaacacatttcacataaacatctcctctaaccctgtgttctaaaattacagtggccagattcctggcagttaacctttaggcatgcttgtgctataaaggtcattcattatttgtataacacttttaacctaaatactcttgtgtaatagtttcagttatcactactctgattttaaaatcattcagcttaagatttggcaactttgcagaagtttttgcctgtgccagagattaggtgttgacctctgagtatgtatctatttacacctccgaatcctattttgctgtcactggttcttctgtcctggccccagcagggcccacgccattcacaatctgctacggagcaagctctctgattttagaaggtgggtgttggtctgcttcttgcccccttttcatccccgagcataattccattgtaatcactggaggtaaagtagaccatccttgggagcagcaatctgtctctcctggagtaaattccagcacaagcttctctggtagagcacatgttcccaaggcccagcccgcgctgtgagaggcctccttcaccatggagtataagagcatgaagtccagcgttggacaatcctgggctcaaatcccagccaggtcgcttactaagcatgtgacttctggtcttggttgttttttagagacagggtcttgctctgttgccaggttgaagtgcagtggcgtgatcacagctcactgcatgctcaacctcctgggctcaagcagtcctcccaccccagcctcccaagtagctgggaccacaggtatgcaccaccatgcctggccaatttttttaagttgtgtttttatagaggtggagttttgctatgttgcccaggctggtcttgaactcttgggctcaagcagttctcccatcttggcctcccaaagtgctaaggttacaggtgtgagcctccataccctgcctggattttgaagccacagtttctttgtttatacagtcgggataataataacacctaatatggattctaaagattaaataggaaattgcatgtcaagtgcttagcacagtgtctgtcacacactagatactcaatgtgtggtggtggccatagcatcgctattatcaagataacatccatggtataaaaataacgtaacaactaagtcacttggagaaattgtagtcatatggtatgaacatgtctgctgttgcaacatcccaggaatcatcttcacaactggtgtttaaaacacatacacacattgttgcttttaggaccttagtcagcttgagctgtcataaaaaaccgtagactgggtagcttaaatgacagaaatctatttcttacagttctagaggttgaagtctgagatcaaggtgccagtatggtcaggttcttcctggtttgcagacagccagcttctcactgtagcctcacgtgtgttggcagggtcatggtgggtgggataggatcaaaagcactcttctgtcacttctaataagggcactgatcacataatgagggctctaagctcatgacctaattagctctcaaaggtcccacctcctaataccatcacttggggattagggtttcaacgtaagcattttgggggacacaaactttccattcatagcagagtcacacggtgtttttaacttaaatagctcccaatcccccaaaggtaaaaattggctgtcacaatgggtattcaaaataaagtgccgcaggtcctgaatatattaataaaaggattctcgagtataaacaatcacacttactaagtatctgcttcgaaggcagcactggcctggacttgtgagctcctagatgtctgtttaaacatccctttaaaagcattactttatgttcatgcatgatgctctaatatcatggattctttcttggcagttgcttattcttccaatctttgcaaatatgatcaattgcattttgcttgcagtgaagtctataaaaatctttgagctatattctgtttcttgaaacttggtactgcctctagtttgttttctaaaatcattagcctctaaattcatttaatatctaataaatcttttataatatctattccttttgaaatttgttctacactgcttatgctactgcctcttattctacaggaaattttaaagtgccaggatgctacctgtgagggggaagacatgaggctctgttatctgaatgaattgaattacaggttgcagctttgaactcttcaccttttaaactgtctactttttcattttttcccctctggaaattgatatcatacttatgcattctctttatactttctttcagttgtctcagaacattcaaagcgaagtgatatctcatgactgatgagagcatattgttctaaaaaatggccatgataccatgctaataaaatgtgacacagaattgaagtaccaacttcttgatgacaactttgagtttagcatcctttgactttacaaaaatcacgatttgaaatgttttctctgggttagttattgtaacctaacatagggatttgacatatccccagtgttacataaaataagtgtgggatcaaaataagtctattgacacctcccaggggctttaacagtataaagacttccttctgttccactgctacaaaattgttatcttattggtgagttctttattcagaaaagtctcctttatccaacatctatactttttctttttataaacagaatattttaaatataatttgtagggtcttaatgattgggaatcacattattaatataaattatttaaagggcactaagtagaagtcaggagacatagatcctaacctgttaggaactgcctcttggatgatctctgaactcagcttctgcacctgcatttcattcattcattcatttattcatgtattcactcttgaccttattccagaaaggatttaaggtggccttcaaagaagttggaaatacaagctagaataaatgaaaaaaagaaaaggaagaggcagaaagataaaggcacaaaatggagcctggaatgagcgtagatattcatgccaagatgaccagcatgcttgatactttgagtctgttgccaaggagaaatgtaagtggtcttggtactaagatgcaacagggttgactctaaggagttccccacagagcggacacagggacatctgacctgataaaacaacatccttgccacaagctgagaaacatacaagaatgttagagaacttaaaaaaaaattgtccgtataggctgctaattatcagtataggccatgtataaatacagccacagttgcagcaccgttttgctaatttgtccatttttaaattacatttaaacaaaagcaaattaagaacaaggaaatgtataggtgacacaaacgttgaccattaaaggtggacatgccactcatatacatctcagcaaaatctcacatagaagaggtttttaaaaatacagcagcagtgaagagtaacagtgttaattacatgatcagagaattccacagaaacctcataaaaggtctcaacattcacacagcttatttgatactgatctattcggggtgacccctgctaggctcactgagggcaggtctgggaccctgctcaggttggcaggtgttcatgaaggaagatgcagtccgccgagtcaaacatcacacccgcagcaattagcaaaggccacaccagtgtgtagtttacatttagtaaatgctgttctacagagaaaggctataatgcacaccggctgcctagccctctcccattctggcttctgtttgaatgttcttcaggctgttcttcttgtatgccacttccagacgagattttgatgaatattactgggtggtgggctcagcctggcatgtcctcatgtgattctgtgtgaccagacacaggcctgtcattggtaaacccagggaggcctgtcaagctttgtgtttctatccctgtggtttgagatgctcagaggtatttgaggtatatgtcaggccttcattcctactttctgtgggcctagagtacttttagggtttgtatctaagaaactttctctctctagcttcagtagtgatcatcatttcttctgtttcttcttgcttgttgttgcttttgccttggaactctctgggcttctgaaccttccgaatctagacaagtaatgcagatcgttcaggtgcatatcagttgatgagaggctctcatagagggtttctcccgtggagtgaattgcatggactttctgacaactttggttacccaacagcccttttttttttcttttcctttgttgttttttgttttaaggaaatgcagccacagttggaattatattctggagggttaaaattgcccaaggccagcctctggagaagtagaacatggctagttatttgaatatttgaataaattcttcctaggtttaattttctgacacactgaccttcccagcaatctgggatggcaggtggttcaagagcaaggacttggagccagccagccaccttctggtcccagccatgcccctggccaatggcatgaccttgggcaatttacttatacttttgacacctcttggtctataatatttggataatagtaccctcttcatttgggtgttgtgctaattaggtgaattcatattataacatgctcagagcagtgtctagtatataagaagtgctaaatgggccaggcgcagtggctcacgtctgtaatcccagcactttgggaggccgaggtgggtggatcacctgaggtcaggggttcaagaccagcctgaccaacatggtgaaacctcatctctactaaaaatacaaaaattagccaggcatgatggcacgtgcctgtagtcccagctactcgggaggctgaggcatgagaatcgcttgaacccaggaggtggaggttgcagtgagccgaggttgtgccactgcactccagcctgggtaacagaacgagactccgtttcgaaaaaaagaaaaagaagtgctaaatgagtgactgaataagatttttaattaaatatcgttcttgtatttaatttcctacacctcagtgttgaaatcattctcatgtggcattcagtccttaactcttttaatccactagggggcctggtttctggtagactgtggcactgatgcagaattatgaagacttcagccgtgaggagttagatttttcccccaagttccagtatcttgctctattctttatttcctgcccaaattctaccctagctttcactctgtgcaaagaaaggagagcatcatctctcagaccaatggagaattcatattaagcacagcaaactttcataaattttgtttacttcatttgattttctcttgtagttgggaaaataatgtttcgctataaatatccttttcacatttctgttaggctgtaagaaactcggatcctataaatgatgattatcagttgattaactaaacaatgttagaacattcaaaaaggaaaaaatggtaaaaaacctatttgcctacttgaatatctttttatcttaaatcgactgaattttttttttccccgcactgacgtgaattcattgggagctttggtatcatgtagcttcaacttgaattaaaattgaaaagtattgactggacacagtggctcatgcctgtaaccccagtgctttgggaggccgaggtggacggatcacttgaggccaggagttcaagaccagcctagccaacacagtgaaatccggtctctactaaaactacaaaaaattagctgggggtgtatgcctgtagtcccagctgctcaggaggctaaggcatgagaatcccttgaactcaggaggcagaagttgcagggagccaagatggcatcactgcactccagcctgggtgagattctgtctcaaaaaaaaaaaaaaaaattgagaggcactgttggtaacatacttccctgaagttgtataggacttagaatgtaacccgagggaagctgcaatataggtgatcaagaaataccttatgaaaatattattgagtattttaatagcttttgaaatgcagcattttaatttacttttttatttcaaagtgactgaatcgataaatgggtaaaattgataaaaaacgacttaaattcctttcttatccttttatttagggaaacaattaatatctttagttgaatccagaagttttgccccaaaatctgaactccctgttaaataagctaatcagcacctcaaatttcaaggattttagggcaaacatgtgacctctttgaaatctcctcatagtacatctgcttatcctttcccgaaggttagggacgttggtgttactattcaaaggatgagacttcggtagagcaaaactgagaaaatagggaccataaaagctaaatacaaaaaagagtggagagggttatagcaccaaaagagaaaaggttccacattgtgtcagtgcttcttagactttcatcagggctctgactggctgggtctggaggggctgtcggggagtctgtggaggccgcctttctaccaggcccccaggtgatgctcatgtgcccccggtgagtgacagggcagctcctgtgttctggaacaacagaacattctgagcactcagttctgaatctgctcttgggcccttttgttcatttttccggaggagtgatcaattaaaatttggaaagtacttggatattctcagtcctgtgtaagtatcagattatgagactaaacacaagctcccagtagaccctctgctgccattgtaaactgcggacacgtcttgcttctctcttagaaacaggggaaggtatttgtcatcttgggagttcctgtggcccaatgagtgccccgaagcttgccgatggcgtcatttgtagccctctgttcccaatgtcctcagccatttcctcctagtttcatggggagctgcccggcacactccccagcaagcttttcctgcagtacttcttctccagggtctggaagttccgcagtccttttctctttcagcctcacctctctccttctgtttctccagcaagtacatctttaacgtgctcatcctggcttccccatctttaacttttcttttccattttccatctccaaacatctctgcccaattctgggtgaattcttcaaaatatatcatccagtcctaagtgtctcttcaactgttctaatctttttttttttaatttcaacaattatcttttttattctagaagttttccagaaggtttttcaaaatctgaccgttcattcctgatagtttcttgatttatgctcatctctgaaattgcatcctttgtttctttacacgttttgtacgtaactattcaaaacttactcctgagagttcccacctctgtaattcctgggggcctgaatttgttgtcatggtctgccaactctcacacacagtgacttgcccaaccagatgatgacacagtttggggtcaagatgttgatcaggatcaaagcttatgtagggaagaggaaagaagtgagattgggcagagggagaagtcagactgccatgctggcccagtcaagcctcagctaacctggcggggcactatggaacatgcccctagaggctcctatgttgggccaaaatgacaggctgccctcggaaggcagacctagaaggagctgcccctgcaggccttctgcagaccgcacacgctcagctgggcagcatgaccttccctggagggaatctgggcgtcccatctctgtggctacacttgctttccttagtgtctgagagtcttactgaactcttagcttcatcttcacctctgcaatgtttgggaaggcctctgaccctaatttacggaagctctttttctgagagttttgtttctgcaaaagaggagggtggggattcccagccctggaccctgtcagcacccttcaagggttttgctaggagtgggagcccctgggcccactcccccaccatgctaatgtcctcagtgtccgtgtacccctgtgctcctgacaggctctgtctagcacctccaacaccttggcttggatcccagctcctcacatgctccctgggcacacctgctctccggtgcacctgcccaaatgttcagctcccccccagccccaggcataggctactcaggccccagctccccattgtgtgtggggtacaggggccattctggaaccttcctgcctttataccagctaagctttctatctgggatggggctttccaggaggccttgggcttgtcaaagctccctgccagcggtcatacgtggagcagccattctgtgctttttgtaacaagtggcatctgtacatatgataaagcactttattgtattttttacaaagttacttcatttttaatgatgatgttgtttatgagtccttactatggtgtgtcacaaattgaatgaggcacatccgtgtatgtacttaggcatttctgcatatctcagtaataagaatttgtgtaaacactacagaagaatgcttgttccttttaagcttgaattttatcaagcttaattaagaaaagcagtaaagtttcatttgttttgttatatttgttatatttgcttaaatgtagtcatccttacttttttttttttttttttttacttcaagacgatttgaaatcaaattatattaactgacatttacagatcattatccccaaacataccaagacatccactcaaaggaagttgtatcatttatttatttatttggtcattgtacaccagagcaatccataatttcaggcttctttcttcccttcctttcccttccttttccttcccttcctttccctttccttttctttcatgtgaagtatattgtaggaataatctctaaacatagcccatggcacagtaaggattaccgataatttaacctttcaaaaacattaaatgaaacaagactttacattgaagtactaatttgatgctatattaaattgtcacttcaagcttttttaaaaaatgagtgaaacatgataataacagcaattcctgaaagccggagcccaggttcacactatcgtgcggagatataaatatttatctattgcagtacatcacttagaaccctttctgcttcaaccttcagtcagctgtgaatctcttaatggcatttcattctccatgagaatagcaacaaatcagggcttcataacccttattattctcggtgagtgcctaagggcaaaggaaacctaggtctggtggctgttacgttttatgtttttgaaagcctaattccatgactctaatttatcattgcattacatttctaacaagcccacagtagtacaggaaaaagttctgagggagaattaggaagggagaaactttacctttgttgacgacatcatttataagtagacttttttttttttcttttttgagacagggtcttggtctgtaacccaggctggagtacagtggcgcaaacacagctcactgcagcctcaagtgatcctactgcctcagcctcccaagtagctgggaatacaggcatgcgccaccacacctggctcatttcttttatttttttttgtagagatggggtcttctcatgttgcctaggctggtctcaaactcctggactcaagcgatcctcctgcctcaacctcccagtgctgggattacaggcatgagccaccatgcccagctgtaagcagattgttttttaaaaaaagacagaaaaaagtgaaaactgttagtgttggaaatgcatgttacagatgagaaaaatttaaaaagccagcaaaaataggaaagtttctgacagcactcttagaattaacggaagctattatgtggtaagtaatgaagggaagtgacaagagcaagaggtgcccagctatgacagtgcagaagtgaacggtacttaataaaaggaatattttaattttttttttttttttttttttttttttagagataggatctccctgtgttgccctggctgatctcaaactcctgggctaaagcaaccctcctgcctcagcctcccaagtaactgggcaaaaataacattttaaaatgcaatgcagtgaatttaacactgagaataggaaagctgaccccaaagaataagtgtgattgacttagctacatatagcaagtataagaagaattggtgataatcaggttcacttttatgaagtttgagagtagattttcagcacctattcagatggaagctcaatgtcaagcctccgctccaggtgccaggcagagctgctgtttgatgtgagcggagggcttagatacaggtgacctgcagagtcagacaggtggaaatgacaggtgagcattgtgccaccaggaggaatgcctcaggggaaaagccctactcaaggagccgctgaaaggaacactcttcggtattgtgttcatgctgcctgtgctctcacaggagaataagcccacttatctggtgtgtgctcttaatttctgagccacacacgggacggccagcattgttcagtgtttggtccatttgcagcctcatctgccttgggacttcaaagtgtctgcagacaggagttggcagactcatccattctacaaaggagcctcccgggccgcattagagcactgcacctgtcgagtctgtaaagcgagacattaccatcgcagaaagggacaactgtgttgatgacgtccttttgccagtggggaaggattgccttgtagccacatcttgtagaccgtggttgaaagtgaaagaaatgcacctttcctaaacagtggccccaagggactgcattgtaactttggcattcttgtaatctggaagttaaacatgtggaagagaggaggcaaaggttcctcagattgtcttgtggttgagccaacagtgttttacaaaagggtaatagataggatgctttaaactcttacaaagaagagaatgaccgggtcaaataataggttgttaaaagcatggcattgtggtacccccagtacatgctcttcttctcactgtctttcttttattttctttttgttgagatggagtttcgccatgttggccaggttgatctcaaactcctgggctcaagtaatccgcccgccttggcctcccgaattaccgggactgcaggcatgagccactatgcccagcctcttcttgctgtttttgaagcattcgcttacaagttattttgttaatttgtctatgatatttaagttttgaagaaaaatgtgctcacagttgtgatcctagaagcaacataagatagaaatattttttttggtgttttacgtttacactaatctcactttataaatacagagacactgcagcattattaattatggagagtccttgaaattgggagtccccgtcatgcattaaagatacaacccgtgtctctgagagcatttggggcacatatcaggtgctcctggaagtctccctccctcacgccttcctgcctttgccctctccacccctcacctcggggccttggctgcatcttggccctgcttgagtcatgagcaggtcttgtttcccttatctccacattcatcagaatgggttgtctttttttttcttttttcttttttcttttttttcttctcagacgaagtctcgttctatcacctaggctggagtgcagtggcacactcttggctcactgcagcctctacctcctgggttcaggcgattctcctgcctcagcctcccgagtagctgggactacaggcacctgccaccatgcccgtctgatttttatatgtttagtagaggcggggtttcactatgttggccaggccggtctcaatctcctcctgacttcaagtaatccaccctcccctgcctcccaaagtgctgggattacatgcgtgagccaccatgcccggccagaatggagcatcttaaaggcagcaagttcctctgtggttggtatgggagcatcatgtctaagcagtgttatgcccaaagatcccctcccctccaagggtgaggatagggaggagctggaggggaaggaggcagacgtcctctaattgttgtgcacgtgattctgtggagaacaccatttatcagctttatcagtgcatacaaactttgggaagttgagagaattttaagtgtgaattctgtataaatcatcggatgtgattctttactcttattcagtgacagattgatatcactagggttacgattctgctccacccctttcctcaaagttctgtttctcccgtgatgctggagaatgaggatacattgcgtggtacagtttacacgtgcggtaatagtcccagaacagataaactgtgaccatttccgaattctcccccaagttaaccatgtgactgccttgttttttttttaagattaacatccttaaaccgttattttgtggtaccctcttttcctcctttcatgcccgacatatgccttttttcctacttattgtgtaaagttcttcatttgtcatggccatcgtgagaaaaatctggggcttccctttcatcataaatgacaggttttttttctgctttcaaaatctagaattttcatatttgtaacacctggaggtaagggtcatggtgttaattataaagagagcagagagagtaggcatctgtaggaaacatcttgggtttttttaattatttgctggattcatttattcaacagttgtatatgaaatggtttttacacatgaggtcctgctaagggtagtgcttgccaccttcgtggagcttacatttggcaggaagctgtattacactagatgaatcctatgtggatgtgcaactcaaaagaaagggttgtggactgagaatcataagtttgggggttatcgagacgcagatagaaatgtaaacaaacggtgtggatcaggtagcctgtacacagtgaagaagagaagatgagaggacatctaggtcagggccctgacaatgggcatgtagaggaggaagcattggccaaagagcaggaaagatgggacggagtaggaggactgccaggagaacacagcgtctcagaagccaagggagggaggaagccccagacaagagcgctgtttgctcatggggttcaggagagagaaaggcggagaagcatctgtcaaatttaaccactcaaaggtcattgagatctcagggggaacagttgctctgaagggaaaggaaagtaaaatccagagcaggatgagctgcagaatggatggggggttacagagcaacagaaaataagcgtagacagctctgccaagaagccagtcaggagagagaccagagatggagaaagacatggagtcaaagaagggtttgtgtttctttttactttttattgtaaaaatgttcaagcagacagaaaattggtagcatatacccatcacttagattgaacaattattaacattttaccacatttgcatcattttatttttgcagaaatgtttcaaaagtaaatcacagacacatttcctctgtaaatactttgatatgcttctctgaaacataaggacttctcaggttaagaaaattgccaataaattccttcctgtcaccaaatatctagtgagtggcataatcaggtgtccccagttgccctcaaagtgtacgttcaagccaggatccaggcggtgccagaccgtgcatctctgcaattgagagggcgttttgtgttttgtttttgttgctttaatgagagaaacttcagcacatttaagcactgttgagaagctgctagtggagggagagaggttgaggatcctggactgagagggaggatgctcaagaacccgacaagatgcgtcgcagtgtgactggagagaccactctcagaaggggatccaccgtgcaagcactgagtgtctttgcctatttgtgttgctgtgaggaatacctgaggctgggtgattcataaggaaaagaggtttatttggcttgcaattctgcagactgtacaagaagcatggtgtcagcatctgtcgctggtgagaccctcaggaagcttctactcatgttggaaggcagtagggagctggcatggcttggcgagaggcaaggaaggagaggggaaggctcttttccataagcagttctccctatggcaccaagccatttatgagggacccacccccatgacccagtcacctcccaccgagcaccacctccaacattggggatcacattgcaacatgaggtttagaggggacaaatattcaaactgtatcactgggagatggggctaccggaagtcaagccattcccctcccatggcacccttttccacctgaagtaggataacttgcacacggacaagaaccaggtgtctctgctccctgatgcaaagtcagcaccgctcatggtaccaggcatatgatggatgctcaatacgtattttttaagtgaatctatgaatactttttttttttttttttttttgagacaggagtttgctctgtcacccaggctagagtgcagtggcgcaatctcggctcactgcagcctccgcctcccaaattcaaacgattctcctgcctcacccagcctcctgagtagctgggactacaggcatgcaccaccacatctggctaatttttgtatttttagcagagacgaggtttcgctgttggccaggctggtctcaaactcctgatctcaagctatccgcccaccttggcctcccagggtgctgggattacaggtgtgagccaccgtattctcagcctctatgaatgaatattgagagtgatgagggggttttgaggtttaataaaaatggaaaaggttcaaaagatagataacacttccatactactttttatgcaccaggctttgttctaaaaactttataactaactcatttaatcgttaagtactattattacctcccagtttccaaatgcagaccaagaggttgaataactgtcccaaggtcacacaggtaatgaacacggagctggaccgggagggctcttagctgtgtaaggtggctgaggctcgtgagaccccggctaaagctgtagctgtaaatctacagtctccctggttcagggctgacctccagcagctggtgtgtgtaggaatccttggagttaacacccgctggtgttacgagtttgtgctcagcattctctgggtcaactgggagaatccaccaggattctcattcaggtctctttgtgtcaacatctgcctacaacagcgcatcgtgctagagaacagaggttcctagcccaggcattcacagacccagttaaatgttcctccactgaaatgcagcagtgtgcccttttcccagtgcttccccccagaaattcagttaataggtataattttctctactgcaaaattttaacccattaatgctttctaaacctttgatatcacctgcagcttggcagtactcgaatctaatagataaactttggtatgacttgtgggtttgtacatgtttatatcctcaggagttttaggtattcatcaaggagccccataagtgagccatacgtttgagaacaactgtgtgtagacttgctgataaagtagacagactttttttttcttttttgttttttttttgagatggcgtcttgctctgtcacctaggctggagtacagtggcacgatctcggctcactgaaacctccgcctcctgggttcaagtagttcttctgcctcagcctcccgagtagctgggattacgggtgtgcaccaccacacccagctaattgttgtatttttagtagagatggggtatcaccatcttggccaggctgatcttggactcctgacctcgtgatccacctgccttggcctccaaaagtgctgggattacaggcgtgagccaccgcgcctggcaaagtagacagatttgatctgtctcttttcagtgtaataatttagctaatgtttaaggtaggggaggtatagaatgtaatctgtatgggtgttttttcctaaggggggacaactagtcaatgatttgctgtataatattcaaaagatttcttgaccatatttgtagcatgaataatggttctttgtcgctgtgagacatagctttctgtggctctgcacagcaacttgaatcagagaggaatggcgggattctgtaaaggtagttcgtgatgggagctcagtgaggggttgagcagcaaaaccaaaatcggtgtgtcccctggggcagggactgtgtcttgtgggcctcaaaaataactgcctcggagcagaccccactcagtacatgtctgtatgtcagttgggagcacaaaacaggtgtaacattaaaatttcttaacagagttttgaatgaaaataatcattatcatcttcagtatagtatagtacacagcaccgtgtgaagtattttgacatactcttacctgtaaccctcaaaacaaccttcaaggtaggaattaggctctttttctggaaaatgaagctaaactgtggagtgatttggtaacttgcccaagatctcacagctcgtaaatggaggcgccaggacacacacacacacctttctggctcgcaaacctacgttctctctactgcacgtggagactagacttcctcagtctccatgtttgaaggcccatccaaccacctttctacagaggccaagaaccccttttcatttctctagatcagatgtgagaaattttcttttcacccagtggctatttactgcctgttttgcattagcaaaactcaatttattatattttgaaaggaaatagaaaatgtttcactcatctaatttcaaataacaaggtgaaactctactcaggaattacatgagattaaaatttatagctcagttattgtcaataagaaaaaagaaagggaagaggcatctttaaaacttgccaaaactctagatggcaaaaatcagaatcaagtaccaatgctgtttatctttaatgatcaaaaccaaagactttttcattcttaaagtggttaaatattatcagaattgattattaacagtatttacaactaagaagtttgaaaggacattctaattacttttgtattttttataaaatgctcattgtaaaaaaaaaaaaaaaacagaaaatgaaaaattcaagcagtatagtagaaaaggatcagaattccctccaattgcatcattagcatctctgaatatgcccaacatgtatggtgtttacagtaatggaatctcaccatttatgctgtttattatcctggagattgcacacgtgtcagtggacatagagcttttttgaaatattacttccccatgattttaaaggaaggaaaacctaagcttcctttgggaagtgcagagggacccctgttttatgaaaatctgctctcagggagaagtggctccatcttgtggccctctggagtttggtcatgaaaaacagccaaggtcgtgttgtgtttttgcaactctcctcggaaatggtgtcaaccctgggcttgtccagttaacttggtggaaaccagcagggacaaggcagtccccatctgccggcagagcaggagcgagggtgctatggtcacaggggttgcccccttctcccctgctctcttgagaagcttagctctgccctcccagcttctaacactgggctctccacaatttcctctttcatctcgacttcaacactgttagagaagctattttagcagccaggttgctctgcctcagccttgtagtcagggctttgggggtagaagacagaggcgctaggtggagtgtaatatcccttaaaaggaatttgagaaagatagtcacatgtcctcttgccttacacgatcatatccaaggtttgaccatacaaattccatttggaatgttggaaaaaaatctgtttggagataaaattgaattttcttttctgtgtagagatggtgaacacagatgtgattggtaagcagtacaaatgtggtcattttctgtaaataagaccctaatggctggagtttttcactttgtatgaacaccataggcgtatgtattttacatctaaggaagcaatcttttgattggatgtttttttcctttttctttctctcctatgcagtacatagtggaatgtcatgggatcacccttcttccccagttcttgggcatgtaccggcttaatgttgatggagttgaaatatatgtgatagttacaagaaatgtattcagccaccgtttgtctgtgtataggaaatacgacttaaaggtgagactgattttatgaatttttgtaaagtaactcaagcttactcttctacattgtaaatgttgtcattgatcatcagaaatgcttaggagccgctcagcacttaaagctaccagacaagtagcagtgtattccttcctgtgaggcaataagtgcttgctggcctcaccgaaaaacactggcacatgttagagatatcacatctacttaaatattcagccaactgcataccaggcactgttctagatgctggaagtgatgggatgaacaaaccaaacctgcactcggggagctgacattctggtgggtaaagacaggcagtaagtaaaagtgataagttagtcatagagcatacccagaagtggtaagtgctatagacagaattaaagagggggagggttttaaatagtcctgtcagggaaggttcccctgagaaagatgacattggagcagacttgaaggagatgaggaaatgagctgaggaagaatattgctggcagagggaactgtaagtacagagaccatttcaaaggcttggagataaaggggggcccctggaaattctgagagtggagtgacataatctggcttctggtatcaccaattcaggggagaatgttcaagttaggggttggaaaactatgacttgcctgaattccaaatcctacttgagggacttttttttcttttcttttcttttttttttgagaaagagtcttcctctgttgctcagtctggagcgcagtggcgcaatcttggctcatggcaacctctgccccactggctcaagcagtcctcccacgtagctgggaccacaggcacgcaccaccatgctcagctaattttttgtattttttggtggagacaggatttcaccatgttgcccaggctgatcttgaactcctgagctcaagcaatccacccaccttggccttccaaagtgctgggattataggcatgaaccaccgcggctggctgggccaattttataaatacatttttattggaataccacgatgccccttgtttctgtattgtctgttactgcttttgcactgtaatggcagagtttggtagttaccgcagagaccatttgggaccacaaagcctaaaacgtttacccactgactgtttgcagaaaagtttgccaaactctggtctctgacatttggttctcaagttttttggtctcaacgctttcacgctcttacaagaggacactcgaaagcttttgcagatgtgagttgtgtctgtggatatttacagtattaaaaattaatataagaaatattagaatatgtagtttctttaaaaatgagaaaaacattacatgttaacatttttatgaaaaataactattttccaaaagcaaaaacatgaatgagacaagtagcattgttttacatttttgcaaatctccgtaatgtcttgacttaatgtgagatagttggaatgtcctgtctgattccgctgtcagtctgtgtggtgttatgccgctgaagtatgtgaagaaaatctgaactcacacaataatgaagtttggaaagttgttaaagcatgttttaacaacttttttggataattgtagatattcttctttgatactacaccaaagcttgacaagaggtaatttctcaaagcttagttacattatgaaatctgaaatcatatcaatgaactttttgtactcttcatcgaaatccattgattggtttgcatgcattgtttgaatgtgtgattttgccaaggcatgcacttgccatttggaacacattggttcactgagttatttgactcttccaaatattgacacatttcattatacagtatcaaaaagtcataacagtgttaccaccaatgtcatcagaaaagtcttttacatattgggaagcggtcaggcccaggatggtggatataagttttttaaaaatcagttttttacttggaatctcaaattttatcactggccacaagccctgtcagttgttttctgtgaaatgaccacatgtagcaagcaccccagcatacaggggagcctagcagcttcattcattttgtagcaaacatcagtcacatgcccagatctaaataaacatagactgtcagttgttctttcaagtaaaagtgttgtttcatgaaaaagatggccagttcaactcataactcaaaccatcacgaaaacagttcttaagaaatcattccttctttataaacagaagtgctttatgtatatttcctgcacagaatattgaaaagacgtgtactcctgggtctagatttgatacatttaatgttatgctttcatgtgtttactagatgcctacttgtatgacacaccatcttagccagaagttcagcaactcgtacacagctcacaagtcacaaaaaccaggatgtgtggcttcagaggtttctgaaatgacgctgggtttcttagatggtgctggtttttttcattgttttttttttttaaatcacaaacactactaatacccactgttgccactgtttgacttatgctaaactgctagcagttcttcccaccattgtttttgcattatttatacaaatatcaagacgctgaaaaaggcaaataatttctcagtattattataaaaatagttttggctttgtatagttttggtcttgggaccccagggttctgaaccatgcttagagaaatgctagtctaagtgaaggaaatggtctaggcttgtctcctaacctctgaagtccccacacactggatccacttcccaaatacacccttgtcctgtcctgtcttaaagtcttcgcccaagcaagccattttgtgcccctggaattgcccctggggaaatcccagccatcctccagggcccttgccagcaccagctcttttcgtgaagccttggcggtactgctcagagcacacaggactctgtctgacttccccagggaagaaagccagagtgacctctaaagtcacatgttgttcttttatgacttgttaaccttgtgtaagttgctgaacctctatgaccctccgtctcttcatctgttaaaatagggataattttacctacatttgcagggatgttttgagaattaaataagatacatatgtattgtgtccagcgtgaggcatggcatatgggagttaatgaatcttggttgcctcattcattctcctgatgtgtaagtgcctcaagggcaagtatgttcttctacttaacttttttttttttaatccccctgcaatgcctaagatagcgcctcggacaagtaggcatctggtaaacatatcttggagtaaattatacttagagattggatattctagttttaatttgccttgcttttttcacagtttcatctccctttctggcttgtggcatagataaactctgttcttgccagtgctctcagttgtgatggaacctgtacatctggcattgtttcatggcttaaactcttggccttccttttctattttttttaataattttttattgtgaattaatttaaacttggatgagttttgtgttttgttgttcccaagctaatgatcagcatttgcatacagatgaagcttccctgagaatcagaagcagggtggattatattgtaggagaggaaacacacacacagacacagacagacacacacacacacagacacacacaccccaagaacttggttaagaattcaaagtagaatagtttcttcctgttcccagcatcataggcagtgctcaagtattacaaatgtcccatttttaaaaagtatttgggaacattcgttgtgaaaaatcagtgtgtaaaggaaggtacttctggtccatattcaggaatccctaaaggaaggaaagtagaccatggcaagtaacagttgctgggcatggctgtgcagaggggctcggactgtggtcgtagaatgggttctcaggtttgccttcatgaatggttcacattatctgtctccatctgatgggtcagctttgggctgctctgaatcgccctgagaaacattgaacattttccctgggccagcagcagcgtccctcggatcttccagtcctgggggcactgagcaccagggggatggaagatcggccctggggagacccccccagcctggtcttggctcccttccccaatgtgaggagtctcttccgttcaagtttccgcatctgtgaattgcaggaagctcaatcctagtcaatgcctgagctgctcgatgaaagccagtaatcaaaaattttgatttctttgcagatggccaatctaaaagccactttcacttttcccaagccaactgtaagttcatttaatgaatggctaactcaagtaacccagggcaatagatgtcttttcatcaggtggtaaagaagcaagtggcttggctgacctcacgatagttaggggtgtccagtgcaggaggggaagggagcccaggaaattggcctgtgattcttctccagccatttatgcagtaaacacaggacatctgctgtgtatgagacaccgtgattgtcatccatacttaggaattcaccagaccatttgtttcccagcttttcttttgaattaaaatcttccacaagccacgggaagtttctctgcttggactctacccctaaagcctccccgtcggcctccgaggtagactcaggtcatgctagacaacccagagctctaaggcagagttttgaacaccactgcagtaagagcacaaactgctgagatcaagggccatgttttcctccactttgtacctctgcactcagcatagggcctggcacaaaagaggtacaaataactgtgtgtctttgaaggaatctccaaagtaaatggggtcagagagtggctgtgggggactgatgtatagcaagcaaggaaagagtgttcatcagtaactcttaagacgggagaaaacaatgagcattgcagaaaaaagtcagcaggtgaggatgtgcccacagaaggacgtaatgtggggaaagaggcacttaacgctcctgtggtcccactgcagccagctagtgggactctttaagataacaggactgactatttctggcagttgatacaaggagtaaagtgtggggctgatccagtgttgagtaagttactgctcaagtaagtgatggtcaggttttctaacttccagcaggtggacaagaaccacagaaacacaggtgagcaagacagagtcagggctagagaagcggccagtggccaggaatacctgcagagaggggacacaggccggacagagagccatggtcagggagggatgagaagcccattccgcatgggctgcgaagcagagtgggtgctgagctggctctctgctccgcctggagccattttcatattttctgcgtgtgaaacccaatgcctcccatgcgcatgtttttattattgccttgtgtttcagggctctacagtggctagagaagctagtgacaaagaaaaggtaagtaccttgctgtatgtctccccatgtcctgggggcatgatcacatactcccaatcacctttactctttatttctagtctcccacccctgctattgtggttcttcctgttccccattctgctgccaccagcgagaaacactgtattgacccgatgagagttctacttcatttctcttcatcaaattgttgaatagtgaaacagttatttgttgcaagcatggttggaaggaacattccacatgcaacttgctcttgaaaaacacagccacctgtgcagtaaacctataatcgaaaatggcactgacagctgagagtgcgttcctgcgggtcagggaaccaggacctaacactgcttcaccgatatcaaaccgaatgtgaccctgaatacatttctttgcatcgctgagtctgctttctcacctgtagtatgttggcttggatgagcctcaaactcctttccaactattaagacatgatacaagtattttttgcctaagaaattaaggataagaagactgcatctctttttctcttttcctggcttattggaccttaggtagtatttgagccacatttagtttactgtgcaagattatagagagagtcaacttgaaggattggtttgaataggaatttaggaagtagcttcctggatgtaaacctaaactaactcaagtcaacacatgcttatataaagggtacatctatactcttagttatgccttcttgtcaccttgggaagtgcctttttcttaactattccatttgaaaacagagctcaaaattgttgtttgaaagttgttcttttagactgatagcagttttgagttgaattttatagatttgcaaatctacttttgtttgttcattcagaggtgtttgtgaatatttttgtggctactatcctagcttcaggggctaaaataacaagacacacagaaagatctagcaggggatgcagacctcaaatagaaaattatgttatcatggggtgaacacttggacaggacactcagggagctctagagcacatagcaagggcgcctggctcaggctgggcagggtcaaggaagggcttcctggaggaggtgatgtccagaaacctgaaggatcaataggagttagtcagaggaagagcggcaggtgcaagggcatgagagtcagagtggggagtatttggtgcatttgctgcagggagagaggaagccacagagggaaggaagccagtcctgtcagagaggctgatgaagtagcccggagaagatgctggccggagctgggatgtggtagaagtggatgaattacagagagatttgggaagacaaatctacagaactgagggattgagtgccagaggtgccagggagtgtgcgtagagggaagggggttaaggatgacccccaagtttctggtttaggcagttgggtaggtaggtgttcattccactccctgaaatagcaaacaagagcaggaggaggagtttgaaatgtcagttatcggggaacctgccccgatattcacataggttcttttctgtttttcctaagcatcagccggcttgagaaataaagggacagagtacaaaagagagaaattttaaagctgggcgtccaggggagacatcacacgttggtaggatctgtgatggccccacaagccacaaaaaacagcaagtttttattagggattttcaaaaggggagggagtgtgtgaataggtgtgagtaacagacatcaagtacttaactggttaatagaatatcacaaggcaagtggaggcaggtcgagaccacaggactgaggcgaaattaaaattgctaatgaagtttcgggcaccactgtcattgataacatcttatcaggagacagggttttgagatcaaccggtctgaccaaaatttattaggtgggaatttcctcttcctaataagcctgggagcgctatgggagactgaagtctatttcatctctgcagtttcgaccataagagacaggcacacctggggggggctgtttataagcctgtatctccaggcgcgtattctctttctcagggatgttccatgctgagaaaaagaattcagcgatatttctcccatttgcttttgaaagaagagaaatatggctctgttccgcccggctcactggtggtcagagtttaaggttatctctcttattccctgaacaattgctgttatcctgttcttttttcagggtgcccagatttcgtatttgttcaaacacacatgctgtacaatttgtgcagttaacgcaattatcccatggtcctgaggcaacatacatcttcctcagctgacaggattaagagattaaagtaaagacaggcataggaaatcacaagggtattgattggggaagtgataagtgtccatgaaatctttacaatttatgttgagagattgcagtaaagacaggcataagaaattacaaaagtattaatttagggaactaataaatgtccataaaatcttcacaatccacgttcttctgtcatggctttagccggtccctccgtttggggtccctgacttcccccaacagtcagtgcggcgtcagaacagagatatccagtaggcatgagaggctgcacagtggctctcagctgaaaaaagagtgtgggaatcctccctgaaaggatggttggcagagacaggaaagtgggtgaggtcccccaggaggagtgtgtggagaagagaagcatgtctagaacaagcccagcagaacatcaccttttacaggagccaggagacactgggtcactcactcagatattgattgtctgtgatgagtacacactctgccaagcattgtaagaactgcttcgtggaactaggctgatacagtccccatcctcatgaaactttcactctagtaattttccatgaaccagaggaaatgaacttcccagcgtcagatgctttcgtgaggccaggtagggtaagaatggagagttgtccagggacatatccacagggaaatcgctggggacctggtcggtgagggcgagtggggaccaaagccagattgcagcaggtaaggaggagagaagaaaatggtggaggcttctttggccatttgcccttttactgtacatcagtgaatgtacattttgagaattcaaccttcgcctaaaccccctctaaggcactggctttggccagaagaggcagaaacagtgactgtcgacttccatgctgccatgagtgaatgtttcttccaggtactgaagactcagcaggtatttcagttttagcccatgagaagctcagaggctaaattttgttgagattttctcctcagaggaaatgccagggtgtgtacagagtcacacatgctcttcagcatcgtacgacaggccagcccctgagtcacatgatgccccatgttggtgggtctgtttttactttcttccaaagttccttgggactaccactagcaggatttttttccttcattcattttgatttcttcaggttcagtcaacaagtgcttggtcctgctctgacagtaaacactgccaacaaggacagttacagctaatggcgtggttgctgctgaggcctaaatcataaaacaagggcacacagagaggaaagccacacgtatttgacttcctgtatctgtaacggttcctgcaaagcaggacattcacttacctatcttccgttccgctgttgcacctataggacttaacacactttccagaaacccagggcatgaaccacagttcactgccctcctcaccaaaaagtgtttagtccctttattggtatagcttcctatgaaaagagaataatagaatttgtttgaccgagaactcatctttctaggactctgctaggatgcttttatcctgtatctaatatgaacacgtagccatcattccttaaaacatctccctagggggtaggcttagaggaagtcacaactggcactggttgagtacaaactatatgccagaccgttttaaattgtacatgaattatgtcatgtaatccttaacagtcaccagatgagattggtgctgtcgttacttactttgagtggatgaagttgcttaactgacaggtttagtaacttcatccagggtcctacagttaggaagtgacagcgccagggtttgagcctgggatcagcagccccagagcgcacatttctaaccactatgccacactgccttgtaaatgtttgtgagttcatgtctctcctttcctttaagggcatattatcaaaaagtcatgttaatcccattgtgaaaatgaggaaaaagttaactacattgacaaaaacattgtttcagagttaaatatggtgctgaaacagttgattctaaaacttgattttttttctaaagtagtgaaataaattatttgtttccatactatgttagcaaaacaatttgtatttcctctatttgaagagcttgagcattttcgctcatactttcagatgtacatatttgtaaaacttttacgtttaatgcagtctttatcacgtgtcttacactgtgcaaacattagaattgtctgcacagttgccctgaggaagaattcagtgccctagccttctttttgtggttgaggtttctaataactcttattccagaagacagaggctgcataaagctaccccacccacccttctatattaaaaatgctcacttgggaaggggaaaaggaaatagcttgaagatgtggaatgtcaaagtcatagaaattggtaaatgatggagagtgtgcctgccttgacagtagggtagagatcaaaatgtaccttcattcatgcacagtaaaagggcaaatggccaaagaaacatccaccatttccttttctcctcctcacttcatcacctgctgcaatctggctcccacccaccgtcaccgaccacgtccccagcgatttccctggggatacatcacccagactagagagagaggaggcatttgaaatgtcagggtggcgtcagaacagagatatccaataggcatgagagggtgcacagggtgtcttagctgaaaacaaagggcttgggaatcctccctggaaggacggtcagcagagacagggaagtgggtgaggtcacccaggaggagcgtgtcgagaagagaagcacgtctagaacgaacccaggggaaagtcgtcattcatggctcggtagagatcatgccatgccttctctctctgatacagcagtgttttgtagactctagaaacgtttgttaaactgtaatagatgaaatgaaatgtattaatagagccaaactgttttgttttttttcgagacggagtctcgctctgtcacccaggctggagtgcagtggtgcaatctcagctcactgcaagctccgcctcctgggttcatgccattctcctgcctcagcctccctagtagctgggactacaagcgcctgtcactacgcttggctaatttttttgtatttttagtagagacggagtttcaccgtgttagccaggatggtctcgatcccctgacctcgtgatccacccgcctcggcctcccaaagtgctgggattacaggcattagccaccgcgcccggccaagccgaactcttaaaaacattgtttgtttgtttttttaacttttaaaaaaagtctttgctttcccttttctgccatcctttgggttttctttccatgatcagttaggatttttgactcttccaaaaagcctaccattcattgtgttcacaaatcataaatactcctttttatgatcagacatcgggggggaaaatgctatcaaaacagtctactaaatgctatcaaaacaatctactggtacctactggtttgaaatatttggggaaggctaaaaacacttactacattttagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaccactgcattccagcctcagtgacagaacaagaccctgtctcagaaaaaaaaaaaaaaaaaaaaaaaaactgcatagagaatctctggtgacatagtttaattagtaatctcaattcttattcttcccaggttttctttcatatgagtcattataacttctagttttccatacttttaacttgttgatgacaagtttgaaactgtcatttcaaatatttagcgttataggtgcagacaagtcccatttcttagattgtagcttgacatgtaattagtgtgatttgcattagcataatcatgaagatggaactgaaggaaataagttatattctaacaatggaatcactttcatggcaacaagtctcagaacatgcatgtacagatgtcttgaggttttttttaagagcagaacagtgctttaaaaaaaaataaccattgtcaaattctgacagctgctatgacttgttttattctttaattctttcctttttaatggaagggcatctcccattcatggctccagcagtttcgcctcctctaaatgagacagagaaatgtgaacctccctggtggtcgatcttttcacagctgcgctgcaattccagtgtgacatcaaattagtaattatagctgagcgggctgctttttacaaatgacagtcttagcatgctgcctgctagcgagcgactcagcaggggacctggggaagtaaaagaaaacataactggactcacttgatttctgggggatttgacctgactctttaaaaagcccatgttcttgagagagagagtcctggggatttacacaaatatgcattttgttcatcatcctgcacagttcttctcaaaactcatgtctgattttattaggtaaagtaaagtatgtgtaatggagccatagggtcacaataagaagatcccttttaacatacagccttcttcctgaaacccatttgaaagaaaacagctgccctgcaattggcatttgtgtaactgtattggcaataatcattgttgacactttgataatgggctacaaaaagccgccttgtcgattctcaggcactgtgaattgcaccagcaattaagtgactgtcaccgtctccgacgttttacctattaccaactgagggttcgagaggattaatcattaatacccttacgtctaaaaatgcttttcgaaaccagttttcagcatttcttttgtggtctttaaattgtaacaaattataattaattactacccctatctggtcatctgggctgccattgaagtgaggtggccagggcggcgggctccccaaacgtgacacaaaagcacagcagcgtatccttctggaaatctttatttgccgctcagctaagaagtgcctctttttccactgtgggcggatcatcggttaaaggggggttgtcaagctttttaggccctcaattcagctaatgctttaaccgccttctgtaaaattccttttcttccgagatagaagggaatcatttccctttgccagccagtgttagttagggacaccaatcctactacccaaagtgcaggggaaagtttcccactagggcagaagcagggcttctttctcagaccttaaaggtggcaccagtaacatctaccttctggaccagagacattttataaaagggagatttgggtgaaggactcgaaacagagggttaggggatctgagtcccagccctgggggcacagggctgcattaatggggtttgagtataggtcatctgactttgtcctcgtttgtaaaattaaaggatttgcttgcgtcattgctcctcatgctgtagtgttggtgagaatctcttgtttcaaatgaagctttcctggaccttcctccagagatgtggttcagcagtcggccccacttggagaagtcctggcctgaccatcactaaaatcttctctattccagatatagattaaggtgattgctatgattgatggggaaaaaaatgttctgttcagcaaatatagataagaaccccataaaccatgaggggtattctggaaatgaagttttaaagcttcatttagaatatctcgtaactggtaagcatggcacgtgacaaaaagagaggatcacatgcagtgactcttgtgagcactttccagattttcactcagatgacagcattaaaatcctcaaggctttatgacttatggcttatggtgcttcatcagctctcatttgcctcagattaatttttatctcactggaatgaaatcaactcagagtatcccaagcacacgtggagcactgctgttaggtatgggaatgttttcacgctaacaactcgtagttggttctagaaaaagttggggtggagagaagacttccaaaattcagtatgtggtctgaatttaaaccaagctgctacagatgtgtaattcttaattaaataatgatctttaacatggtagtattaaaccagagatctagaggagttagcaaactccttgagtgttcagcctttgacatttcttagattatcaccatagatatctgcgcaccagaatcttctgttccgactggaacgaagccatcccgtaggtcctattttgtaggtcttgtatgcagttcagctgtcatatcccagtttgtggaggaagaccaaaccgtcacctttgacattaccacatagagttgtcataaaatatgacagtattaaaaaaggaataaattttactttttacgtattagcttgagggaaaattgccaacagctaggtcttgccagccctaacagttataacttaacgcttctccagttttgcgcggcttacttacagcactgtttcacaagtatgttgaggtatattctctttccacattcatacataaacagattcaaaataaaaattataagatgttcacatctggatgctagtcacagatgtgcacattctcactgttttcactgtgaaaattagaagttattaatgacctcttagatcatttctcaaaccatgaacttgtatagacattctgcttatgtagttaaaggaggttggcatatgtactatttgtgcaaaaccaccctttttctttgctacttctgtatgaactttatccgtatccactaatttgccttttgatgtatcaaatttgtggcttagatgttccaagaagcagaactgattttattataaatctccagcatctcttattaccccagaattgataccaaatatgttactccatcaaattatttttatcctagctccaacataaggattacctaaaattccttcccttatagaaatacttgtgaattatgttttcagttccatagatgctgatttttatgaagatttttgcaagcacggcaaaaggggttttattcttttttgcaagtttattttcatttgggtgagcttggaattacaagtaaatcaggaacacaagcagttctaacataaaacaataattactacgtattttttatgtggagcattcagctctgagtgtcacagtgacagcgtatcaaaaggacacccggcagcagtctttgacattgaggcttacaattagacttaaaaaataataaataggttgccaaatgagcatatcaaacaaaaaattcattccgaaatacaagtcctttaatcacagagtactatgatatgtattatcctttgcattaaaacctagtgccaaaatcctgtttgcattagacactcaagtgtgactgggtgcatttcttcttcccagtaaagtttccatccagactaaaataaaaacttggctctatattataaagattttggctctgtgcattttaggttcatgtattttctatttccagttattaatggccatttacccatactgttggctcttgttgtataattaaagtttagaatgatcattaaaaatccaatgatattttagtttgaattctgtttaatgtttcaaactatagtttgaaatttgtgatttttaaaaattttgtgtcatctgaaagatagttttttaaaatctcactaaaataaaatgttcatataacttctggctttactaaaccttagaatatccaatattgctcaactccatatgaatgacagcagttatgcatcaaattacagaacctcatgaaataagcacatatgtacacatacacgtgagttaattcccacttcaaacaaacaaagcatttaactcttttggtaaacacattgttttggttttggttttagagattctgcaaaagttcttagtcatttggaatttttaagcataaaagtactaaataatattaagcaggaattttttaggtgttgctttttagctcctttttatcagttctgggaagcaaacagtgctgcatctcctttgctctcatagaattctgtaatttttataccacaggtctctgctaaaaggcggcatgtgtttagaaattctaaaaatgagggctctgaactttgtaactgtcctgatacgttttcccttttttaatcccaaccccctggccaaatctgtccttagagatcattgataccttgtattgaaccctagggcgtaagtaattccgttgagaggcttttatacactgaaagccttacgcgtgtgttggttatcttcaggctctgactcagctgagtgtgcatctcacttcgcacattcatgttgtgtcttaatgacacacaaactatttttgaccatgacctgtattgtcacacagtgtgtttcttactgttgacttacagtagacttgctgaggcctgtgatgctgtgctttaaaagccaaaaactttgcaaaatgagggagaaatgtctataataaatgtattatatatacacaaatgtttataataaattttctttttacaactcatagcaagttaaatgttcccagtgggttcactgctccctaggagtgagttcaccattccctagtattttggttatattttctggctactaagatttcagcttctgtggatttttgctttaggtcagcaaaacagcattcactaaattatccactattataatgtgctgagaaaaaactaacccatggaaaattaaggtaagacagaagtcagcaaatttctgtctttggccagatacgtaaaatcattacattttattccatatattgaataaagatcataaatttcaaattctttattacttcaggaatttaaccagtccaatttttatgataagatagggacattttactctcatttgggtttcagtttaaacaaaaggtcttttcagtgaggtttcctactaggaatagcttttgcaggtgatcacagaggtttttctagctggtagcattcacaattgaggtttgcaaagcagtgtagggaactagagccgccacgacagggaggttggcgcctcgggccatgtcaccttcgatgcatcctgtctcatgtgccctctgtgttccccgtgggtcctgtgtagtgaaatgaaatactaactttgccctcatgtatggtaggtttgtgtgcagtgtgcagtgacaaaagtgtcttccaaatttgaagacagtatgtagagaattcatgtgacatgtttgtaactagcagataaaacctaaaaacaaaggaaattttaaacatcgtttaaataaagcttgtcgctcacgggctgcatggggcccaggacggctttgaatgtggcccagtacaaatccgtaaactttcttaaaacatgatgagattttcttgtgattttttttttttttaagctcatcagctctcattagtgttcactgattctatgtgtggcccaagacaattcttcttccagtgtggcccagggaagctaaaagattggacccccaggtttagattaccgacatcataaattgttttttttttttaattatccaggtatcaactagaaggtatcctaagtttaaagaccctattttagaagaaatagacatagcaagttactattgccaggcactatgtgctttgtgtcatttgatttacacactaaccctattacataggtacagtattattaattacccattatataagtaaggaaactgaggtttgggcagattaagcaactggcccagaacatcacagctagtgttaaaatgttaaatatgtcagtatattttttaaaagaaaaatcttgctctggattgatcagcgatgcgcttttcctagatccataagccatacttgagaacatgattagcatataacgacgtttgtatataacacactgtgtggcaggcaccattttaggcctttttacatgtgtgaactcatgcaaccctcacaaccctatgtttgcaaatccccctttaaagatgggaaaccaagtcacagagaggtaacttaacttgccagagtcacatagctaataattggagttgcggagctacaacccaggcagcctggatctagtgtgttcacataaccatgggcttcagtttgtctcctacgtggaaagctgagccatgcctagtcgacctggggtcgggcatcactccgtatgacagtgaagggctcattttatccgaacgggaagcaggacagccaggctgcggggggaacggcgtccctctgctgatgcctgtggctgtgtttgtgcatttacacgtcacattagcggagatgaatgccacttggaatccaacccaccgcagcagattacctcatgcaagagagaaaacagccctgcctgtgctagcctggctctgcgttgggctgtatttactcacggggcctcagctggccagggccttggagcagctctggggcccccgacccgggcaggaatcccagctcaggactagacgcacagaggaggacggggtggggaagagcagttccctcccataccctcgtcccctcccagcaagtacagagggtcgtacagcaatcgtcccgccttacttagaggctctgatctgcacaaaactggccagagctgaattcagcgcaaataaagactcggcccgccgccacttcagaaaggttgctgaccgctggctggaagccggcctcggagagtccacagctgagaagcatttctgagctgtctttagttagccctgggggtttcttccaccctctggctgtttctgcactgaactagaaaagatatcaaagacactcattaaagaaccagacccagtgactacaagcttggaaaactctaagcgcaaataatccagtgtttaaaagcaaagtgtagaatctgttgctacattaagctgtcgctgcccacagttaattttctgctgctctgcagacgtcatctttgtaggcagttttacaccaagagtttattaagttcattaaatcatagtatagttttccacatttaaaaaaaagatgtttctaatataagcactgctcattatcagagagatatattgaaatttcttttaaaaagctaagtagtaagattttcttgagagtgaatcattgtcaggtgacttaacctttgtcatctcgtttttttctttttgtttttgaggtagggtcttactatgtcacccaggctggagtgcagtggcgcgatcatggctctctgcaactttgacctcccgggctcaagcgatcctcctacctcagcctcccaaatagctgggatgagaggcacacaccaccacggttatctcatatgttttattacttttttgtagagatggagtctcactatgttagccagactggtctcgaacttctgggctccagtgaacctcctgtctcagagtcccaaagtgctgagattgcaggtgtgagccgccacgcccagcctatcttgttcttaatttaaaaagaacagttaagtttttgtaaaaaaaaaaaaaaaaaaaaaaaagtttttcaacctgtaatacccatttcaagtctgtgcgctttattaaatgctcacagtgatgatgatgacgatgggggtggtgatggggattataagcaccactatttgaatctgtcacatggtttctgattgagttcccagcacaactctaccttagcagaatgattaaggttcccatctcagctcatcactcaccaaactctgagaccttagttaaattgcatgatctcagtttccttgaatgtaaaacgtgaataatagttaaggttgttgcaaagactgaagatagatgatagatgtgaataaaatgacgcacacaaagtgctaagcaggttacctaaggctgctgcgtgttttcccctttctgcatctatggaaacaggctggagaggtccaggaacctggcccctggtccctggcaagcaaggggtggaaccaggattgcaacctcaggattcatgaccccaaaaccttcgtgcccctgagcactctgtcttgcagcaagcatttgggaggttgatatctgtaggccagtgttagattccatgctggcagctgccctgccaggatccgccttcgcctcttgatcctttcagtaagcccttaagtcttttagccaatctgggtgcccttttttgagcttgatccaatctaaatacgaccctagtgcctgtgaaattcacaagtcagcttagtcatagagtacatggtgtccagagttttatgaggtaggattatactttccctgtcacatgaggtaattctgctggggtgaacctgaagtggcattcatcttcattaatgtgacttgtgttacaaacacacatccagcatgtaatttactgccttgtcgggggtctgtcatctctgccttcaggtttctcacatttatacaaaaccagaaaaaaacaccctctacccttcttttcttacacttataaaatgggttgtggaattgaggcagatatccttaacacccccacccacacgcctcccatcgccaacacataatgacacagaaatgcccaaggtgtctgctgggaaaattacgatccttctccatctctcctgtttttgtgtgtaggtctggcttcaacccttttttctaacgtgcttccaattttctgttttgggcagtgcttatgttctcactgccctctgagttttgttaaacttcagaaccttgcatttcattcttggtgaaacttcattatgtttacagttctaataggagagaaaccttataatctagtgtgatgaactcaaacattttaatattgtgctgtcttcacatttcaaggtttgtgggaatggggggtgcacgtattgcattattttaaaattattaatgacagatttagggggtaagtctagcaggcgcatcctgacattttgtgaagaatggcgttgcattctcatttcttaaagactcaataactcagcataaaagtgtttggaattagatcagtctttcctagaatcttagtatttatctttacatcttacatacacatcccatcctgctttattttctacctacgtgctttcatatcattctcccgtacgagattacaaactcctttacagcagaaattgtgacctattcatatttgcatctctctacttgactcactcagtaactgctgattgaattgaatcttgacatttctgggccttgctgtacctgctttgtaaggattaattctgtttggcttataaagattgtggttatatctaattcaaagttgcaaaactgtttaaattttctcaaagttagtagccaaagcgactaatttagaaatgcataatttatgtacatatgtgttgctgtaaatagatgtgactgtttacatgcatgtctatactttataaataggaggggaagtgaacagttcgagcatgtgaaagatgcaggcgatggacccagggagtgttctttcattgctctgaataaggagggaggaggaacagtgccggagccaggaaggacagcagcttgtttccttggattattttgtttacatttggttcacacctacagaaaagaggaccattccaggttcatcaacatacaggcaaaggcagtgcatgacattggatttctttctgctgaaataaacaagctatggttagccgaaaggggtgggagattattttgagctcgtactgaatgcaggttgcacaaagttaaatagaataatccacactgttttaaaactatatgcctatattatcctgtttgctgcaatacaagctacagtgttttctgctcatgatccatgttttgatagttgctcattgctttgtgttggttgccataagtgcagtttacttattagctcaccctctcgttcatttgtaaaaggtagaactctgatcttaatacgtttatgttaagagaagaccctttttctttgatattgtccaaatgagaagagaatttccttcttggagtggtgaacaggaaggcttggaagggcagatggctaacctcgtgctgcatgtctccctggtgcagaaagtagatatgattatggatagagctgttctgagacaagataacatgttatttgcaatgtgagcccagcaacggctccccaaaagtgggaggagggatggagttgggttgtaagaaaattgagggttcctgggaaagtattccaagaatacaaattttatacttagaagacttcttgtaagaaagtgagtctaagaaagcagtcaggttcattcctctgaaaaacatgaaatgtgttacaaaaagccttatgatatggagtctgtctgacccccaccccactgctcttgcgaatgcttccagagattggggctcactggcgccccccggtggtattcaagccttctcctattttattgtttgggtaagacccctgtggtggtgaacggggtgggggcggtgaaaggggcaaacttcagtgtccagggttggaaggtgtatgtggtttttttaggttttcttcaagcgcctttgtcattgtttttctcatttgttttaggccaaagaactgccaactctgaaagataatgatttcattaatgagggccaaaagatttatattgatgacaacaacaagaaggtcttcctggaaaaactaaaaaaggatgttgaggtaagaacagtcagtggagaggccagactcattgtataaatatcagccctgttgggttttaggagctttttaaaccatctatttaaatcttcaatcaaggcaaaaacctgcatactctaccttagggaagtcagacatgaaggtgtctcatgttacatgatctggtttaaagcaaacgcatgccagtttagcagccctctcatttaggcaccaaacacaagaaagcacctgctgtcatccgctgggaatccccggtcccaggcccctgtattctgtattgggatggcccatgaagactgacctgcccacaccagccagtttgggaggggccaggggagtactggactctgtgtcaaccagcagagcatctcaaaaacaaatattcagtcactattacagtcttggcacttttccctctaaagcacaagtcagtgctggttaacatagcctgggtcacttaatgctttcctatctccaccagtcaccacaaaccatgtcatgaggcccagtgaggcccccttacacattgtgggactagcacaggggcagcttgggatactaggtcataggggacagtggagagacatagaacagtgtccaaggggctttcgtccataatgatggagttttgcttttaaacactgttctaaacatttaaaatgtaccttttcctgtcatttagtttatgataaaggcattgcagcttttccattggatttgctcattatttaagtcttttataaatccaggaaaaaaggaaaaaaaggttattttctttcctttcttttttttttttttttttttttgagatggattctcactgtcttctaggctggagtgcagtggcgcgatctcggctcactgcaagctctgcctcccaggttcacgccattctcccgcctcagcctcctgagtagctgggactacaggcacccgccaccacgcctggctaattttttgtatttttattagagacggggtttcaccgtgttagccaggatgatcttgatctcctgacctcgtgatccacccgcctctgcctcccaaagtgctgggattacaggcgtcagccaccaagcccggccaaaaaaaggttattttcttggacttcgttgagttacaaaacaatgcagtgggaattagaatttaggcagctactaaactcagcttttcttagctgttgctttcattcatttgtgtacacttcatggcacaccagtacggatctgctacttagagagaggctttgtgggaagattgtctttttatgtcattaaaccaaaaaaaaaaaaagaaaaagaaaatgacgaaagccacagaatgagtgtcatacatttgtatttcccatgaaggcggaagcagtataatttatttttaatcttctaacagttctttttattacaagaaactcacactgaccaagttattagtagttaatatttttagatcataaattagtttaataaaattttttacattattttacctttatagtatacatacttggattatttatagtatacatacttggattagaacctatatattggttatttgtgaagggtgtaagtatctactttcttgttgccattgtttttagagacagtcttgctgtgttggctagagtggggtggcatgagcatagctcactgcagccttgaactcccagctcaggcagtcctcccgcctcagcctccatagtagctgggactacaggcatgcaccacggtgcctggctaatttttgaatttttttttttttgtagagactagggtcttgctttgttgcgcaggctggtcttgaactcctggcctcaagcaatcctcccacctcagcctcccaaagtgctgtgattacaggcatgagccactgtgcttagcctgtaagcatctacttcaaacaaacaaaacgatacaagtgtttgcttttctcttctaacattttcctccagtctttcattaaggaatgtttagttttcctcagttgtgagtggttactaataaaatgtattagttaagcatttcccccttgctttgggatctgtttgatccaactgataagtatccttagtaaacatactcttggatttttattgattaatcagcaaatccttgatactgagaagaatatggttttagcaattatggtaagtagcccttagggttatctgtgacctattaaaaaaatggtttttttctgttggcagtatatcactatgatatttagactccagaaataatgtaattcaagcagttcaaatttacagttgaattacagaaggatcctcttagctcttttgttgtctctaataataccattgattagaggactctatagtctaatcccatacatggctcaagcacttagctgtttcgttgaaatggaggcagggtgtaaaacatcctttcatttaaaaatattctcaatagctgataacagtgtctttagttttgaaatttatgcagaaccatcattaaatttttaagcaggtaattatggtgaagtagcttgacatctgatcttgataatgaggctagaatttaatcgagttttctgttttcatcagttccatgctttctaatttagctgactgacccattggagtttcattgcagttttttgttgttgttgctgtttttccttaatgcctcgagtaggagatctgagtgtattacagctcaagaaatctagattttaggaaaactaattttcatctgaggttctagttgctgtttttctgtaacagcagccctgttctattcctatgccatgctgggtattttcatccacatagctttgcacgtaacacaggtgagtctttttctgcacacaaacacacacacagatcggtgtatgaggagtgacaagcacttttgccttctgccctgtgttttgtcaattctgatcacggccctgaagaatcaaccctggtctctcctctcattgactcacatgatgcaaaactgttctccctctgtggcatccaggagtaccccctcacagggcatttcagttgtctgaggtttatagccccccatccatggagatgggtgagaggggatagggcggtgggagtagtgggatgggtggcagcatttatggagcacatcgagcccaagtccttcccatgcagtgtcacttgtcattctcaaaacagccccttgacagtggtcctgcccctaccctagtttgatgaatggggaagccgagcccagagaccctatgtaatttgctcaaaggcacaaagcttctaaattcagactggggcgtcaggccctcagagggcacagtccttaactactctgacataaacacaagttaaaaatacctgtgagagcacagtggaggctttgttttctgataattgcttcgaaggaggattataatttttaacaagtggtaagatataaccgttaaacagggctgactggcattttaattctacttcacagatatgttgggagatggtgatgtggtagaacacggtgtgttagtagagttaaataaatcagttgagaaccattgtgaaggatagtcttagactcgtaaagatctcaaggaagattgtagctcaaagatttgtcacagcaaggactcaattagtaaggaattagatgagaagggatattctgagggaaaaagaggcagatgtgaggtccagcaggtggtttctgagaagctggaaaggaagaaaagcaggggacctaaataaagactgaaaaatcttcacactttgaaatcttatgttcttaaaacttaaagaacaaatatatactgttttcctgcagtgagccggaagcagaccccgcagtgaagcccacgccccctttctgtcttctctttccatctgcgagcttccagcccacgaaaaatctcagatgtattgccacacttcattcactctacctcagaacagatttaaagtaaagtttgaggcctgttgtggtggctcatgcctgtaatcccagcactttgggaggctgaggcaggaggattgattaagcccaggagtttgagaacagcctgggcaacatagtgagaccccatctctacaaagttttaaaaattagccaaacgtggtggtgcatgcctgtggtcctagctactagggaagctgaagcaggaggatcccttgagtccaagagtttgaggcttcagtgagccatgatcacaccactgcactccagcctgggtgacagagccagaccctgtctcaaaaagaaatttaacgttttgaagatgagagcccgtgaattaacaggcttttccatatggttctttttcccccggtctacaaactgaaacctgtttaaattgaaatcttgatattaaaaaaagacttctaccataatcaaaacattgccagttacaaataacagcttccattattttgtgtgaggcaccatattttttctctcagtttcattatcttaattcttcgacacccctgtgaggtgagtggcattgtccaattttaaagtcagaatgactgaagatccaggaggcgaactcgtcaagcatggaactggcgagtgagaccaaatcagactctttgtttcttgaatgggtctccctggtcagcatgacctgtccttttaaccactgtgccatatttggtttttcccatttctacctcagtctcagagatttgaaatcatgaataataatcccagcagtttgggaggccaaggcaggaggatcacttgaggccaggtgtttgagaccagcctggacaacacagcaagatcctgtctccacacaaaataaaaaataattagctgggcatggtggtgcacctctgtaatccagctcctcgggagggtgaggcaggaggattgcttgagcccaggagttcaaggctacagtgatctgtgatcataccactgtactccagcctgggcaacagagcaagatcccatctcttaaacaaaaagaaaacatgtgcaatgcccattgtgactgcaattttctcagtcttcttgggtgcctcagaacagcttcttacctagagatgcattttgcatcatgctgatggtttttgggttgtgctaggagttgactgcacctttatttcttcctcactggaagacgacaataagcggtctgaccacaggcctgaggcccaggaaaattactctgggctgcccggtgtggcgaggaacccagatggggtgccaggggaggctgggccctggaggctcaccctggtgagtgcggctggccagtcccagttgtccccttccctctctgccctttggcaagttaatcacagacagccctgacttctgtaactaaaacatacttgaaggtcaaccagtagaccttcctgttaaggtaatcgtcttaaatggtcaccttgcgcttcctttgcagagctgttgcctcatgcagtctcagacaaaagttttctgttgttgctttgttgtttgtatttggctttggtagttacttcctgctggaagcaggttggggagaattagggagagttgggacggatagggaagaagtaacaagcatcccattcacttgtccaacaagtgccgaatactttcccgagccctctgcctgccgggattcgggaatgcagtgaaagccaaaaccttagagccccgtttggggctgccttgcttgggaaagagagaagtcgctcaaatactccaacaaaatgaatgtgcagcgaggccccgtgtcactggggaggagtgtgcggtgccctaaacacccagactctggggctgtgctgccctgtgcagtgccccgcagctgagacctgaaggcacaggaggaagtacctgcccccagagaagcccaggaagtgggcagagcagagctcaagtgggccccagaagtggatggggccaagctctccaggcctcctgggccatgtgagttttgtttgtgccctgtgagaaacgcggcactatggaaatgtgttaagcagaacaggatgggatcaggttcacattttgaaaacttctgccctttgcagaggactggaggggtggttgaggcaccactcagcctttaccacttcacagggaccttccaagcacccagagggagcaggtgtgggcagaaggggggccttttccctgtcacctctcaagccgagcagggcctggcctggctccagagaggctttcaggtgtagagagagaggccagggaagccgtagatctagggagcagagccaggcaccgtgctatgcttgggaggggcagcagaggtggccaaggagaccctgacccagtccttcagcagcccagaagccttgggacaacagggcaaggagaaagtgggcccaccataagcacccccacccccacatacccctcagcattggagaagacaactggtacttacatgcatatttttcaataggcttttgaactcaggccccagtcattctgacggaaacaggttcatgatnnnnnnnnnnnnnnnnnnnncccccacccccaccatacccctcaagcattggagaagacaactgggtacttacaatgcagtatttttcaaataggcttctgaaaccccaggcccacaggtcattctgacgggaaagcaggttccatgatcacagcagtgccatgtgtgctgctgctggccacctaaccctccggagacccacagcgcagagtcatgtgtggagggcctccgatgccagctgattttaactcgttaccttcctcctagggttgcgaagaaaaggagaggggaaagctgctttaaggcagcctccagaggtagctgatagagagcagagagtacaggctcagaacaggccctgaattcacccctccttggatttgaatccttgcactctcgtccagctgctgagcctggctgctgtctcacacggagagcctgccccctgccttggatcttgtcacctgtccctataccccggagtgcccagttctcttccacatccacaggcccatgtatagcggagctggtacccgagacccagctccctggctggcttcaccgtgcgggtggaggactcaagtgagccttccaccactgtagatttctccccgcagccgcccccacaaacatgatcccagccaggtgatctcggccaggtgcacctcacagcctggcagctgccgagattctaggggaggatgcgcagtctctgactgctggaaaggaatctggcagagagaggtgcaagtggaaagtcagttctcatgtttactgtaatgggggagtttggggaaagaccaggggggatgagcagtggcttcccctcttctctgggacccagaaagctgaacgcaggagccccatgctgtttccacgaggggtttgcctctatttttaaacaaacaggtttctcccactttgcttaaatatttgagtgtaagatttgtgtgatttctcttttttgagctcaaaacaattggggaagatatagctggccctgggggattcctgttgggaaggcagcgaagtgggagctctggccagtttgctgggctgagcggggtgctggctgatggagaattgcaggcaccaggaaccagctggagagtgggatagccctgtgcccaggggtcctctcctcgtctgtaaggaatcggggcttctcattcagtttcgagacagaactccttcccagcaggctgaggagaaatgactctgcggggcttagcaaattgatttcatttttagccagaacttcaagacctgtgattttatctgtttgccctttgcatgaggacatctgcttcctaaattctatcagcatagcccagaggctgctcagccactctgcattccccagcgaggtggcactgagtccttccagagccaggaccgtgaaccttcctggaccctgagcccaaggtcagagtggaacaggatcctgtgcagagccagccagccacggggtcagggagccagttgggtccagcccgcagatgggctgccactgtttgcactcagcacaaccatccacatcttatggcaacattggaacgttgtgctgaaggtctcaaataagaaaagggaaacaaagagaaatcgtgatctgaaaagtcaaagaactgggcagacaggagtagccaaacacacagagctgggtcttgcccccacattatgttctagccacggctggaggaggagagggaggacaggaatcctggatgtgtggtgcttcgtggaaagcacacatggaaagcaccttgttgacctggacaggactgcattactcaccagatgtggacacagtgcctttacttttacttatttacaacagcgtaacaatcgcctccacagagcatgctgaattccagggtgctttcctgaactaccaccagagactccgctggaagctacttgggagatgcctgggtttccccattagccagtcttaatcattgggaggaacttgctctctctcccagtctctctccgcatctcttactggtcatgctccttgctatctggtgaaatccagccaccctgtgatagatacacacctctccgcatccagtgtggcattccagggtaaacagcctgagctctgagccagcctgaagtgtgaggctacattttagatagagaaacagcccaggagtgtaagagcatcgtgaaggaggcacccggcgcctctgctgccccaccccacagccttccctctgggtgtcacccgagcttgtctcctttaaatgttggcttttatgtttaaggtgtggctgactcaccctgttgcctctgtccccagtttctggcccagctgaagctcatggactacagtctgctggtgggaattcatgatgtggagagagccgaacaggaggaagtggagtgtgaggagaacgatggggaggaggagggcgagagcgatggcacccacccggtgggaacccccccagatagccccgggaatacactgaacagctcaccacccctggctcccggggagttcgatccgaacatcgacgtctatggaattaagtgccatgaaagtaagtttgattagtgtggaccctttttgcatgtgaagtggtttgactttggccttgttatctaccagtaagcactaccccagttatgagggtgctgcccggcagcactcatcctccaaactccaaagaaatggatttggggacaagagtatgttaaagctaaccgtgatctcagtgctgaaacataaggcgatcggacctttgaattctgtgatgttgagggaatacagcaaaaccacgaactatactatacatgtacaacacacctgtacatatgcacatacacactggcatacaacgtacgtgcacacacaacacaacatgcatgtacatatgcacacatacatgttcacaaataacatcagaaatgctttaaaatattaatacgtttttgcctagttatcttttttatctaagtcaaaagcatcatgagtctaagctaggcacatgcatgtgatcctctgtgacccttagcttgtcctcttgtcattaccaacagccctctccctctcaggggtgtgaagggtgtgtgaagatgggccctgtgggtggggtgggaatctgatttgctgctgagtctggctctgctgtcctcccccatggaagggcctatggccctcttccctagagtcagataaatcttaatccaccgtatccaggtgattgggtgcaccagttatttgaatattacatcctaccttagcaacttatccgtgacaataccaaaatatttttgtgataggataaaaacagcttcttggtttttgaataataaaaactgtggctcatcagttgttttttaatctcaaatggcatatcagctgaggatctgagttctgttttgttctgttttgctcaccaaaatgttttcttcaacacagaaaattagatagtcaaatgtacttttcttactgttcatatttttggaaatggatagaaaacagacacgggccgggcgcagtggttcatgcctgtaatcccagcactttgggaggccgcggcaggcagatcacctgaggtcatgagtttgagaccagcctgacctacatggagaaaccccatctctactaaaaatatgaaattagctgggcatagtgatgcatgcctgtaatcccggctactcggcaggctgaggcaggagtcacttgaactcgggaggtggaggttgctgtgagccaagatcgcaccattgcactccagcctgggcaacaagaacaaaactctgtctcaaaaaaagaaaatagacattggagtggatgtatgcctttatccagttctgatactgtatccagtgagaattatgaacagttctaccatttgatgtaaaggattagtgtacataattagttctgttttatagggtatttttaaatagcatatttcttcacaccaaagcaatacacaattattaaagaaaatgcaaattaaaaaaaaaaaaagactccgttccaccgttggatctccactgttgataccctggtgtgatgatgtttttagttgttagggttgtttctttttaaattgcagggggactgggtcagagaggcaagctgtgtgtttagtcaggatccgcaggggtggtgtagagtttgtctctggactccttccatccgcgttccattgaatcccctccctccaggctcacttctccctccctccctccctcagcagcaatgctggcactggtgttgtcacatgtcccacagtcattgctctcctgtctctgcagactcgcctaggaaggaggtgtacttcatggcaattattgacatccttactcattatgatgcaaaaaagaaagctgcccatgctgcaaaaactgttaaacatggcgtgagtatctccattttgtttccttctctctttctctccctctctctctctctctccctctctctctctctctctctctctcctggctcctctgtgtgacctgtaactcagggatcactcctttctgccactgagctgctttctactgagccattcaaagccctttagtgacgcttgttccctgggggcaagtcatgttctgagcgtaagatacagaacccacaaacgcttactgctcactgctgctcttaccacagctccctgtggcttccagcgaagtcacttaaacatgaacatctcttctttttacacatggcggacactaacaggcatgcgcatcactaggatgttacacaaattcttttttgtttgaaaaatgttccagagataaaagtgcaaaagaagataatgaagtgttctaatatgaaatattcaaaactgaagcatgattgtctgcttaagacacttcccaagtatacaggattaatatttcttttctcacagtgagttgtattttttctactacagaaatctcttgagtgcaaaatcaaagttgcataatattactcaccgttaatgttgcttgatgggagttttcactgctctagccatatgttaagctattttatcccccatgagaagcctatgaaagagatagtagtgtacctgcttttgtcagttggagaaactgaggaaaatagcttcaggagtaacttgccagggcctcatagtagcaagtggcagagatgagattcctcccccggacccagccccctcctggctctgtgttcatgctcatccccttgccctgcctgcaaacacctcctgcctggctgaactttacagctcgccaagtttcaggcttgtattgcagggtgccatctttgttttgcagaggtcctgaaagccatagagcccaccccacacagatgaatgtattccctggtttggtggccctggaagaaaaggtgcttcccacagactgtgtagaactaatgaagattcaccagaaccaaaaactcacttgaaacctcttcttttctattttaaaatagaaatcagcctaacaaacacagtattctatttgccaaagaaatatttcagtcacattgtcgatagctatggtattcctgctgtgtgcagagcacagactgggacctcaccgcccccgagcacgtcagtaagcaagtgtgcctggtggcttccccccaacagaaatttttgagtactctttttaaacaaacatccgcaccaggtgcaccacccccattccgtcatttctgaggccagttcaggagggtgagggaggggtcttcagaagactccatggtcattctgatgctcacctctggttgaaaaccatggagtgtggcaaagagagaactggcgaggaatcctcgtttgacccttcccacttgtatgacctcaaggggacacttttggagctcctgttttttcacctcatacagaaatcctactgccttgctgatggggttttgccagagatacaagagttgtctggacaaatgctttgtaaatgtctgttcccatattatacatcctgtgaaattggagtgtatcctagccaatatggctccatgttcatctctcctatcctagccaatatggctccatgttcatctccccataagccacaagttcgcctccatagtgtgccacacggcataaaatcacaggtagtttgcaagaagaaaacattactgtcagcaaaggaacgctgtgttaagctgctgtgggggaccattctctctgcattcaagcctgggctcctccatgcagccgaggcctggaaatattacaagttccccggtgaacatgggtgtctaaaaacagcacatgctcacttagcaaaactccgtgcttgccctttgcagctcaggaaactggccagtgagtgactcccttgagtgtgctggcctgcaccctgcatctcatcatggaaaaatccctcaccgtgcttctgcagggggccaggcttgcttgctctctgcagggctcagaaaggggaacagtggcacccctgtgtgctgctgcagagggaagtcagctccttcccccgtgggcaagatggagccagcagtgttgtgcctcacctggttacggtgcagggaatgggctgggggcagctgtcccagaacctgtggctgctgctgttgcccctcatgtttgagcactgagctgggggcctctgtccagaaacgaaggggtcctgaagaaatcatgcggttttaagtcatcgtcattaaggtttccctttcgccaaatgttgatgtcattctcaaggtggctccagtctgccttcttgaaaagtataacataagtattgtttccgtgacttctgaacaattccactctttgatagtaacatcccaaacgtggcctgtttgatttttttgtgagttgcaacagccccggtgtgtgtggtagcatctggtgctcctgtcgccctttgtctcatttgcagacacagatttgtaagaaccttgcttattcaaccatgagcgccaagatattttgagtgatgtttttcagagcagagactgcatggatttgaaaattgcttgctgtatattcagttgccattggaaatagctgtagatattgagtaataatttggggaaatcataaacactatgtcaatatttccttttttaaaaactgcccaggctggcgcggagatctccaccgtgaacccagaacagtattcaaagcgctttttggactttattggccacatcttgacgtaacctcctgcgcagcctcggacagacatgaacattggatggacagaggtggcttcggtgtaggaaaaatgaaaaccaaactcagtgaagtactcatcttgcaggaagcaaacctccttgtttacatcttcaggccaagatgactgatttgggggctactcgctttacagctacctgattttcccagcatcgttctagctatttctgactttgtgtatatgtgtgtgtgtgtgtgttgggggggggtgagtgtgtgcgcgcgtgtgcattttaaaagtcataaattaattaaaacagatccacttcggtcagtatgtgtcccaacaaagaccctttgattccagctatggccgaatgaatgagtgagtgagtgagtgagtgaatgaacacacgtgtgggggaggggagaaggaagtgcatgatgtcaggcaccgtgttggcatcacacaacaaactgtggatcagttttttttttttttttttttttttttggagttgaaagatgtgagacagtattcagaataatgaagataataatgatgattattataataatgatgatgattccaaggaaaaaacctacagcgaatgttccatttctaccccgcacgcagacactctccctaacactgataacctgagcccccagcactggacggaagaatgctggcgtctccgtgtgtactggttcagggttctggccccagccttgtcaggaccccctggtgtccagagcccccacccctcccgcaacaagcagctgatgccccagtgattctctatacatttttcacctcggccaatatgtccaggaaaactgcttacttctcttttcttgcctggagccttcattgttcacccttacgttgcaatataggaattaatgctacaaaataaaagtaaagcttacctgaaaagtgcatagtttggggcaatggtatctacatctcccactgtgggaaaaccagcaaagcatcaaaactctcaattctcctgttaccaaatgcagatctgaattataagatgtttatgtttgaccattgtttcaacaatgggattttgttacgaattatccctttaactgaaaccctcagttttactgtttacattattaggaaaacagggatatcttttgaatctaaaaatttgatgtacagcatgtgatttttgaagtttacatgtaaagtcacagtataggtgaaataacgtttgtcatattttgagacgtatcctgcagccatgtttttacgtgagtgttttagtcaaagtacatggtagacagtctttcacaataaaaggaaaaggattttttttcctccaaatgtacatttatcaacctaatgattgatttttttaaaaagagatttcgccccagtctggtttatgaaagttcattgccctaaactgtgctgattgtttttaatcaagttataaatttccaacctagatcatgtatctaccaactctcctgcattttccaaaaggcattgagcttaaatattagtcttgcttagagtaggttatccacttacatgctgcgctaaagccatgcctttgaaactccttgtttaaaacatgatatgatttttgtgggcagtttcagaaaagaaaacaaacaaacaaaaatcgaccctttaattattacttgcaactcaacagatctccctgccgtactgccttttccaggaactttacttcagggctgtccagattgcagttgtgccccgtgtatgtggatctagttcacagagtctttggaagccagcagtcgtgccctccgtatactgtccactcattttatgtagatttggtatcctcagcagccagtgttaacaccactgtcacgtagtgtacagattcatcttttatgtatttaaagtaatccatactatgatttggtttttccctgcaccattaattctggcatcagatcagtttttgtgttgtgaagttctactgtggtttgacccaagaccacaaccatgagaccctgaagtaaagataaggtacacatacattatttgagtaactgtttccttgggggccaatctgtgtatgcttttagaagtttacagaatgcttttatttttgtctataacaaacagtctgtcatttatttctgttgataaaccatttggacagagtgaggacgtttgccctgttatctcctagtgctaacaatacactccagtcatgagccgggctttacaaataaagcacttttgatgactcacaagatgaatccttttttcctctgtcccaattgtgtgtctctgttccaaacacattttaaatactcggtcctgacagtgtctttagctaatccttgaagaaataaaagtggaattgaatctttttagtttctagagccttgccttcagtttgggaattattttatcagtaataacaaacttccacaacacaattgactttgccgcaagatgaacaagtagaggaaaagaatctcttccatgaacatcctataaagtcatatgttttgtttttagctttgatacaccttaattctatgtgtatcaccattttttgaaacttccttgggataccattgatggatagcagacttaacggcattccacttggtgccaggttaacacagacagcttgtctatagcacttgctctgataactcatttttcttctaatgcaactgatgtattatagcaggggtccccaaaccccgggccacggaccggtactagtccatggcctgttaggaacctggctgcacagcaggaggtgagcagctggccagcattaccgcctatgccccgcctctttcagatcagcagcagcattagattctcataggagcgcgaaccctattgtgaactgcacatgggaggaatctaggttgagcactctttatgtgaatctaactaatgtctgatgatctgaggtggaacagtttcttcctaaaaccatctcctcagccccctgccagtccgtggaaaaactgtcttccacaaaaccagcccctggcaccaaaaagattggggaccaccatattagagaataatttgagcataatgcacttgtcacattgcttgtgtgccgtttggtctgcaaggaacattaggtgaatgcagagaactgcactcaactgagctgcatagggaaacacaacacaccgacacttcaaacatctccagcacctcacttcagtgcatgtgatttgttacactcgttcatatctggagttacacgtttccacctgacatcagatcacctttctcctctttacaataacccaagagctgccatccttctgatgcccacaaccacaggcgtgccttacatctttttcaaggtaacttgccctgtttttatattttgaatatttcctaaccagttagcgtttttataattgtgctactgtttttattagatttctttttcttttcagtgtgtgactcattacattttgggatgttgtggccctagtttcatttttcccagaagttctgtgatttccattgtgcagctttgcctaaagcagtgatttctaggaacatacatgttgcattattgtagaattgactgtggtcagcagggagctttaattcaatgttctttgtggactgtttgaatgtggacattcattttcccttcattttggttaagttcctggattagaatccacaatagttccagaaggttatttctaattcatggaagggcaaaagttggtatgaagcattaatcctgagcacaacacttttcaaaacagtggttaagagttaagtgcaagagattacaaactatatgttgtgaaatggtgatgtatatagtgtgcaaatgtacacaggccgagaggctgaacaaagactcaggaccgctgcacacaacctttcttggaatttttaaatagcacaaaatcagtgattggagtgactgttgtacacgtgcatctttcttcgagctctgaaaataactggcccccattccttcctataatatagatatattaaaagcataaaaattaatatagattgctatattaaaaacatagaagtcattcttcctaaagggcagaaactctgccatgtcttttgaattcctatgctaggctgggcacactg

SEQ ID NO: 13615 - DNA, 33478 bp, Human
  misc_feature (1)...(33478): n = A,T,C or G
tttagtagagacagggtttcactatcttggccaggctggtcttgaactcctgacctcatgatccacccgcctaggcctcccaaagtggtgggattacaggcgtgagccactgcacccagccgaaatttatttttttttcttttgagacagagtcttgctctgacgccaggctggagtgcagtggcatgatttcagctcactgcaacctctgcctcccaggttcaagcaattctcctgcctcagcctcccgagtagctgggactacaggcatgcgccaccatgcccagctaattttttttatatttttagtagagacagggtttcaccatgttgtccaggatggtctcgatctcttgacctcatgatccgcctgcctcggcctcccaacgtgttgggattacaggcgtgagccactgcgcctggcccaaaattaatttttataatgtatttttcttaacccagtatactcaaaatattatcagttcaacatacaatcaatatagaaacaaattattcaggtattttacatgatttttttcacactaagtctttgaaatatggtgtgtatgttaaacttgtgacagtttggactggtcacatttggagtgctcaatgtgcacctgtagctggtggctactgtcttagccactgtaggcctaaagtttccctcaaaagtgagaccaaactcaacaggtctccctatctcaggccttgccctccttggcccattctgaaactccactggctactagttatccttccaaaaaacaactcaaatcatgtcatccccctgcttaaaagatctctgatatctcctgcccttctaagacaaagtccaagcactttggcataatttgaaaaactcaacgacctgaccccaatttcctttttaaaaaattattatatatttttttagagatagggtctctgtcacaaagggtggagtgcagtggtgtgatcacagctcactggagcctcaaacccctgggctcaagcatcctccagcctcagcttcctgagtagctgggattacaggtgcaccacccaatttcccttttaaactgccctcccctcttcaccctcttccccacaatatgtgcccataatgctaagaacttctcaaacccaacaagcttttccatcctcggtccttcttgcatttttctctctccccttgaacatccatccatccatccatccatccatccatccatccatccaaggagtacctactaaacctcaggtggacgttggactcaattcaggggctatcgggaaacctcttcgacactcttactcctctccaacgcccttccccaccacccacctccgcgcccccagctctaaatttagctcccaggacgccgctggttggttcactcctcctcccacaccctctctaaaggccgggaacggaattgttagcccctccacccccacccccatcaaggtcaagaaattgaagcggggcggggggcggtgagcataactactcaatccccattttctcatctgaggaactaaggcacgaaacagggagtgccgaagggtacaccaggcctgatgtcctaatgcagaaaccgggccttcctgcagtgggccgggtcagctcggatctccgcgcggtcctgagtcgccgcccccaacccagccaaggattaatttaggcgagctatcccgcccgccatccccatatccgtccctgccagcgtggcggggagggaccccggacggaggggcagtcgctgcggggcggcgccagcgcccgtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcgggacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaggcgcgggcttggcgacgccgcttgccggctcctgggcgggcgggaggatcgggaatcgcggattggaccgggtgtccaggctcaagggcgccgtgattggaaagaacggaaaaggggcatcggagagacagcgagggtcatggaagtggccgcccgcttcccctctgagtgcgtcttccagacccgagttacaaactgccccgtttgtttcctctttctgttaggtgtcagacagctgacacctaacaaacacgcacgcctccaggacagccacatgccgagctgtgctgccccttgtgggtgttgggggcgctcccgaagcgggagagggcggagttagggtggcccacgatccaggagaggcctggcctggtgtttttatgggatgggtattatctgttgggataaacgattcctgcagggccctttttccttcccgaagcacgccgagttttgtgttggactcgcgcgctctgactgaggttcggatctgggggtgcttgcctgctccagcagcgcctcccgggcacctgtggcacgttccccatttacgcgagtgggatctccgcgggggggaccctggcgccacggccagggctgtgcagaaaaacacgttcttctgtccggggagaggaggaggcaccgtgtgacctccctgggagaggatgaggaagaggaagctgagctggcacgggtgggggggccagcctcgggctgccctcaggaacctggcattccctcccagccccggagccccagcgcacagacgctgatgaaacctacgcgcctgtttgcatgatgaaataaatcctcgtggctctctcctcccctctcattgtcgcactgcccccacccctttttgctcctctcccttcattctcctccacgctgctttccatactactagaaaacgcgacagatcctggcgcttggctaggtggcgggcgggggccacatgcttattttctcaggcagctgtcccaccagcagcgagcgcggccagatccgaggtcctctgctgtttgatccaaaacatacactgttagaacggttagggatcttgtccagccctgccgtcttattctacagagcccggcattgaggccccagagcttgaacacgtgtctgttgcccattgtcacaccgttttcccagattggacaagaaatagcaaccaggcagagaagggagaaatgcttccttttctattagaaatgagccaaggaaaagctcgcaggggctcttgttgccattcccgactcatcctctttcccttgctgggtcttttgtagtccatgctgttctcctttgtctctgtcacaatggtctaccaggacaattcctgacaattttggagttctttcaaatgagggtgtaagtgtctgctggatttgttcagggtgggccctgaggccggcctgaaggcgcaggtagcccttttttgcactctttattgctggattgttgggtcaaattggaagccaggatactgtttataggcacttctggcccgggtaccaaggttcacacctgtaatgccagcattttggggagccaaggcaggagaattgctttgaggccaggagttcaagaccagcctgggcaacatagtgagactccatctctacaaagaaacaaacaaaacaacaacaaaatgttgtcctagctactacagaggctgaggccagaggatcgcttgagcccaggagttggaggctgtagtgagctatgattgaccactgcactccagcctgggtgacagagcgagaccctatctctaaaataaataataaatataaaatataggaacttcaaatccacttttcactttgggttgggaagtggggagtgggcagggggctgacagaccacagcaaatccccttccctttgaaggtctttagcagtagggggagtggggaagggacttctgcatcagggcatagcatatgtttctgagatcactggaagaagctagcagtgccaggagcctaaagccagctcactgtttggtcgtccagtggagcaggtacagctcacagtccctaagccagggaaacctggctgacttccactaaagtcaagcaagcctggtcggcctcgattagccaaggtgtggactcttcctccaaagcccacctcagcccacctctgccagggcagagaagccaaaatggtcacattgcagccaaaatggtcacacccttttgctccagagcagaatactgcctctcagtcttccaggtgcttgaggataactgggggcttcatttaagtgcatattctgattctgtaggtgggggtgggaactagattcagcatttctttcttttctttctttcttttttttttttttttttttgagacagggtctcactctatcacccaggctggagtgcagtggcgcaatctcagctcacagcaacctccacctcctgggttcaagcaatcctcccaccccagcctccccaataactgggacaacaggcatgcaccacccatgcccagctgatttttgtattttttggtagagacgggggtttcaccatgttgaccaggctggtctcaaactcctggcctcaagtgatctgcctgcctcggccttccagaatgctgggattacaggcgtgagtcaccatgcccggcctagattcagcatttctaactagctctgactgattggtgcacataccacactctgagtactcaggaattagtgaaacataacttccctcacctttcagatctctggagtctagcaaaaaaaaaaaaaagatggctccatccaggtaaactttgatctctaaatcgtggtgtggagagccaggcttttgatagagtgtctgcatggctgtctgcacctgcttacttatagggactgtcagcttctcaggaaaaaccattggagtaagtaccccccagtcactcctgctgggaatggccctcaagtgattgtccctggagggaaagaagcagcagttgggttgcactatctccattcctatgactccagtttgctttccttttttttttttttttttttttgagatggagtttcgctttgtcgcccaagctggagtgcaatggtgagatcttggctcactgcaagctccgcctcccgggttcacgccattctcttgcctcagcctcccaagtagctgggactacaggcgcccgcgatcaagcccggctgattttttgtgtttttagtagagacagggtttcaccgtgttagccaggatggtctcgatctcctgacctcgtgatccgcctgcattggcctcccaaagtactgggattacaggcgtgagccactgcacccggccctttttttgtttttttcctgagacagggtctcatggtgtcacccaggctggagtacagtggcacaaacatagctcactgcagtctcaaactcctgggctcaagtgatcctcctgcctcagccttgcaagtagctgggactataggcacgtgccaccatgccctgctaatttttttatttttttatagaggcagggtctctatgtattacccaggctggcctcaaactcctgggctcaagcagtcctcccacctcagcctcccaaactgctgggattgtaggcatgagtcacctcacctggcctccagtttgctttccatggtcattaaccatttgcacactgaggctctgctctgaggttagctgtccagagtacttaagataatttaattgccgaagggagtgtcatgtatgaatatttgagtctgtggagtcttaaaaatatccagcgacaccataaacagctcattagccagcagaacctttgagtgggtcagaaagaaactttccctcatcaatctccacattcccagctccgtgttgcatgtttgactctgaagcctatatacaggcttggatggcagttgtgccaaagacccgtacctggataaggtgaatccgaggtgagcaggtagggctgcaggtgttaatggcaccctgtttggttaagcaaacaaggtctgtgcccaggaagcttaccttggagcagctcccaagtctttggacatgaaacaggcagtgctgggaagaaggggatgtaggctgggcaccaaagccagagcacagcccatgtcctgaggccttagtcacatggagggaagaaattattaaggatgggttaaaagagcttggacattaatgcagtgagggagaaacgatggaccctcttctcacatttacctgagcttccttttaaagtgtttgaaggagctgggtgcggtggctcactcctgtaatcccagctattaggaaggctgagacaggaaaattacttgaggccaggagttcaagaccagcctgagcaacatagtgagactctgtcggtataaattaaataaataaaattttttaaagtgttggaagcattccacactgtgtcccttattaaagatttggtggggggttcctggtgtagagcactccaaaatccctccaatccccagactcctttttattattattattattttgagacagagtttcgctcttgttgcccaggctggagtgcagtggtgcaatcttggcacactgcaacctacgcctcctgggttcaagtgattctcctgcctcagcctcccaagtagctgggattacaggcatgtgccaccacacccggctaatttttgtatttttattagagacagggtttcaccatgttagtcaggctggtctcaaactcctgacctcaggtgatccacccgcctcagcttcccaaagtgctgggattacaggcatgagccaccacacccggccttattattttattttattttattttatttttgaggcagtctaactctgtcgcccaggctagagtgcagtggcatgatttcagctcactgcagcctccacctgccaggttcaggctgagacaggagaatcccgggtagctgggatgacaggcacgcaccaccatgcccagctaattatttatttatttatttatttattattattttcctcaagatggagccttgctctgtcgcccaggctggagtgcaatggtgcgatctcggctcactgcaacctccacctcctgggttcaagcaattctcctgcctcagcctcccgaatagctgggtttacaggcgcgctaccacgcctggctaattttttgtatttttagtagagatgggtttcaccacgttggccaggctggtctcgaactcctgacctcgtgatccgcccgcctcagcctcccaaagtgctgacattacagccatgagtcaccgcacccggcctattttattttatttttgaggcagagtctcattctgtcacccaggctggagtgcagtggcaccgtctcagctcactgcagcatccgcctcctgagttcaagcaattctcctgcctcggcctcccgagtagctgggaccacaaacccggctatttatttttgtagagacagggtcatgctttgcttctgagtctgaccctctagttttttattatttgaaaggagaggccaggtgcgatggctcacacctgtaatcccagcactttgggaggctaagcagatcacctgaggtcaggagttcaagaccagcttggccaacatggtgaaaccccatctctaataaaaatacaaaaaaaaattagccgggcctggtggcaggcgcctgtaatcccagctacacaggaggctgaggcacgagactcactcgaacgattctgggtgacaagagtgaaactccgtctcaaagaaaaaagagagagagtttgatttttttgcttcctaaaagaccaaaaaagtccttcattgccaaatctgaggaaaaagggtcagcagagcaataccatatttatccattgacataaagtagcgaggcattttctcatatagacctttattttcatgttctggaagatgagttaggaaggcacagcaatattgtttcttcttttttttttaatttgaaacagggtctcactttgtcacccaggctggagtgcagttgcagcctcaacctcctgggctcaagcaatcctcccatctcagcctcccaagtagctgggactacaggcatgcaccaccacaaccggctaatttttgtattttttggtagagatgaggtttcgccatgttgcccaggctggcctcaaactcctgagctcaagtaatccacccgccttgacctcccaaagttctgggattagaggcatgctccactgtgcttggcctgggaaggcacagcaatattgaaaaaaaggaacattgctttctaaggtgagttttaaaaaaaaaaaatgttcagttgtgcacatagattcttgcctgtgccaacaaacccatgaaaaacctgtttctttctggtctgacttagacccatgcctggggtctctctccattatgattcatagcgaatgaatcacacgtttttgtttacgtgtttgttccctaggttagccaggaaattttttctgagcagtcttactcatctttgtatccacatgacctaatgccaggtctagtgtctggaaggtgaagagttgaaaagaatgctggaatgaaagcgttcccctcaggataacctagttttcttattttatttatttatttatttttgagactgagtcttgctctgtcgcccaggctggagtgcagtggcacgatctcagctcactgcaacctccacctccctggttcaagtgactctcctgcctcgcctcctgagtagctgggattacaggcacgcaccaccacacccagctaatttttgtatttttagtagagacggggtttaccatgttggccaggatggtctcaatctcctgaccttgtgatccacccgcctcgacctcccaaaatgctgggattacaggcgtgagctaccatgcctggtcaggataacctagttttcttactgtcaggcctgagtctccgctggcttaatgatgacgtttaaatttccttttctgtcctttcagttgcagggtataagtgtttatctcagaatgtcccaggggcagaaactaactttctctgttttgatgatgttgtctgttttttgtttgtttgttttttgagacaaagtcttactctgttgcaggttggagtacagtggcacgatcatgcctcactgcagtctcaaccccctgagctcaggtgatccttttgcctcagcctctccagtagctgggactacaggcacacaccaccacgcctagctaatctttaaatttttagtagtgacagagttttgtcatgttgcccaggcagttctgggcttcataggatccaccaacccttccaggcgcccttcccaaaaaggttgggattacaggcgtgagccactggaccagccagagaataaccttctctgaaccctcctacttatcctcatacagatagtccccgattatgatggtgtgactacaatttttgactttacgatggtatgaaagtgatatgtgttcagtaggaattgtacttttaaaaattgttttaagacagattcttggccggacacgggtgctcatgcctgtaatcccagcactttgggaggctgaggtgggtggatcacgaggtcaagagatagagaccatcctggctaacatggtgaaaccccgtctctactaaaagtacaaaaaattagccaggtgtggtggcacacacctgtactcccagctactcaggaggctgaggcagaagaatcgcttgaacccgggagacagaggttgcagtgagccgagatcacgccactgcactccagcctgggagacagagcaagactccatctcaaaaaaaaaaaaaaaaggcagagtcttgttctattacctacattagagtgcattggcatgatatcggctcactgcaacctccgcctctcaggctcaagcaatcctcccacctcagtctctcaagtagctgggattacaggtgtgcgccaccacgcccagcctagaaattgtacattgaattgtgaattttgatctgtttctgggccagcgatacgaggtacatgctctcgagatgctcagcagggacagtgagctgcagctcccatttagccccacaaacatgaggacaaatggccagtcacaagcttgtccaacccgagaccctcaggccacatgcactctggacagctttgaatgaggcccaatacaagtccgtaaacttccttaaaacattatgaaatttctttcttttttttttttttttaagctcagctggagtgcaatggcacaatctcggctcactgcaacctctgcctcccaggttcaagtgattctcctgcctcagcctcctgagtagctgggattacaggcacgcgcaaccacacccagctaattttgtatttttagtagaaatggtgtttctctatattggtcaggctggtctcgaactcccaagctcaggtgatccgcccacctcgtcctcccaaagtgttgggattacaggcgtgagccaccgcacccagccagtgttagtgtattttatgtgtagtccaagacaattcttcttccagtgtggcccagggaagccagaagattggacagcccactatagagtctatagtgtgctgtgttgccaggtggttttgtccaactgtaggctaatgtaagtgttctgagcacatttaaagtagggaaggctaagctataatgttcagtaggttaggtgtactaaatacttttttttttttttttttttgagttggagtgttgctctgtcgcccaggctggagtgcagtggtgcaatctctgctcactacagcctctgcctcccaggttcaagccattctcctgcctcagcctcttgagtagctgggattataggcgtgtgccaccacacccagctaatttgtatttttagtagagatggggtttcaccatgttggccaggctggtctcaaactcctgacctcaagtgatctgcccgcctcagcctcccaaagtgctggaattacaggcgtgagccactgcacctggccctaaatgcatttttgacttaagatattttctatgtatggtggatttattgggacatacttcattttaagtcaaggaacatttgtattaaacagtattgctggtatttcttgtcccaatattaccgaacagggagtggatgtgactttttttcttttttttaaaaagcaaaaacaaaaaacttttaacagatagggcctcacctctgtggcccaggctggagtgtctatgggctgaagtacagtggcgcgatcaccactcactgtaactttgagctcctgggctcaagcaatcttcctgcctcagcttcccgagtagctgggaccacaggcacatgctaccacacctggctaatttttattttttgtagagatgaggtctatgttgcccaggctggtcttgaactcctggcctcaggcaatcctcctgcctcaacctcccaaagcattgggattacagatgtgagccactgcatctggcaactttttcttacactgaacaagccagtattggggccggggtctcagacactgtgactgatgctgtttatttacctgtttgcatccagcattgctgacaaggcaagagtaagtaactgctgctcactgacatttgggtatgcacagcaaagggcttcatgtaatctgatggttatgcccatgaaagctcattaagagagctcagatactaggcccagaggatcagggcttcttaggtgtgcagggacacttggtgaaaatggttgtatcagttagctattgctatataacaagccatccccaaacagtaactaaacagcagcgatttgttattgttctccatcttttgggttcgttgggttctttgtagatcttgctgagcttactcatatggctgcatacagtgtacagctggactgtcctggggtggaagctccaagatggtcttacccatacatctggggcattgctggggacagctggaagcctgggagttccctctatcctcttggtctcccaacattctgatcactcagtagtctagcttgagttttatttacatggtagtttccaaggccacttaaggcctaggctcagaagtcccataacatcacttaccaagtattctgtcggtcaaagcaagtcacagggccagcccagattcagggagaggggaaatacatgcctgttgttgttgttgttgttgttgttgttgttttgagatggagtctctctctgttgcctgagtagctgggattacaagcgtgcaccaccatgcccagctaatttttgtatttttagtagagacagggttttaccatgttgcccatgctggtcttgaactcctgagctcaagtgatccgcccgcctcggcctcccaaagtgctgggattacaggcgtgagccatcgcgcctggccttttttgtttgcttgtttgtttgacagaatctggctctgtcgcccaggccagagtgcagtggcacgatctcagctcactgcaacctccgcctcccaggttcaagtgattcttttgcctcagcctcccaagtagctgggattacaggcacctgccaccacgcccggctaatttttgtatttttagtagaggcgggggtctcaccatgttggccaggctggtctcgaacttctaacctcaggcgatctgcctgccttggcctcccaaatcactgggattacaggcatgatccaccacacctggcaggaaatatatgccttttaatgagagaagctacatgtgcaaacaggaatgggaggagtggtaggagccacattttcgaataatcctccacaagggccagacctcaaagaatgggtcttagagggaacgtgctgcctgtcctgatgtgtggccagcagagccaggaccaggtgcagaagccgactggaatcacaaccctgtgaatcagggttaaagaacaaaggacaccttcctaaaggtactgactcatagatcccataccctgttctcacggccttatgttcacttccacaaagcaaaccacacaaggtcgggtgcagtagctcatgcctgtaatcccagcactgtgggaagccaaggcaggtggattgcttgaggccaggagttggagaccagcttgggcaacatagtgagaccctgtctttacaaaaaaattttaaaactagccaggtgtagcagcatgcacctctagtcctagttacttgggaagctgaggcaggaggatctctggagcccaggaatttgaggttacggtgagctatgatcacgccactgcacttcagcctgtgtaatagagtgagaccctgtctcagaagaaaaaaaaaaagcaaaccacacaggtggccatgatgctggaccgctaagcaatctattcctctttgtgttgagccttcattgcaggccatcacccaaaccatctcctcttccccctccaagtgtcctgcaggccaggctttgggaacactcttcagaggagcccacacctgccctgccctacccagcgctaccatgtgaatatccttaattttctgtagtacttgcaataggatggactcatgtgtctgtgcccagcagtacaaaaccaggcaggaatgagaatagcagagggtacagtcgggctcagtactccctttggtttggaagtggacagtgtggaggtctcttgccttaaggagcatgtgtgtgagtgtgtggtgtaaacagatttctctcttctgcccttctgaacacaagggtagagtgggcctgccttagtttactatggctgccataacaaaataccacagattgggtgctttaaacaaaatgaattatctcctagttctggaggctggaagtccaagatcaaagtgccagcagggctgggttctgaggcccttctccttggcttgcagatggccaccttctccctgtatctgcacatgggccttcctctgtctgcatccaaatctcttctcataaggaccccagtcagactggattagggccccaccctaacagcctcattttaatttaatcatccccttgaagactttatctccaaatacagttgcattccgaggtactggggttgggcttcaacataagagttttgggggcaggccgagcatggtggctcatgcctgtaatcccagcactttgggaggtcaaggcgggcagatcgcttgaggtcaggagttcaagaccagcctggccaacatggcaaaactctgtctctactgaaaatacaaaaaattacccaggcgtggtggcaggtgcctataatctcagctaccaggaggaggctgaggcaggagaatctctggaaccggggaggcggaggctgcagtgagttaagatcatgccactgaactctagtctgggtgacagagtgagaccccatctcacacacacgaaaaaaagtttttgggagagatgctattcaactattcagctcataacagggccattcccctttccaactgggacagcaatcactactgtttgtaatgggaggcatttcagaaggtcattccctattggtaatgaatttcagggacagcttcacccatagggtgcatttgaagtgtttgggaggaggttaaggaaggggaggagcttggccagcaatcagaataattagctcagctattttgttctgaaagtctctgtcaaagccaattttcttttcttttcttttctttttctttttttttttttttgagatggagtcttgctctgttgcccaggctggagtgcagtggtgcgatcttggctcactgcaacctctgcctcctggattcaagcgattctcctgcctcagcctcctgagtagctgggaccacccggctagtttttgtatttttagtagagacagagtttcaacacgttggcatgctggtctcaaactcctgacctcaggcgatccacctgcctcggcctcccaaagtgctgggataacaggtgtgagctatcacacctggcctgaagccaattttcaaagaaactgacctattccctcccatgccagggcctcagagggagaggctgccgatcgtccccatctggtatccagcagcttcataagacccctggcccctgagaaatgttgggatcttggttctctttgtggaggtcagcggttgcggggcagaggtaaagaaaagtcttggactgagtgtgctctgcatctctcaccaggatttccaccccggcagttctgtcctgcttgttaaatagaccatccagccagaaaagccacccagacacatgtgattcctccctggactgtgtggcgaggagggagggaagaccgagattctggcatgtcggcgtatttacctccaggttaacagggagctgcctcagagctggagttcagattgtccagggtgttttgctcactggctgttggcttggatctgagcagaagcatttggacctcccccaccccggccctgttgtgaaatgctctccctctccctggaatgggaacagcagttctaggaattccatcctcgtactctcactaagcctcacgtccccacatccaatggaagaatgcttctgccaaaggaaccccaggggaaagtgagggccatgcgcggctcagtttacagaagtcctatccagccgcagagtatgggcactggagggctatggggaagcgctcaaggcagggaacatcctgttctgacaagcacccagaagtctaagacctcctaatttttccagctgagagtgttagctaaggggtggtagcctggtctgccttactaattttattttattttgtagagacagggtctcactctatcacccaggctagagtacagtagcatgatcccagctcactgcagcctcaaactcctgggctaaagcgatcctcctgcctcagcctctggagtagctgggatcataggcgcacgccatcatgccaggctactttttaaattttttgtagagatgggggtctcactgtgttgcccaggctggtctcaaactcctggcctcaagcaattctcatgccttggcctcccaaagcattgtgattgcaggcatgatccagccttgctaattttaaacagtaggaggcatttaggattggagtcgaggtgggttaggttggcctctggacggctgtgaggggacagcctttctgggcctcagtttcctcttctgcaaggtgaagctcctgcgtggggagttgtaagggggaataagacctagcacgtcaggctgtgagcacagaccggaggggatgacagatggcaatgattgctgtatgcacctcgcccgaaaatctaagccttcattcatgcagcactccaatgctccttggcctccaaaaatgcttcctgttcccggcttgtgacatctttctttggttgcgtatgttctcccaagtgattttctctttaacagcaattatgtgagtgtcactttattctcacacaaagaatcttgatgttctttattttatttaatcttcacgatactcctctgaggtgtggattttgttattccctccctcttataactgaggaatgaaagtgcaacttggagttcagggactgacatgtggcaagctcaggtttgagcccagaacatctgcctccaagcactatgctatttgtacattaagtacctgccaacaaggagatcctaaaaataaatggcacgtgcctggtgctttcaaaatagtttgaatgagcctagtacaatgccgttgttttacaggtgaggaaactagaacctaagggaatgtctctatggctttatttattgtaatcccagaactttgggaggccgaggtggggggattgcttgagcccacaagttcaagaccagtcaaggcaacatgacaaaaccttgtctacaaaaaaaaaaaaaaaattagctgggcatggtggtgcatgcctgtagtcccagctacttgggaggctgaggcaagaggctcacttgagcccaggaggcagaagttgcagtaagccaagatcacactattgttctccagcctgggcagcagaccgagactctatctcaaaaaataataataatgataattaattaatagaaatatttccttactttttttagagacagatcttgttctgtctcccagactaccgtgcagtggtaaaattgtagttccctacaaccttgaattctgggttcaagccatcctcctgcctcagcctcctaagtagctgggactgcagacatgcaccacaacacctgactaattttttttttgtttgtttgagacagagtcttgctctgtcacccaagctggagtgcaatggtgcgattttggctcactgcaacctctgcctgggttcaagcaatcctcctgcctcagcctcccaagtagctgggattacaggcgtctgccaccacgcccagctaatttttgtatgtttaatagagacagggtttcaccatgttggtcaggctggtctcaaactcctgacctcaagtgatccacctgccttggcctcccagtgtgctgggattacaggcgtgagcttccccacccggcctacacctggctaatttttaacttcttttgtagagatgggatcgtgctttgttacccatgctggtcttgaacccccccattgctttatatattgaaagcaaactactgtcaccacaaagcatgccttgaaaaaaaaatatcattcctatatttggtgcacatttggagtttaaaatcctgaaggatactggctaacaaacatgctgaagtttatgatggttcttggtttccgtgggcctaaaaaggagggaggacaccctcaccctgtcccttccaagtgtctctcctgagttgcttacctgtcctctgatttatccctgctttgactgataattggttgctggtatggatggaactgaataaatggtgaaattatgtcacctggaccctgcaggtcatgataataactagaattgtatggggcttacattgtgtcagccactgttcaaatccacacagtaatcctatgaagttggcactaccatcatcatcatcatcattgtcgtcgccaatctggagaagcagaaactgaggcacaaagattttaagtcataacttgcccagagtcatgagagctagcaaatggaatgacagagctgggtttccaaaggatttcaggtagaatgagcctcagttattgtccccagatagttcaagaccgaaccttgaactctacccccagcacacaacgggctggatcccagctacacaaatggtttgaggtgtaggggtgctcctctcttcttcccttgccctgctgggaggcagggttctgggtttccctgctctgcatctctgggttggcaatcaaggtcagccttagctcacctccctcacccctcgggcactggagaactggggtgagatggatgtttctctgggccgggggtttagggtcaggctgcttggaagcaggaagatggaggacttgggatctgtgtcccttggtgatctcctcttacgcctgtctgtggacttcacacacttggctgtaatcacttgtttacgggtctttctcgactaaattacataaggtttggatctaggcactttcactacatctgacttttttaaagtccctacgaccgtcgcatggtgctagtacaaagtagaggttcagtgagtaagtaaatgagaccagcacacctactttcaggaaaaaaggattgagcaaagaccggcaaatatgtgggtaaggattaacatttttgtccctggattgcagtagtctctatacttgaatacagttcatgggagttaaggtgtagtgtagggttttgggttttgtttttgtttttttttttgagacagagtctcactctcttgcccagggtggaatgcagtgatgcgatctcaactcactgcaacatctgcctcccgggttcaagcagttttcctgcctcagcctcccaagtagctgggattacaggcacatgccaccgacgcccagctaatttttgtatttttagtaaagacagggttttgccatgttggccaggctggtctcgaactcctgacctcaggtgatccacccaccttggcctcccaaagcactgagattacaggcatgagccactgcgcccagcctgaatcacttttttgataaatgaggttttttttatttctgtattttctctcttcctctcccctcattgtcccaataaaattacatttcaaagttttaaaaatccagccaggtgcagtggcacacacctgtaatcccagctcctcaggaggctgaggcaggaggatcacttgagcccagaagtttgagtctagcctgggcaacatagcaagattctgtctttaaggaaaacaaaaaacaaaaacaggctgggtgcagtggatcacttgagcccaggagttccagcccaccctaggcaacatggtaaaaccctgtctctacaaaaaagtatatacaaaaattagctgggtgtggtgacacttgcctgtagtcccagctactcaggaagctgaggtgggaggatcacctgagcccaggaggtccaaggttgcagtgagccatgatggcaccactgcactccagcctgagtgacagagcaagaccctgtttcaaaaaaaaaaaaatttaaactaaaattaaaagtaaacatttgttgtttttattatgatgattcttgagccaagtactatctataataatagcatttccacttttatatatatatattttttaaaaaaagcagagttaataattgctttgttttaaaaatgtgcttagttttcatttaggttttcccaaaccttccagaagctctctaaaatgcctcacagtaaggtcttgcacacagttggacttctagatttatctgcccattttttccctctctcctaaactaagacaagatttggagtaacagtttggctgctccagccctgccacacaactgtcaatgtggggttccctgaagccctagtctttctataattttggcagaacacatcttactgtattctttctgaaatgtctctatggccaggtgcagtggctcacacctgtaatcccagcactttgggaggctgaggcaggaggatcatttgaaaccaggggtttgagaccagcctgggtaacatagcgagaccctgtctccaaaaataaaatttgatttaatttaaagaaaaaagagaggccgggtacggtggctcatgcctgtaatccctgcactttgggaggccgagacgggtggatcacctgaggtcaggaattcaagaccagcctcgacatgtagaaaccccatctctactaaaaatacaaaattagccgggcttggtggtgcaggcctgtaatcccagctactcgggaggctgaggcaggagaattgcttgaatctgggaggcggaggttgcagtgagccgagattgcgccattgcactccatcctgggcaacaagagcgaaactccgtctcaaaaaaaaaaaaaagaaaagaaaagaaaaaagagaagtatctctgttatacttttacttgatttgtgtttggcaggggataagatgcaggttgaagtgaattttctgtcagattgtgaaggcgtcaaggcaccgtttgcaggcttccagtcttgccatttaagacattttacgcccttctcattccctgtccttgtgtatacctgaaaatcctataaaggattttctctttatcgccagtattgtgaatttcacaatgatgttaactgagtgttttgaattcattgcactacttactgaaaggggagcttcaatttcaagacatctctttcaattcaggaaaatttccgtcttctttttttttttttttttcttgagacaggttctcgctctgtcccccaggccggagtgcagtagcgtgatctcaactcactgcaacctccaccttgtgggtttaagcaatcctcctgcctcagcctcccgagtagctgggattatagacacacaccaccatgcctggctaatttttgtatttttagtagagatgggttttcaccatgttgtctaggctggtcttaaactcttgatctcaagtgatctacccacctcggcctcccaaagtgctgggattacaggcgtgagccaccacaccaggcctttcttcatatttttaaagtaaattcccttttattagtttctcttttctccttctggacttcctgccatccaatattggacccctaatttattatctttttgcctattgttcatctctttgtcctttttcttttttcttttttttttgagatggaatgtttctctgtccccaggcccggagtgcagtggcacaatctcggctcactgcagcctccgcctcctgggttcaagcggttctcgtgcctcagcctcctgaatagctggactacaggtgtgcaccaccacacccagctaatgttttgtatttttagtagagacggggtttcaccatgttggccaggctggtcttgaactcctgacctcatgtgatccacccgcctcagcctcccaaagtgttggggttgtatacgtgaaccactgcacccggcctcttttgtttttctttaagattttctgcttcctttattacctgtttcctcctgttgatttgcttagatctcgccttaaatgctacaagcctttctcagaaatgtgtgggaacatttgactggttggttttttaaattttttaaaatttagtttttgacacagggtttcactctgtcaatcaaactggagtatagtggtgcagtcttagctcactgcagccttggacctcctgggctctggtgatcctcccacctctgcctcctgggtagctggaactacagacgtgtgccaccacgcttggctaatttttgtcttttttgtaaagacagggttttaccgtgttgctcaggctggtctcaaactcctgggctcaagcaatccgcctgcctcggtcttttctttctttctttcttttttgaaagacagggtctcgctctttcgctcaggctacggtgcaatgtcatgattatagctcactgcagcctcaacttcctaggctcaactgatcctcccacctcagccttccagagtgttgggattacttacaggtgtgaaccactgcaccgggcctggctgtttttatttaagggtggggaactcaggagctgaccaggagtcccttgtgtggcccagagactgatgggttccatctggtggctagctggttttattcactgtggacccccatgccacaatcagtttctgtaggtctttatcttcactctttattctgaagcaggggagaggagagggcttaaggctcaccattcaggaggtcaactttaatttctctgtcacccctctccttggggcaagggacacctggcacccctctggtaagtttgcttaagagagtaaacctcagggcagctgctagatgctggtaagaacctggggtttccattttccatacagacttccaagcagtctccctgttatcagcccccatccccagattccatgctgtgcctaattcctgaaccttcctggggttctctggggcaaacggagaacttgctccacccccacctccctgcatttcagtgtcacccgcttcctccccatgagatcgttgaccgctcctgtacttgcctctgtctttacctgttgtgatttggggtgacagttggagctctccctgcatccaggttggagaacgtgcttgtacttctcattcttggtgtttggcatgacttttgagaggagtaggagaaaaatgtcatggctctgccatcttgaagtcactttgatcctcaaaagtacttcatactctttgtagtgacctagtggaggtgggtcatttaccccagtgtacagaggggtccaagacaggcctgctgatgacataggacctcagttaaagaggttttgttttccttttatttatatttttttttatttttttgtgacagagtcgtgctctgtctcccaggctggagtgcagtggcacgatctcggctcactgcaacccccgcctcccaggttcaagtgattctcctgcctcagcctcctgagtagctaggattaggtgtgtgccaccatgcccggctaatttttgtgtttttaatagaggcgggatttcgccatgttggccaggctggtctcgaactcctgacctcaggtgatctgcctgcctcggcctcccaaagtgctgggattacaggcgtgagccactgcgcccagcctgttttacttttaaagatgaggtctcgctgtgttggccaagctggtctggaactcccagcctcaagtgatcctccaaccttggcctcccaaactgttgggatttacagatgtgagtcactgcgcccagccgtagcccccacctttggctaaagagttttatgtggaggccaccctagcgtgatgccactccacctgctgaacacacacacaggtttctgtcagaccacacctgaccagcagccctgaagggaccttggcatccatcccacccactcgtgtttccatttcctgaccttgtacatgggccaagtgtccccagcaccaagtagctctgcagcaggtgtcttcagccaggctttaaggtttgtctttttttttttttagacagggtctcgctctgtctcccagactggagtccaatggtgcaaccactgctcaccacagcctcaatctctcaggctcaagcgatcctcccatctcagcctcccgcgtagctaggactccaagcgcatgccaccatgcctggttaattttttaaaaattttagtaggccaggtgcagtggctcatgcctgtaatcccagcactttgggaggccgaggcaggcggatcacctgaggtcaggaactcaagacctgcctggccaacatggcaaaaccctgtctccactgaaactacaaaaattagccaggcatctgtaatcccagctacttgggaggctgaggcaaggagaattgcttgaacccaggaggcagaggttacagtgagccgagatcgcaccactgcactccagcctgggcaacagaatgagactccatctcaaaaaaaaaaaaaaaattgtagataaggtcttgcaatgttgcccaggctggtctcaaactcctgggctcaagtgatcctcccacctcagcctcccaaagtgctgggattgcaggtgcgagccacctcacccagccttcggctgactttctgcatgctgctgtttactcctcacagacccctccccaactgaaatctctgcttttattaggtaaaattaggattcttatttttaagtaactgtggtagccatagaacaaagggcacagaggctttttctttcacttttaagtataattaatgatttaattttttttgagacagagtcttgcttgctctgttgcccaggctggagtgtagtggcatgatcttggctcactgcaacctccgcctcccaggttcaacaattctcctgcttcaacctcccaagtagctgggattacaggggtgtgccaccacgcccagctaatttttgtatttttagtagagacagggtttcaccgtgttgaccaggctggtcttgaactcctgacctcaggtgatctgcctgcctctgcctcccaaagtgctaggattacaagcatgagccactgtacctggcctgtttttttgttttgttttgttttgagacagggtcttgttctgtcgcccaggctggagggcagcggcgcgatctcagctcactggagcgcagtggcgccatctcagctcactgcagcctctgcctcccaggttcaagcgattctcctgcctcagtccagagtagctgggattacaggtgtgtgccaccacgcctggctaatttttgtatttttggtagagacggggtttcaccatgctggccaggctggtgaaagcaagatcttcaagaagtatttgtattcccatgttcatagcagcatgattcacaataactgagaagtggaagcaacccaggtgtccatcagtcagaggaaaggataagcaaaatgcgcgcacactctcaatgggatattattcagccttcagcaggaaggaaatcctatcacatgctacagtgtggagggaccttgaggacattatgctaagtgaaataagccggtcatgaaaaagcaaatcctgtatgatttcactatataagatacctagagtagtcaaattcagagagacagaaagtagaaccctgcttgccagggcctagagggagtggggaaggggagttgttgtagagtttcagtttcacatgatgaaaacgttttggagatgattggcggtgatggtagcacaacaccctaccgaaaatgtttaagatggtcaatgttatgtgtatttcaccacaatttttaaaaagtcaccaggggctgatgacctttaaagaggctctccagatggttgctggcccctgggcgcttctttgagactgttgaatctttaactcttaggtttcacgctatgataaacaaaccaacaacaacaaaaaaagtgtggctcatgtctgtaaccccagcacttcgggaggctgaggccagtggatcacttgaggtcaggagttcaagaccagcttggccaacatggtgaaaccctgtctctaccaaaaaatacaaaaattagccgggcgtgatagcacatgcctgttgtcccagctactggggaggctgaggcgggaggattgctagaacccaggaggcagagattgcagtgagccaagattgtgccactgcattccagcctgggtgacagagcaagactccatctcaaaacaaacaaacaaaaagcaaagttggggggaaacaagaaggggggcactcttgccgagtctcaaagattaagaaacaacagaaaaaaagtggtcccatctggagccaggatgtccagccacttgtccactgagtccccaccccgctgcctggaccctggggtctctgggcttccctcccctctggggaggagagattgtacaaccccaagccttgcagagtggagcagtgccacatctggcctctagaaccaaaacaaatctgggtcactttttaaaaaaaagagttagaaattggtcttcccttacctcccctcactgtcaccccagccctgcaaagagagggcaccactgctctccatttgtaatctgggctcataggcactcagacctagaaggtgcatgggtctttattttacagatgaggagatggaggcccaaaacagggggtgcaaggagcaaggtgcatagggtcacacagctgactgggaacggagcccaaatgcaccctggttctttacacccctcctcctaagaaacagctgtgcgctggagtcccataggcaatgagcagggctgtcagcttcagtatcactgcctctcctgcaaggggacaggagagtaagaccagtgactgcctggaggggccacagccagactagaggaacacagccagcaggtgaagtttatctttaggtatctctctgcattcctctgcccttcagcatctcacgtcatcctcagcacagagccccgtttcaggaactcacactcagactccgagatggaaattggttcctttccaggggtttacagagtccagtgctgagcatcaagaaatgaatctcaatatgtacaactattatggatccataaaaattaaaaatcaaaaaagtaaaataaagtgtaagaaatgaatctcagctgttggaatgctactcatcatagcccctaagtgaaggagagatttcaaggttattgctaaggaagggcattcctgaagtccttaaatcatgattcccaaacttgggttattcatattttatctgcacaattattaccataccttgcattccacttgtacagatatttaatatttctttatatcaccttagcttttgaatttaatttacattattttattatagaatctataatatattattatattattggatattaaaaggaattgctatcactactatatatggaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactttgggaggccgaggcaggcagatcacgaggtcaagagtttgagaccagcctggccaacatggtgaaatcccgtctctactaaagatacaaaaaattagctgggcatggtggcacgcacctataatcccagctacttgggatggtggggtagaattccaaggtcagtgacacactggcaggacacactgggggcctcacaaaggaggggctcagcaggagagcccacccttcactcctgcctctggctcttctccgcaaagcccaggcatttctctcttttttttttggaactgtctttttgagatagggtctcactgcagcctggacctcctgggctcaagcaatcctcctgtctcagcttcccgagtagctgggactacaggcacgtacccatcatgcccgactcattttaacatttttgtagagatgaggtctctctaagttgtccaggctagtctcaagctcctgggctcaagcagtcctcccacggtggcctcccaaagtgctgagattacaggtgtgagctaccacacctggcaaaagttcttatttttactactctggttgaatcacaagtattttctgtttggtcatttgtaaaatgcagctattctgggtatcccacaggagtgctgtaaggacaggactgaataatgactagaaatgcattttttccaccgtggtatgtgattgtcatgggtaattaacactaagcccaggtgggtgagtgagctgaggggctatagggacagagcacagtgtgcacagagctctgggaagacacaggtgcagttggtggcctgcagaccccttccattggatcattccatgtgaaggggagttggggccgtttggaggtagcagagttctgggtggcagccaggcccccaaataagcctcactactctggcttttttttttttttttttatgaaaaggagtctcgctctgttacccaggctggtgtacagtggtgcaatcggctcactgcaacctctgcctcccaggttcaagtgattctcctgccccagcctcctgagtagctgggattacaggctaccaccaccacgctggctaatttttgtatttttagtagagacggggtttcaccatgttagccaggctggtctcgaactcctgacctcaggtgatccacccatgttggtctcccaaagtgctgggattatgggcatgagccaccgcacccagcctcctctgggtttttcaggagaatctgctgcctctactgcagccacgcctttaaaaagtggaaaaaccggcaggcaagaggctgcagatggcttgaccaacctccctgttcccttctaggtaccaggatcatctatgaccggaaattcctgatggagtgtcggaactcacctgtgaccaaaacacccccaagggatctgcccaccattccgggggtcaccagcccttccagtgatgagccccccatggaagccagccagagccacctgcgcaatagcccagaagataagcgggcgggcggtgagtgtcggggcttggccaggctctaccttgggaaagggaatgtatgaggctcctggagtccatccactgggggcaattccagggaggaggaacaacagggactctgccctaccctctaaggagcagctcagagcccagagggtgagagtaggggtggggaggttgaactcttcattggtagcaactttccccctgaaaggggcccaggcacctcaggaaaggtgatctggcacctttgggtcatgtaattagcggggagtttgtttgaaatggcagcggctgcacacagcaactttcgtaagcatgtgcctctgtataattgtctctgaagcatttccacttggaacacacccatgatgtttgtggtgcaagagacaagttatcaaagacacagtgtacttgtcctttgggaaattatatgtctacaagataagaaatacatccgggatgcctcctgttgggctgttggtcccctagtggatcttcatgaaggcaggtagaaacaatgcagccagttgtctctgccgatttgacatttggtagctgggtccttcctgctgtccccacctcccgagtaattagagcagccactgtggtagtggtgtaagtgaatgcactctttgtggcatcctgactggcttggcagagtgttggagttctctgctgcaagatgatgcagcataagcacttccgggcaactataatcagattggaacccgccgacccttcacccggaaggccgtaccccaggcccagacaggaagcagcagggacctcagcttggctggctctgctaacagcagcagaattaatctccccagggcctgcaggacatgattcataattaccttgggaacctcacagtacaagacagacaatagttgcctgtgtcttagtctgtttttttatggctgtaactgaatacctgagactgggtaatttatgaagaaaaatggtttatttcttacagttctagaggctgggaaggccaagggcatggtgcccgcatctgctgggcttctggtgagggcctcctgctgcatcataacatggcggaaggcatcacagggcaagaggggcacatgagagagaaccaagctgcctttttataacactcttgtgataactagcccactcctgtggtaacccattaatccaggaatgggctaatccattcatgaggacagagccttcatgacccaattacctcttaacggccccaactcttaatactgttacattggggattaagtttctgtatgaatttcaaaccatagcattccagccctggaccccccaaactcatgtccttctcatatacacatatattaatttggtccccatatccccaaagacttaacacgttgcagtcctagctcaaaagttcaaagtccagaatttcatctgaatcagacaagactcacagcatgattcatctcaagcttaatttccttccagctgtgagcctgtgaaactaaacaagttatctactttcaaaaaataggggctgtccctggcccctaaaaacatcagctggtggccaggcacagtggctcatgcctgaaatcccagcactctgggaggctgaggcaggatgaatacttgaggccagaagttcaataccagcctgggcaacaatgcaagaccccatctctacataaaattttaaaattagccaggcatggtggtgcatgcctgtaatcccaactacttgggaggctgaggccagaggatcatttgagcccaggaggtcaaggctgcagtgagctatgattgcgtaactgcacgccagcctggccaagagagtgagaccctgtctctaaagaaaaaagcaaaaacaacaagagtcagacgaaatgatatagtctggatatttgtccctgcccaaatctcatgttaaattgtaatccccagtgttggaggtagggcctggtgggaggtgtttgggtcgtggggacagatccctcacagcttggtgctgtcctcatgatagtgaatgagttctctcgagatctggttgttgtaaagtgtgggagcgccactccaccctctctcttgctcctgcttcctccatgtgacatgcctgctcccgctttgctttccaccatgacgaaaagccccctgaggcctccccagaagccaagctgaggccggcgtcatgcttgtacagcctgcagaaccgcgagccagttaaacctcttttcttggctgggcacggtggctcgcacctgtaatcccagcactttgggaggctgaggagggtggatcatctgagatcaggagttcgagaccagcctggccaacatggcaaaaccccgggtctactaaaaatacaaaaattagctgggtgtggtggtgggtgcctataatcccagctactcttttgggaggcttaggtaggagaatcgcttgaacccaggaggcggaggttgcagtgagccgaaattgggccactgcactccagcctcggagacagagtgagactccatctcaaaaaaaaaaaacaaaaaaacaaaaaaaaacttattttctttataaattacccaacctcaggtatttctttatagcaatgaaagaatggcctcatataccaagcattcacccattgttgacctggccctctgtcccctctctccccaggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaagagttgggccccgtctgagcttttttcaactctgtttggtaactaacaccagctgctatctgtacagtgctgctgctttttttttttttttttttttgagacggagtttcactcttgtggcccaggctggagtgcaatggcgcaatctcagctgattgcaacctccacctcccgggttcaagcaattctcctgcctcagcctcccgagtagctgggattacaggtgcccgccaccatgcccagctagtatttttttgtatttttgtagagacagggtttcaccatgttggccaggctggtctcgaactcttgacctcaggtgatccacccgccttggcctcccaaagtgctgggattacaggtgtaagccaccgtgcccagccttgtacagtgcttctaaagcgtgggcctgtccttatttgattctgactctgatcctgtgggtaagtagaacaactgttatcctcactttacagctgagaagactggcacaagaacaggtaaaatcgtgcagctgctgaatggcacatgggactggatttgagtcctgctactcttttttttttttttttccgagacgaagtcttgctctgtctcccaggctggagtgcagtggcacagtcctagctcactgcagcctcaaactcctaggttcaagcaatcctcctgcttcagcctcctgagtagctgggactacaagttcacaccaccacctggctaagttttttgtgagtagagataaggtcttgctatgttgcccaggctggtcttgaactcctggtctcaagtgatcctcccacctcagcgttccaaattgttgggatgacagatgtgagccaccacgcccagcccataccctggtattcttgatctcttgtttttcagtagcaaggcagctgcctcgcttctgtgctttctcccccttctctcaaccccaagcctgtcgagtttggcaccttcccgtcagggcccattccatgcaagagtcaaagggaagagcccctgccttggccagtgtggcatctgatctgcgggcactcgacctttgccaattgatcgctttgtgtgagctgtcatgtgtggcacaaacacagacaagctctctgccttgaaaatttcattgaaatgtaagatttgcccgaaagtaaaggtagcataggctgggcacagtggttcaagcctgtaatcccaggattttgggaggctgaggtgggaggattgattgaggccaggagtgggagaccagtctgggcaacgcagtaagaccccgtctctacagaaaattttttaagtagccagacatggtggtgcacacctgtggtcctagccactcaggaggctgaggtgggaggaacacttgagcccaggagttcaaagctgtggtgagccacgattgtgccactgcactccagtgacagagtagaggcttcatggaggtgatgctacagctggaccctgggaatgagtgggttgggggaggcaggggcccagtgttgccaagctcagatggtcttggggagctggggtgttcagggaagagacatagtagcctgctttggtcagagcaggcagt

SEQ ID NO: 13616 - DNA, 11366 bp, Human
gtggtggcaggacacagaactccctcccacagggagcagggcctgggccaggggcagttccagtgtgagtttttccactcccaatattcttgcccagtgaatctggcttaaaagcagcctcaaggtcactgtaaagggaagagattccgtcagagtcagagcccagcacgtgctgcgcctgggtaagggtgagtgggaaatgcagaggcctcgtggggccttgctcagcctgacagggcccctaaagtgcaaagactagggtgaacaccccaacgccctgtcttttctttttttcctttttttttttttgcaacagagtctcgcgctctgtcatccaggctggaatgcaatggtgtgatctcagatcactgcaacctctacctcccaagttcaagcaattctgcctcagcctcctgagtagctgggattacaggtgcctgccactatgcctggctaatttttgtttttttgtttttgtttttgttttgagacggagtcttgctctgtcacccaggctggagtacagtggctttatcttggctcactgcaacctctgcctcccgggttcaagtgattatactgcctcagtctcctgagtagctgggattataggcatacgctaccactcccggctaatttttgtattgtcagtagagacgaggtttcaccatgttggtcaggctggtctcaaactcctgaccttgtgatctgcccgcctcagcctcccaaagtgctgggattacaggcatgagccactgtgcccagcccatgccctgtcttttcaagctttctgcacataccaagacccccagcccagctcactcagacaaagctactggcgggaaagtgtgaggaagggtgtgggcgtggcccaggccctcctcttctctctgccgtatactgatagggctgccccgcacccccccccgcccccccgcgactcagccacgagaggtcatccttgctccagcacagacccctaagaaccctcactcggaacaggactttgggaaaggtggtttctataaatagatgagtaaataaattgacagttgaatataccaagcgtcctggggaccgcaggaggaactgtgtacagatggcttgaaggccagaggcttgggttgttgtactggccctgccactggccagctgtttgaccttgaacaagtcagttccactctgtggacttcagggtcctcacccagaagaagagcagccatatggtctctactgcctggtaaacaccctggctcactctcgcgagatggtggttctcaaagtgtagtgtgtagtccacacaacacctgcattgcaaccactgggtatttatttatttatttatttaatttatttatttatgatggagtctcactctgtcgcccaggatggagtgcagtggcacgatcttggcttactgcaacctctgcctcctgggttcaagtgattctcatgcctcagcctcccgagtagctgggactacaggtgcctgccacatcacccggctaattttttgtatttttagtagagatgaggtttcaccatgttggccatgctggtctcgaacgcctgacctcaagtgatctgcccacctcggcctcccaaagtgctggggttacaggcgtaagccaccgcgcctggccaagggaagtttttttcttttctttttttcttttttcttttcttttccttctttttttttttttttttttttttttttttaacacaggtttctgagcctcaattccagatcagctgagcctggagtttctgaagacaagggctagaaatctgcactttaaagtcttgaaaaccactgtgtgccttcatctaagctgcccctgcttctctcccctccatccctcgcctggccctgtcctccctactctcccctgcaccctcccccgccccaagctccccacaaacggccaaagcagcagtgtgaggcaatcgctctatccttgaccccttcctttgcacagtgagtgatggcgtttttatctcctgatgatgatgcacagccttcagcgggggacatttaagacgcagaacaccaggtccaggctgcagctgcgggactcagaggcgaagcttgaggggctcaggaaggacgaagaaccacccttgagagaagaggcagcagcagcggcggcagcagcagcggcagcgaccccaccactgccacatttgccaggaaacaatgctgctagcgacattcaagctgtgcgctgggagctcctacagacacatgcgcaacatgaagggtgagcgctgcgggaaggaggcgatgaggggttggccagctctcagcggatgaggctcaggccacccaattctgatcctagttgtgcctcttactgggtgaacctgggcaagtttcttcccttcttgaatctcagttttcccctcggaagaagtgggctggttactaagatatatcccttccagattctataatttctggtctcccctccaggactccaatctttttttctccttttctttcatttttattctttttctttcttccttccctccttcctttcctttctttcttcctttcttccttccccttttccttcattcgttctttttttcttccgccttttcttttttttttgtttgaataaaggtctctgtcacagaggctggagtacagtagaacaatcatagctcactgcagcctcaaacccatgggctcaagccatcctcccacctcagcctcttgagtacctgggactacaggcgtgcaccaccacaaccagctagttttatttatttatttttatttttattttttttagagacaatgtcttgctatattggtcacgctggtcttgaccccctgggctcaagggattctcccaccttggcctcccaaagtgctgggattacaggtgtgagccgccacacctggcttactttattttgagatggagtctcactctgttgcccagcctggagcgcagtggcacgatctcggctcactgcaacctccgcctcctgggtagctgggattacaggtgcatgccaccacgcctggctagtttttgtatttttagtagagacagggtttcgccacgtcgaccagactggtcttgaactcctgacctcaggtgatctgcctcccaaactgctgggattataggcatgagccatggcgctcagcctattttatttttgaggcagtctcgctctgttgcctaggctggagtgcactggcgctatcttggctcactgcagcctctgcctcctgggttcaagcaattctcctgcctcagcctcctgagtggctgggaccacaggcgtgcaccaccatgcctggccatctttcttgaactattcctgactttgccttccttcagagctggacaagtcttgtagcaggggtacacaggaaagtcttgcccacagtggcagagtaaatattagacttgactcccacaggcaaaaaaagacggagaagagagataggggagtaagacaggagggcaaggtaaagagataagacggaagactggttatcattgaatagccaggaaggggcagaaaccagctacaagaggccacttttgtagagctgattcgcatccaaggtcatttgaatcaatcccctgctgccactgaagggtacacaagtcaatctaggcacgatctttccaattacactggattgaattagctacctttagagcgagaagccatgcttagatctgcagctggcagtggtgttgtcgtcctcactagatggacagggcttccctggcccagaatccaggggcacacagagtagcttatgcatgcaagcacacagactcacagaagcacagattcatgcaatcagattctggcaagcacacagacctcatgcaagcacagactcgtgcagacacacagactcatgcaagcacacaggcctcaggagttgtattctccttatgaagtaggatttttctggttgcttgaacacagctttttccccttttagagacagaaactccagcaggctctggtatagcccatctccaggcagggccaggcctgaccaccccagatggaaggcagatttctggaccctggagcactgccatgggagttgagggcctggctctagttcaggtccctgctagaatcctgtgtgctcctgagcaagtcacttccctctccaaaccaacttactcatttgagacaagatgagggggtggagtggtccatctctaaggggctttccagctcctagacaagggttattcccttctgcagggctgaggcaacaggctgtgatggccatcagccaggagctgaaccggagggccctggggggccccacccctagcacgtggattaaccaggttcggcggcggagctctctactcggtaagtgctgaggcttctgggctcctggtgctgctggcaggaggttccctggagggtgatgtggtgcatgtggctttggctcccctcctgccattccttcattttgagaggacgtccccagcctagagttcctcaaggccagatccctctctggtcacctggggcggctgtgattaactcgaccagcaggctggcccctatggctttagtccgggctcttcagagcaatgagcagacccagagctccagggatgagagctggtggaggctgggagaagaaggaagctctgtctctcctcggctgtgtatccaggttctcggctggaagagactctctacagtgaccaggagctggcctatctccagcagggggaggaggccatgcagaaggccttgggcatccttagcaaccaagagggctggaagaaggagagtcagcaggtaagtgtcggggagaagcctgtggttcctccatgctccactgccatcctcaaggccagctggggttactatttttcccagaattcctgtctcatgcagcagtcactgggtagcaagtggttttatcttgagaactctcctttctcgagaatatatcctcagataatgctcttcccccataaaagacaccctggagagtcctgtttgagaaacactattcctgtgtccttagttacagaataggattgcattgtgtgcccacttggcagacatcatgcaaggggaactccaagtgcctcattgccctgggtcagatatcccaacgatgccaaagtgcactgtctgtgctgtcagcccacctgtggctgggcttgcaggggtgatgtgggctcaccctacaacaggcctggactagaacacagagtggtccatggccttctggggttctctgcgcttgagcactgacccatcacaggggacagtaaccaggttcacggtaaaggctggtggctctgttatggagattttggtggctttaccttcagcaaaagctgacatgctgcccactatacaaagttcaggtagaacccttccttccctaagttctcagagtaatggagttaacagactactagtttgggagccaactgggacttaggtcggcactgctcttagttaagggtccctgggccaatcactgaccttctctggccccacattcttctggtgtggaatgaggtattgaactaaaacaaatcttgaagatcccattcaacattctatgtatctaattaagctggtgtaaaccacttttcccactcccaggtttctctcttgggatctttgagcttctgaagtcaagtaagagtcttttcagttggacctacccataccaccatcattcaccaccaagacaaagggtccagtggggctgggtgcagtggcttacgcctggaggccgagactggagaattgcttgagcctaggagtttgagaccagcctgggcaacacagggagatcacatctctacaaaaaatttaaaaattagctaggtgtaatgctgcttgcctgtagtctcagctacttgggaggccgaggcaggagaatttcttgagcctaggaggttgaggctgcaatgacccgtgattgtgccactgcactccagcctggacaacagagtgagacggtctcaaaaaaaaaaaacaagaaaaaaatcttaaaaagggtccagtggcagcaggtaacttcctccagttgtcagcagatgcacaaggccatggcaacaatgattaccgactctatcttaggacagttccaggcttcctcgtgctcaacttggagttcctttgctgttcccctccccatcttgccttgtattgcctatgggacctagactaagaatatatatatatatatataaaatttttttttttgagacaactctgtcgcccaggctggagtgcagtggtgcaatctccactcactgcaacctctgccgtgcaggttcaagcaattctcctgcctcagcttcccaagtagctgggattacaggcgcctgccaccatgtctggctaattttgtagttttagtagagacggggtttcaccatcttggccaggctggtctcgaactcctgaccttgtgatccacccaccttggcctcccaaagtgctgggattataggcgtgaaccaccatgcccggccaagaatatttttgtctaaccaccttctgggggctcctttctctgacaggacaatggggacaaagtgatgagtaaagtggtcccagatgtgggcaaggtgttccggctggaggtcgtggtggaccagcccatggagaggctctatgaagagctcgtggagcgcatggaagcaatgggggagtggaaccccaatgtcaaggagatcaaggtgagcaaagtccaggtgcgggtggcaggggcccaggagagcccagtgtgaatgctgtatcaaagagaggacccctagctgtggggggtgcttagcccaacacaggctgagtcgtgattctggttccccatggcctggtaggtcctgcagaagatcggaaaagatacattcattactcacgagctggctgccgaggcagcaggaaacctggtggggccccgtgactttgtgagcgtgcgctgtgccaagcgccgaggctccacctgtgtgctggctggcatggccacagacttcgggaacatgcctgagcagaagggtgtcatcaggtaatacgggcagcaggctccaaacccccctcttctaacacaggcctgcaggtgtgcacccaagcatgtggactgcatccccagctccaagaaaccaacccttggtgcacccatggcttccttctacaaaagaagatacttatttaccaaaggagggacaaagacaagataggccctacttggacagccagacagcttgtcatgaccctcccagaaagtttaagaaccttaataattttctgaagcatggggcagggctgaggttcacctggtacgctcaggaacagctgtaatgtagactaaaatattgaaataatccataccactcagtacaccacagcctcctgaatttcccaaggccccagcccagccaccagcctgaatcctttccctgacatcccagtaatccagcaactaaagggcacaagaggccgcaggggctgctccagctacaagcagcctttattctgatgagctggtaactgtgccaactgccaaataattaccctttgcaaagggcacttccctgatgagactcagaaaagacaaggtaccgtagaaacgtgttatctatggtactggtgtaagcagccagtgcaagagagaactcgcaactgtcctcctgacttgacttctccatttgccagggcggagcacggtcccacttgcatggtgcttcacccgttggctggaagtccctctaagaccaaacttacgtggctactcagcatcgacctcaaggtgaagggcatgggagggggacctggaaggcaggtggtagtgagaaaaacaggctcttcccattccccccatgctgcagaaagaatcctcttctattctgatagaatcacaggctgtaagacagggaagggtctggagtgatggcctaactgctactctaccatctccaaagcctgtgatggccccctcttcttttttttttttttttttcgagactcagtttcattctgtcactcaggctggagtacaatgacatggtctcagctcaccgtaacctccgcctcccggattcaagtgattcttccgcctcagcctcctgagtagctggaactacaggcgtgtgccaccacacatggctaatttttgtatttttagtagagacggggtttcactatggtggccaggctggtctcaaactcctgacctcgtgatctgcctgcctccaaaagtgctgggattacaggcgtgagccactgcgcctggccctcttctgtctcacagcaaagttcaactcttatatgtagttatcattttagaaagaaggaaacttaggtccagagatctgaagggtgaaaaaggcaacataactggttcagggtcacacagctgggaacaccaggctgaaacatcttgttggccagtcttgtgcttctgaaagtcatgacagcagaggagcaatgcagtcctcccgcccttgactgggcaactccaaggctgcacctattaacagagctcgaagaccaagcccctggcagcctgtttgtgatagggtgcagtgtcaagagtgggccaaaacccacaagatggccaaattctcctacctcctactgcaggggtggctgcccaagagcatcatcaaccaggtcctgtcccagacccaggtggattttgccaaccacctgcgcaagcgcctggagtcccaccctgcctctgaagccaggtgttgaagaccagcctgctgttcccaactgtgcccagctgcactggtacacacgctcatcaggagaatccctactggaagcctgcaagtctaagatctccatctggtgacagtgggatgggtggggttcgtgtttagagtatgacactaggattcagattggtgaaagtttttagtaccaagaaaacagggatgaggctcttggattaaaaggtaacttcattcactgattagctatgacatgagggttcaggcccctaaaataattgtaaaactttttttctgggcccttatgtacccacctaaaaccatctttaaaatgctagtggctgatatgggtgtgggggatgctaaccacagggcctgagaagtcttgctttatgggctcaagaatgccatgcgctggcagtacatgtgcacaaagcagaatctcagagggtctcctgcagccctctgctcctcccggccgctgcacagcaacaccacagaacaagcagcaccccacagtgggtgccttccagaaatatagtccaagctttctctgtggaaaaagacaaaactcattagtagacatgtttccctattgctttcataggcaccagtcagaataaagaatcataattcacacaaacatcagtctttgttttaatattgtactgttaaaaaaatctatgcagctgggtgcagtggctcacgcctgtaatcccagcattttgggaggctgaggtaggcggatcacaaggtcaggagatcgagaccatcctggccaacatggtgaaaccccgtctctactaaaatacaaaaaattagctgggtgtggtggcgcaaacctgtagtcgtagctacttgggaggctgaggcaggggaatcacttgaaccccggaggcggaggttgtagtgggccgagattgtgccactgcgctccagcgtgggcgacagagtgagactccatctcaaaaaaaaaaaaaaaaaatctatgctagtagattacaacttcacactagaggagttctggacaaagcttttaattagtcaaactaaattaaggctcattaaaaggaaaggaactactgggaaattatgcaattcaataatttagactctgttaccaggatctttcataaaaatttaatttccataatcataacctaaatgagttcttaaagaattctataagcaatagctgattaatgggccctggaagatgaagattataactgtttatttacctaattaaaaggaaaggcagtgccaaatatgagaggataaacaatattagttaacatttctgttatttatgatgccaattagtagtaagataattccacagctgtcaactttgtttggggctggcaacttctctgcttaaacaggctaaaagtttagtattctgggagaagtggctggaagaaggggtaatatggtgaaagcaaattccctttcccaggagtcaagagaatttatgtgaggtggctcccgcctgtaatctcagcactttgggaggccaaggcaggcaatcacctgagggcgggagaccagcctgactaacatggagaaaccccatctctactaaaaatacaaaatgagctgggcgtggtggtgcatgcctgtaatcccagctacttgggaggctgaggcaggagaatcgcctgaacccgggaggcggaggttgaagtgagccaagatcgagccactgtactccagcctgggcgacagagcgaggctgtcttaaaaaaaaaaaaaaaattatacacacacacacacacacacacacacacacacacacacacacacacattgggatgggagggggtagggaggatgaaaaaatcaccattaccacctgaagcttttccattcttgttttaatagcattgatgatttgcaccatttggagatagagctctggcttatttattataaaacaggagctgggcacagtggtgcctacccacaatgccagctactctgaaggctgaggtgggagaattgctggagggcaattcgaaaccagtctgggcaagatagtgagacctcatctcaaaaaaaaaaaaagaaggaaaaaacaaaggagttgatgaaaccaaattatgacaaactaaattaaaaaattaaaaaatagcattagtgggaacactgtggtatttcctgaggtattaaaattttacaactagtaaaggtatttattataatttattcggattgtttcttagtttatttttgacatggataaaattattgtttatctaggagcctcagagttgagagaggatagttgtagagaagtatttctaaaatggaattatcatccactaccagctaagagaaaatagttacttgtttaaagataccttaaagcaacatatattgtagtttcaagagaacaggctgacagtcaagaaataggcttttaacaaacccactggtttgctggattctaattgcctccttcaaactatgtaattgtgtctttctggtttctgtggagatattttcccacttgtttaattttacactggaataaaacaagttatcactgttgatctgattacagaaactattttatataggacgctgtgaagagtagatattctctgagcccttcaaatgaactgtattaaaacacac

SEQ ID NO: 13617 - DNA, 38009 bp, Human
actcgggaggctgaggcaggagaatggtgtgaacccgggaggtggagcttgcagtgagcggagattgcaccactgcactccagcctgggcgacagagcaacactccgtctcaaaaagaaaaaaaaaaaaaagaatattagctgggcgtggtggctcgtgcctatagtccctgctactcaggaggctaaggcaggaggattgctttacccggggaacttgaggcggcagtgaggtatgatgccgccactgctgcactccagcctgagcgacagtgcgagactctgtctcagaaaaaaaaaaaaaaaacacacaggtgaaaccccgtctctactaaagatacaaaaattagccaggcgtcatggcgcgtgcctgtaatcccagcaactcgggaggctgaggcaagagaatcgcttgaacccgaaaccgcgaggtggaggttgcagtgagctgagatcgcgctactgcactcagcctgggcgacaaaccgagactccgtttcaaaaaaaaaaaaaaaaagccgtgcgcggtggctcacacctgtaatcccagcactttgggaggcccaggtgggtggatcacttgaggtcaggagatcgacaccagcctggccaacatggtgaaaccccgcctctactaacaaaaattagccgggcgtggtgacagatacctgtaatctcagctactcgggaggctgaggtaggagaatcgcttgaacctggggtggaggttgcagtgagccgtgatcgggccactgcgctccagcctgggcgacagagcgagactctgtctcaaacaaacaacaacaagaaaacacaaaattctgcgaccatatgttaaaactgctacaatactacgtatttgggaggagatacttagatcaagcatcctgcttctctttggagtaccaacccctgatttaagtatttatcatcaattttaaaaatgtaacctggcaactcagttaggtctttcttcaattttgttgaaaaccaataattgagaaccaattgggaaatcaatatctacgtatttcccatggcgtccagtggcccagagattcctacactatcggtggacacatcacagtaagattagactgaggattggcgaggggtgcgccgttcttgtgtaaagcgggagaagagtgtattatcgttaggcaacattttaggatataggataaacactggtgtcctgaaaacgttcctggccgcaacactctcagaggtttgcattctcgagtttggagaccatggctctgaaagactcaactcactccactgatgccagccaccagctactgttgatgacttcccaagttcgtactttcagtccacacctcttcctttcgctgggcaccaaacttgtctacattccgagtgccccggcacaccccggggcttcgctttccgcctctcacagtaggaagcggcgagccgcttctagtgcccacgccgctcctcggctgcccggcctgggttttccaccctcgcccctggaatcggcctccctagattcccttccctcttaaaatcatttggaaacgggctccaaggggcgaccctgcgcagaaaaccaaattccatccggggcgggcagggagtgctagactccaaggaagacgtttcccacattcggtggtgaggagtgtttggcggcacggcacggccagcgctctcaaggaccctcttctgcgcagaatatccagtcgtagccacgaaaatacgccgcgtcagtccctgactcgaaaggaagtcctccagagagccgcactaaccatctagcttcctccaccttcagcctgccaggcccgcggccaccgccggcgcgggaggccggcccacctctgcccgcgcgcctggccttaaagcggtcgtggaattatgcttcctcaggcaggcggtggacgcaccgcgggctttttctgtttgaagactacagcgtcacacagcaacgcgcgcgagagaagagagtattctcgcgagaagtccaggggtggccgtgatggcggcggcaggagcaggacctggccaggaagcgggtgccgggcctggcccaggagcggtcgcaaatgcaacaggggcagaagagggggagatgaagccggtggcagcgggagcagccgctcctcctggagaggggatctctgctgctccgacagttgagcccagttccggggaggctgaaggcgggtaagaggtcctgccgcccgaggaagacgcgggagggaggcccgcccctcgcgaatcccgcggctcctggagccctgccgcccgccccctgcgaacccaggccccgccgccaatggctcgccctgcctctgcgccgcttggcccgtcccctctcaagcatatctcggataacgccccttccgcacctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccaggtagatttgactgtaaaggccggttaggcttccctgtgctccgtgggtccgcgactgtctgacatgtccaccttctcagtatcctgacagtaccttgggcatccagtctgagatcaggcttagctgaaaaagctgcaggagtatgaagttcggctgtaatttgatcatcatttttgggaataggcattttgaggtttgtcttgagaattcttacttgagcgctttcattatcttatagggaggcaaacttggtcgatgtaagcggtggcttggagacagaatcatctaatggaaaagatacactagtaagtatttttagttgtttgcaagacaaaatagggtttgttttagttatttcttcttcttcttttttttttttttttgttgcgacggagccttgctctgtcgcccaggctggaatgcagtggcgcgatctcggctcactgcaacctcctccccccgggttccagcgattctcctgcctcagcctcccgagtatctgggattacaggcatctgccaacacacctggcttcttttttttgtctttttagtagagacggggtttcaccatgttggccaggctggtctcgaactcctaacctcagttgattctcccgcctcagcctcccagagtgttgggattacaggcgtgagccaccgcgcccggccttgtttttacatttttaagcgaatcaaaaatacattcaggccaggcacggtggctcatgcctgtaatcccagcactttgggaggctgagacctcaggatcacttgagaccagcctgggcaacatagggagacccccgtctcttaaaaaaataaaataaagtaaaatacattcaagtcaactgatttgagtctcgaactgctctgacacaggaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcgtgagtacttttcatagtttttgtgagaattgctcggtaaaataaatctgaacatgctcaacagttactttgtgggcaaaataaatgcaaagtatttcctatgtctcctaacccctattcagcaagtaggatgttgaatcaggagttgttttaattcccttagcatgttatctgcttactgagggcacagctctggtagatacaatggtgggtattgcccctccttttgagttgacaacctggtttggagacaaaaaaaaatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatcatgtacctcttctagtgaattaaaatcatattgtgattgagaatgaaagacttttttccttatactgactgtctgttggaataattgtactgctcgctctctgtaatgttctttatggtttgtattatgctaatacatttataaaagactatctaaacataaggctgcattatcgtgaaattaatccaccttgggtgagattgtgaagaaatacatatatgtgtgtgtgtgtgtgtgtgtgtgtgtgtgtgtgtgtatatgtatatatatatacatatatatatgttttcttgtttttttcttgcgactgggtctcgctctgctgcccaggctggagtgcaatggcaggatcacagctttctgcagcctcgaacttctgagctcaagggatcctcctgcctcacccttccaaagtgttgggattactggcatgagccaccacacccagctttcctttataatctgttgtatactttctagttaaaaggttaaagtgggttttagaaatgctgatgtcttaattaacatgtgacttgtgatttaggaaagagtgtttttaaaaagaaagaaaaatactgaaggatcaggaagaaataattgatcttggtagcaacatctgctgggaaaacacactagctaagcaagcctggtctcttagagaggcctaagatagggccacttttgccagaaaaatttgtttggatagacagtttaggaaaggaagtttactagagagataactgggaggaattcaaggaagaatcaaatcacagttcaaagttttggtagctttggagacaacagtttgtaactgaatttcaaaagttatatctaaagtccagttagatcctatcagtggtatcaagttaaaaaaaaaaaaaaggtggggggccaggcgcagtgactcacgcctgtaatcccagcactttgggaggccaaggcaggctgatcacgaggtcaggagttcaaaaccagcctgaccaacatggtgaaaccccgtcaccagaaaaaaaaatacaaaaattagttgggcacagtggtgcgcgcctgtagtcccagctactcgggaggcaggaaaatcacttgaacccgggaagcagaggttgcaccccagcctgggcgacagtgagactccgtctcaaaaaaaaaggccaggcatggtggctcacacctgtaatcccagcactttaggaggccgagacaggagaatgacgtgagcccaggacttcgagactagcctaggcaacatagtgagaccctgtctctacgagaaatagaaaaaaattagctgggcgtggtggttcacatctgtagtaccagctactcaggagctttaggtgggaggattgcttaagccctgcaggttgaggctgcagtgagccatgattgctactgcactccagcctgggtaacagagtgataccctgtctcaaaaaagaaaagaaaaataaagcccagttaggtgggatggattatcttttacaactgagatagagaatgtgagctagcagggtataaaaaaggctgctttttacacctgtttgtatttaaattaaaataactatttacctacctatctttagtatgaggttttgtctttgtaaataagcttatcacaatagtctgttaaacagaagaggttctacagagaagtgaaggtaaggaaactcagctgtaacatttgtaagaatgtttcgtaattccatgagggtagcaatagttggtaaatgcagtcttctctgaggatatcctaagctagtttcagagtccaagataaacctttgttctgatttcttctcttctagcttaagccatttatactaaaggtcttctgtccttctgttactttgccctttgcaagactaaactcctgtgcttttcctgtcatcttgtgcaatcactaccatgtttctcttctcaaatgcgttggttcctctgttgcatccgtctctgccatattgtctttcccctcctggcctcttcctctcttgccttcaaataggcaagtcttctcttgatgtcaggtgatccatgcgccttggcctctcaaagttctggaattagaggtctgagccactgtgcctggcctagttatttacatttttaattcattttttcttacattctgcctgccctttccaaccacattattgacaccatagagatacaccttagactactttgtcctcttctacagctagcctggcatattctttttaggtactcaaaaaataaacttaacgagataccagtgagaaccttctagatgctgaattgtccagtataacggataaggtcttattaactttcgtgacagaaaaatccaggtatttataaaaatatgagccctgttttggttttgacaacctttttacattttaagactatgttaacatattaacattttaatttacctgtcactgaggggaatggattcatgttaacttctcataaagaggcgtacagcctgtgcagcatggcgaaaccctgactccataaaaaaatacgaaaattagctgggcatggtggctaatgcctatagtcccagctacttggggggctgaagtgggagaatcaacctgagccagggaacgtcaagtctgcagtgagctatgattgcaccactgcactccagcctgagtggtagagtgagagcctgtctttaaaaaaagaaaaagaagtgtgtgtgttcacaagttcactaattcgtataatttggctcttcggcagatcctgtctacctttcatgaccaactacagttttcattgcaacgtctgccatcacagtgggaatacctatttcctccggaagcaagcaagtaagaacaaactctggagtatttgaagatgattatccactggaaaagaaaagggatctgggcgtagcagaatcaggagacctttgcctagtagctggtataaattcagttggggtttagctctgaataattgcaattgcccatttcaggtcacatgatgactccattttgctgctataattgttattttctggaccacttatcgagtattcccttggtagtagagatgtagtactacagataactgtttcttcctttttgtttttgatagacttgaaggaaatgtgccttagtgctttggccaacctgacatggcagtcccgaacacaggatgaacatccgaagacaatgttctccaaagataaggtagaggtggaactaatgtgattgcagttatattgaagagttaggtggaacttctaaatatactccctaacaagtactttcttcccagtttttattgaatatatgacagtggattcagtgattaccttgttctctttttttttcaagatggaatgcagtgatgcgatctcagctcagtgcaccctctgcctcctgggtcccagagattctcctgcctccgcttcccgagtagctgggattacaggcatgcgccaccacgcccagctaattttttgtatttttagtagagacaggatttcaccgtgttggccaggctcatctccaactgacctcatgatccactggcttcggcctcccaaagtgctgggattacaggcgtgagccaccgcacctggactgttgtgttttttttgagagagggtctctgtcacccaggctggagtgcagtggtgtgatcatggctcactgcagccttgacctcctgggctaaagcaatttgccttcctcggcctctcaaagtgctgggattacaggtgtgagccactgcacgtggcctctttttagtttattttttccaaaattattttgaaaagtttcaaggtggaatgtagtgacaccatcacggctcaccgaagacttgacctcctgggctcaggtgatcctcccacctcagcctctcaagtagctgggactacaggtgcacaccaccacacccagctagtttttatggtttttttagagacagggtttcgccacgttgcccaggcaggtagaactcccgtactcaagtgatccgtccgcctcagcctcccaaggtgttgggattacaggtgtgagccactgcacccggcccatttcttcttagatttaacagttaacattttgctacatttgttttatgtccccatatatctgtttttcccttaagctatatgaggctacattgtgggtacactttacccaatattctgttatacaaccacagtgccataatcataataaaaaaatttaacattggtgcagtactactaatttacagttcatatttgtagtttctcaggattatttttgtgttaataatatcctcctctatagcttctttctccatccaggatctggtcaggatcacccattacatttagttgtaatgactgttttgtctctaatctattaataaaacaattcctttattcagttgggttttgctctattacccagcctggagtgcagtggcacaggcccggctcactgcagcctcaacctcctgtgttcaagctattctcccacctcagcctcccgagtagctgggattccaggcgcatgctaccacatccagctaacttaaaaaaattttttgtggagatgtggtctcactagctggtttcgacctcctgggttcaagtgatcctcctgctttggccttccaaacgtctgggaatacaggcataaaccaacacacccagcccctttatttatttatttatttatttatttatttaatgaattaaaattttttaagtgcttaggcagttgtttggcatgatattcctcaatttgcatttgactttcttcatgattatgttcaggttaaacttttttttttccgctttaatagggacaggtctcactatgttgcccaagctgatcttacactcctaggctcaagcaatctaccagccttggcctcccaaggtgctgagattacagttgtgagccactgtgcctggccatgtgttaaacatctttggcaagaatattacataagtattgtgtgttttttagactgtcacatcaggaggtatataagatattgctttgttttattattagtgatcctaaatttgactagttggttaaggagggagcatttttatctttgtgctaagtaatccttaagccatacatggagattatgtgagtactttattttcctactcctttcaaccagtgatttttagcccccattgattatccaaccctgaatcagttgttagagtagtagttgtaaatcagaatacattctttggttgcaagtcttctgtaaataactttccctcattctttttcttcccttttaaatatcactgtggattattttttaaaaatcagtgtgttatagtccattgttggaatttttttttttttttaattgagatggagtctggctctgtcacccaggctaaaatgtagtggtgcgatgtctcggctcactgcaacttctgcctcctgggttcaagcaattatcctgcctcagcctcctgagtagctgggactactggcgcatgccaccatgcctggctgatttttgtattttttggtagagacagggtttcaccatgttggccaggctggtctcaaacttctgacctcaagtgatccacccacctcagcctcccaaagtgctgggattacaagcgtgagccaccacgcccagctcttgttggattttttcatttctgaccctcaggttgtcccagattcaaccattgtagccctatcagactgactcctgaaactctttgatactcccccatccgtttttgaactcttccttactttctggaacaacaaaatattccaggctttctttgtactttccctggttcctttcagtaaagatttagttgtcatggagctaactctggtggtggtgcttttgaagattatctaaataggaggccagaagatgaaggtcaaaagtcgtttcagtcatgcaagcaggagttggtgagagccacagtcacagcagtggggatggaagggagtcctgactgaagtgacatttctgaaattttaaaatttatttggtgagcatttaggtgtaaaaattgtgagagaagagtcaaggacaactcttaatgtgtctagcttattctgggtgatgactggttctaagttatcaggagcaagaatagaaatccataaagcagatttatgaggtaatataccaagttccattttagtcacaagaagtttgaggtccctttaggatgtccagatagagatgtctcagctggtagaaataggagttcaagagagaataatttgggagtcatcttccaattgacagccaagggactgtgacagagcttttctctccaattggagtgtaagccctacatggctaaggtttgtttatacttgtggaaatccccataatctgtgtattgtgtgtatgcaatgaaatattcagagattaaaagacaaacatgtaaaccttgtataacaccgtggggggaaaaactaacatggatttttctcttgattctaacaagatcttcgaaaaatgctgttttctttctttgtcagcatatctttgattgcagcagtaatagtcttaatttattttgaaaattaggatattataccatttattgataaatactgggagtgcatgacaaccagacagagacctgggaaaatgacttggccaaataacattgttaaaacaatggtaagtagattaaaattgattagacttgacatttaaaaaaccattgttttttgtaagaattcaataatatcgtctcattgtgaaatgataaaattagaacaacttaatgttaaatctttgagtgtgagatacagctaattgtgaattttagtagttttcacacacagaatcagtgagatgcatattgtcttatatgaacattgcccgcatacacctggttttatgtattgaaacttgtccacagtacttttccaagaataattttgtattgaaattagagaccatttcttttcttctattaaaaaaaaagttataggcaatattgtccttaaaattaaagagagcacctggggagaagtcaacagcaagctgttaacagtgcttatctttgtgaaatagaaggataggtgaggattatgaaaaacttgggcactctttgtgtttctctgttgtttgaattttttgatggtcactgattatttcttagaaggaaaaacgatactatcttttttggacactgcacctaggaattgacttttagagttagtggttgattattaattccatacttttaagtataaaatgttcattaatagtaaaacactacttctttttagagtaaagaaagagatgtattcttggtaaaggaacacccagatccaggcagtaaagatccagaagaagattaccccaaatttggacttttggatcaggtacattaatatgttttacattttctttttgattttaagccactcggggataggtaatcaggttctgtttacatttgtatatttgccacataacacactgccattatatgcacatagcatggtggactccaaaaaaatagtgactgatatgagagtactcaccttcaaccaagagaccagtgttgtatagtgtttttgttgtgggtcttccccaaaatgttatgaatttcttcaaatcacttttttttttaactttagtttcctcgcttgtaacatgtaaaaatgctatttcaaattacttctaatcttcctgccatcttaaattttgctcttaaaaactttctttgttgtgaaaagaatttgttttgaagaatttgtgttgcatatctaacataacaggcaaacgaaaattgctgttttttgttcaacagcagggttcacatttggcaagtcagaatgtcaaatcttaaagctgtgtctttacatgtttgatttgccagctttgaaaatgcaagattcagcccggtgcagtggctcatgcctgtaatcctagcacttttggaggctgaggcaggaggattgcttgagtccaggcattcaagaccagcctggacaatacaacaagacctgtctctcaaaaaagaaaatgcaagatttcacatagaaatttagatttctgtcttgtaaaatgaaaacatctgactgcatggggcctgaattcccacaggagctgagtgaatggggcttaggcactctggtttgccctgtgccctctcctgcctctacccaagttgattgattaattgccatttatcgccattctgaaactattctgatccttacacttggcctacctcacacatacttgcaaggttgcttgctggtccttaaaacacccaagtttgggactctgcaagcttcattgtttagaattgtccatttcagactgtgcatggtggctcacgcctgtaatcccagcactttgggaggctgaggcgggcagatcatttgagatcgggagttggagaccagcctggccaacacagcgaaactctatctctagtgaaaatagaaaaattaggccaggcatggtggctcatgcctgtaatcccagcactttgggaggccaaggtgggtggatcacctgaggtcaggagttttgagaccagcctagccaacatggtgaaaccccatctctactaaaaaatacaaaactttagctgggtatggcagcaggcacctctaatcccagctactcaggaggctgaggcaagagaatcacttgaacctggtaggcagaggttgcagtaagccgatatcgcgccactgcactccagcctgggtgacaagagtgaaactctctcaaaaaaaaaataataataattagccaggcgtgttggtgtgtgcctataatcccagctactcgggagggtaaaccaagagaatcgcttgaacctggaaggcagaagttgcagtaagccgagatcgcgccactgtactacagactgggcaatagagtaaggccccatctcagaaaaaaaagaattgtcaattttagttcccattctgttagaatttctcttgttttatgagcatccagattgactgacttacgtagactccttttttaattggatgtatttttgcaggaccttagtaacattggtcctgcttatgacaaccaaaaacagagcagtgctgtgtctactagtgggaatttaaatggtaagtgtttacatatctcattgctgaaatatttggaagctattgaatccagttgtgcctagaactggccattctttgggttgacccttaacctggatacttactaaaatgcttttatagttcaaactcaatttttaggaactagccaaggatttggcagatggtaatagaggagaactttttgtcactttacaacagtttggtcttgagtgagacaggtttagcataagacaaggaaccatttcaaggtcagatttgctgtgtttatatctgtatccttataactaacattaaatttagaaagattcatctcctctccactctttttctgcaattcagctgttacttttaacagatttcctgtgcccatcttctaatttttcttgccctgaaacttcagctcattcacatgatagcatttctatattaaccacccattgcagcttgttcttctgttaacccatctaatagcgggaaaacccctcgttactaatggttatttaataagagttggggtggctgagagatatttagctgttcatctgatatatgggatcattaacctgtcttttggagtggtcgcgtcttaaatatctgatcatttctactgttactaatattttaaggtgggttggaaatagctagtgtgttatctttttacaacatattttcccgttttaattgttaaaatttgacaaatacatggtgccacttctgttcttacaggtggagccacttttggaggtgaattcctccactgtcttctttcagcctctcagacttaagtattttgtggtttggaaaatgctttttgctgagctatggtagaagctaaaaactacataatttgaagcattatgaaaatggcggcaatagcacttaatatgaaacagtagttgagtttaatgttagtatttaagagcttgtatgttgtcatattctgcctaacatggccagccaccccacttctgtactgtttgctctgttctggttggatctgaaacttcttaaaataatcaaaatgcaaatgacaattaaaaatgtaattgtggccacgcgaggtggctcatgcatgtaatcccagcactttgggaggccgagacaggcagatcacctgaggccaggagtttgagaccagcctggccaccatggcaaagccccatctctactaaaaatacaaaaaattagccaagtgtggtggcaggcgcctgtaatcccagctactcaggaggctgaggcaggagaatcgtttgaacccaggaggcagaggttgcagtgagccgagatcgtgccactgcactccagcttgggcaacagagcaagactctgtctcaaaaaaacaaaaatttaattgttttttgattatggttacttaaactagagatgatgacattgcagcagtttaacattaaacttttatgaaaaataggaataacatctgaggtgttcaccaaaggaaattctgcataaaaagtctggtcctgtatatgcagaatatgagccaccttcaatgtcttgatcctttttattgcagcagaactgctagtaattcccaagcttgccccaaattaagatttagtactctgcagttgtttacgtaaaggtgttttcctgcagttcagggacatttcctggaagagggaaaaataaaactaattgagaggaatttgaactggacaaaaatttcaaagtacctatttcagaaatacacaaggtaatcttccttgtggctttagtatgtagctaaattttttgtataaaatatgtaaattgtctattcctatttattgcttttagttccacaagccaggttaatctaacctgaattttagtgcattggcacaatcttaataaatgttgtatttgacgaatgggtatggaactaaaaattgcctagcaaatcgaaagccttctttcttatttgtgtcatgtgcaaccacgatggagatctagcagtactggagagaaacacctttttagtacttctgtttccgttttccatgttggatgtattttgtcttgttggatattcaggttcaatgctttagcagatactgtgcttttatgatgtttatggactgtattgtgtagttcaagcaagtgaacatcgacttacagtgaggacattctctctttatgggtgtttgtattaatttggatgaaaaaaaatgtgcccatacagttgttttcattctttttagctgtgggtgtttgggatctgaatgagtgagaatgcatttgtgtcacaccctgagaaagtataccaatagttgcagtttattaggaacaaaggttgaaaactgtaacccaaccatcatagtgctggattcatttgagtttattgccagaacccagtgttcccaggctatgagatgctcagtagattctttgaaaactagggtgaaatccaatatgcctttggaaggaaatcctcctgtggtgttacacaaatgcacattgggtgtgttggtccctatggaatttcagtatccacatggtgtttcccttgtggctcattgaaagcaatctgccttctcttcaaagggggaattgcagcaggaagcagcggaaaaggacgaggagccaagcgcaaacagcaggatggagggaccacagggaccaccaagaaggcccggaggtggggagagtgcccaccctgcccccctcactatttaagtattatttggtgctgggaaagtccagcagagggaagagagttcaagggtcggaggttaaaaagcctgtccattttttctaaaccttgagcactttgagggacaaaataaccccaggttggaggccaggcgcagtggctcatgcgtgtaatcccagcactttgggaggtcaaggagggtggatcacttgaggccaggagtttgagaccagcctggccaacatggcgaaaccccatctccactaaaaatacaaaattaggcaggtgtagtggtgagcgcctgtaatcccagctacttgggaggctgaggcaggagaatcgcttgaacctgggaggcgggtggcagtgagccaagatcatgccactgcactccatcctgggcaacagaatgagactccgtctcaaaaacaaaacaaaaaacaaaaataataaccccaggccgggcacggtgggtcatgcctgtaatcccagcactttgggaggctgagacaggtgaatcacctgaggtcaggagtttgagaccatcctggacaatgtggtgaaaccccatctctactgaaacaaaaaacaaaaaaattagctgggcctgggggcacgtgcctataatcccagctactcgggaggctgaggtgggagaattgcttgaacccaggaggcagaggttgtagtgagctgagatcgcgctatcgcactccagcctgggccacgagaacgaaactgtctcaaaaaaacaaaacaaacccaagtttaagtgtcatgttttacatttaagtgtacatacatttgttagtacaaaatttatagtagtaacaagtatagtgtcttctggtgataagcctggggaacctagggagtgaagttctgttaaggcgacttgagaaaggataggtggggagggagtgaaaccagtgttgaatgttagctcctttagctccttaactttctgcttctcccttctcatgccttttcccttccctttgtctaaagctgaggtgatgaaatccaggttgcttatttatttatatatttttgtgagatggagttttgctctatcacccaggctggagtgcagtgatggaatctcggctcactgcacaagttatttacttagattagcaagatagcaagtgcttatgtctctgagcttctgttcattactttataataatcagtatactaaagactatcaccctaatcacccccattcctctcctcccttcccccccccccccccccgcataatgtaccagctcagtttcatagacatcaattcatgtttaaagaccactgggaagatatccacaatctacaagtaatttcaccaaaactaccttgctcaataaagctaatccttttcacttccttgttttgcctgaagagggcagagttacttatttgagtaatgagaagtatttgctgtgaagttgcatgtattctagctgaaataaaccagaggcctttcttacacagttgaatgcatttgagctaaagggggttttagttttttgatgttattttttcctttctgcagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgaggtatgtaaagtattggagatcatatggatgcagggttactttgaactgccatcattagccttgtcagtctagaattaggtgtacatctcagtctgttgccactgcctcacccccatctctgtctagattcatccagaatgtgcaagaaattctgttccttcctataagctccagccgttttatttatttatatatatatatatatatatatatatatatatatggttttttaaaactttctattttgaactaattttaaacttgcagtaaagttgccaaaaataagttttctttctcatcaagcttttcctaatgataatatcttagaaaaccatagtacagttatcaaaactgggaaattaacattggtaaatattatcaacacaactagagaaagacctttcaattttaccagtttttccactcacacttaattatttctctttagtctattatagtctttaacagttccaaagccattgcttatctttcatgaccatgatatttttaagtgttttaatcagttattttgttgaatattcctcagtgaagatttgtctgatgttttctcatgattagactgaagttaggcagtttggggaagaataacacggaaacaatgtcttatagcatcatctcatgggattcatgatgtcagtaggtcttattggttacgttgaccatgatcatttggttaaggtgattctgctagctttctccactgtaaaaaactaccgtctttcccttatacttaacaaatgtcttaggcaaaaatacatcgagtctatctatgcaaatatcttgtttgtttttaaacttatgttcactaattttagcacccatcagtggatattgtctgcaacaattatgactgtgttgtatgatgattttcgatttcctctttcccttttctgttaattgattatttatatcagtatggactcatatatatttactttatttcagggagtataatccaatactttgattattttgttgtttaaattattccagctttggcaagtaggagcttcttcaagaagttggttcttgtgttctttcgataagccgtgtctttttttaaaaaaaaaatttctttactttgaggcatcaaaaggtgttcctggccaatcttatattttctgtgccccaggcctacttctttcaccgagccctggttcctttgattggagcatgttgtttaggaataacatctaggtgctcacttccatatatcacatataccaaaattagaatgataaagagaagatgcatggcccctgtgcaagaataacacacaaatttgtgaagcgttccttattttttttttaagtaataaagtaaataaacaaatagcaattaatatctaggtgttaggtgtgctgttactaggcgtcattgcttctagacttcctcagtggtcagaggtaggaagtgcatgtgtgtatgtacaaacctgcatgtacacagataacaatttatattgatacctgggttgacagccttcctcctttccttatttgtaaggtctttctccaacagtgggaaatgtgaataattagatagataattatctacaatatatttactttatttcaatatatttattttgttatagagatcagagtctcactcaggctggtatgcagtgatgcagtcctggctcactgcagcctcaacctcctgggctcaaacgatcctcctgcctcagcctactgagtagctgggatcacaggcacacgccaccacacctagctgggttttttaattttaattttttagaggtggggtcttactatgttgcctaggctggtctcaaactcctgggctcaagccgtcatcctgcctcagcctcccagggtcttgggagtgagccaccattcttgaccttgctcatatttaatatgcacataaagtagtttcagaatttctttttttttttttttttttttgagttggagtcttgccctgtcacccaggctggagtgcagtggcgcaatctcggctcactgcaacctctgcctcccgggttcaagtgattcttctgcctcagcctcctgagtagctggaattacaggcacgtgccaccacgcccggctaattttttgtatctttagtagagacggggtttcaccgtgttagccaggctggtcttgaactctggaccttgtgatctgcccgcctcagcctcccaaagtgctgggattacaggcatgagccactgaacccagccagtttcagaatttctaatccctgggagaaacatttactaagtagattatagcatttatatatagctctttttgtctttagacttgccgtactcagtccaaggtactggtaacttagattagttcttttcttccccacttcctttagtgggtcatgtccagttaagtcaggtttatttgctagtgtttgatgccattttggattctcccacatgttgattgtttgtgtgtatgtatgtttggagtgaggatgtgtgaaacattactatggttctgggagtcagagctgtacagaacggtttacaaaatgtcactccctcatcacccctacagtgcccttctcactctcttttttccaccgtcttcccactcacactctagtttctagtttatccttgctgtatttcttcacaaatgagcagatacagtacatgtatatattcttttgtctcccttttttgtttgtctgtttctgtgtttttttggtttgatttgttttttgaggctagaaggcagtggcgtgatctcggctcactgcagccttcacctccctggctcaagcaattctcatgctgaagcctcccgaatagctgggactacaggtgtgtgccaccacccgtggctaatttttgtatttctagtagagatggggtttcgtcatgttggccgggctggtctcaaactcctgagctcaggtgatctgcccatctcagcctcccaaagtgctgggataacacgtgtgagccactgcgcccagccttatctccttttttatacatgaatagcagcgtgctatatatatagtctttgctccatgcaattattttattttatttttttttttagaaaggttcttgttctgtcacccaggctggagtgcaatggtgcaatctcagctcactgcagcttcgacttcctggctcaagcaatcttcccatcttagcctcccaggtagctgggactacaggcacacatcactgcacccagctaaattttaattatttttttagggacaaagtctccttcactgtgttgcccaggatggtcttgaactcctgacctcaggtgatcctacttccttggcctcccaaagtgctgggattataggcatgggccattgcatctggcctcattgtttatttgtttgttttcaagatggggtctcactctgccacccaggctggagtgcagtggtgtaatcatggctcactgcagcctcaacctttcctgttaaaatcagcctgcaaagcctcgaaattctctcccaccttttgccattttttctttctgtggaagtcatggggttctcccctgattatttagattgctcccttatctcacataatggcctggtaataaagtaagattcaaaccatatgcagaggtagagagatgaattacagtgaatacctgtcttagtccctttgtgttgctactaaggaggacttgaggctgggtaatttgtaaagaaaagaggtttatttggctaaaagaagcatggcaccagcgcttgcttctggtgaggatcccaggcatgtccagtcatggtagaaggcaaagcggagcaggcgttagatggcaagagaggaagcaagacagggagggaggtgccaggctctttttaacaaccagctcctcagaaactaatagagtgaaaactcactcacatccccacattccgcattaatctgctcttgaggtatctgccctcctgacccaaacacctcccatcagaccacacctccaacattgtgatcaaatttcaacctgcacttagggtcaaatacccaaactatagcgataccttgtacacttttcacccagattttaacagttcaagattttgccatgtttgctttatctgtttatttctttttctttttctgaattaaaaaaatatatatatcaccctatgtacactaaaaactatgcatctctttaaaaatgcggctattggggccaggcacagtggctcacgcctgtaatcccagcactttgggaggctgaggcgggtggatcacctgaggtcgagagttcaagaccagcctgaccatcatgaagaaaccccttctctgctaaaaatacaaaattgcgggcctggtggtaatcccagctactcgggaggctaagacaggagaatctcttcaacctgggaggcggaggttgcagtgagccgagatcgcgccattgcactccagcctgggcgacaagagtgaaactccatctcaaaaaaaaaaaaatgcagatattttcttttataaccaaaataattccttgctatcatccaaattcagttcataatcagatttccttgattgtcttaaataccggttcatctcctgagatatttattaattacaaaaggaaaattgtcatttagcagtggagaaacctggcaggcatcatcttaatcaagtgaccagggtgaacatcactattttgatagcatatatgatgcactgaggggcacaacattacctcattggagttcctgagtaagaataacaataaccttgaccttaaaatgaggaaacgccaggccgggcatggtggctcacacctgtaatcccagcactttgggaggccaaagtgggtagataaccggaggtcaggagtttgataccagcctggtcaacatggtgaaaccccatccctacagaaatagaaaaattagccaggcatgatggcaggcacctgtaatcccagccacttgggaggctgaggtgggagaatcgcttgaacccgggagccagaggttgcagtgagccgaggttgcaccatcacactccagcctggatgacagagcaagactctatctccaaaaaaaaaaaacaaaagaaaacaccagacaaatgtaactgagggacattctacaaactgaaatgaccaatattcttcaaagtgtcaagcttatgaaaggttgaggaactgtttgagattggaagaggctaaggagacatgacaactaagtgaaatgtggaatctaggattagaacctgggccagaaaaggggatattacttggataattggcttaattttaagaaggtccatggattatttaatagtattattgttaattttctggttttgatgattatgttaatgattatacatgatgtgaacatttgggaaaactgagtgaagcacacactaggactctactattttttgaaagtttgaaattgttggccgggcgcggtggctcacgcctgtaatcccagcactttgggaggccgaggcaggcggatcacgaggtcaggagatcaagaccatcctggctaacacggtgaaaccctgtctctactgaaaatataaaaaattagccgggcgtggtggcgggcacctgtaatcccagctacttgggaggctgaggcaggagaatggcgtgaacccgggaggcggagcttgcagtgagcagagatcgcgccactgcactccagcctgggcaaaagagcgagactctgtctcaaaaaaaaaaaaaaaaagaaagaaagtttgaaattgttttaaaacagttaaggccaggtgctgtggctcattcctgtaatcccagaactttgggaggccaaggagagcagattgcttgagttcaggatttgagaccagcctgggcaacttgttcaaaccctgtctcttcaaacaattagctggatgtggtagcacttgtagtaccaactacttgggggctgaggcaggaggattgtttgagcccaggaaatcaaggctgtagtgagtcaagatgacaccactgcattccagcctgagcaacagcatgagaccttatctcaaggaaaaaaaaaaaaaaactagtcaagaggctagccacagtggctcatacctgtaatcctggcacttgggccaacacaagaagatcgcctgaggccacgagttcaaggctatggtgagctgtggttgtgcgactgagtaagagagcaagaccctggctcttaaaaaaaaaaaaaaaaagttaaattttttaaatgaagatttattcaaattaagttccaaactcatcaccattggtttgttatatttgagggaatatgcaatataattaatatcaatcagatgtcttaaagttaatcacatgtaggctgggctcagtgactcagcctgtaattccagcactttgggaggtcagtgcaggtggatcacctgaggtcaggaattcgagaccagcctgaccaatatggtgaaacccgtctgtactaaaaatacgaaaattagctgggcgtggtggtgggcgcctgtaatcccagctactcaggctgaggcaggaggattgcttgaacttgggaggcggaggttgcagtgagccaagatcgtgccactgtactccagcctgggctacagaacaagactctgtctcaaaaaaaaaaaaaaaaaaagataagccaggtgcggtggctcatgcctgtaattccaacactttgggagaccaaggcgggcagatcacgaggtcaggagttcgagaccagcctgaccaacatggtgaaaccctgtctctactaaaaatacaaaaatgagctgggcgtggtggcacgcgcctgtaatcccagctactcgggaggctgaggcaggaaaattgcttgaacccgggaggtggaggttgcagtgagccgagattgcaccactgccctccagcctgggcgacagagcgggactccatctcaaaaaaaaaaaagataatcacatgtaataaaaactaagtaacctaacaactttctcttttttgttgctttctcattccttgccagtatcttatgctgagatttttaaactcctcaactaatatttcaaacacctgacctgatatttgtgatttttaaattgttttattggactaatgtttttgtggcaattgtccccaagaacctcaaataagttgcaggccttcttttaatctctgtcaccgcagctccccagttaaagatctcagatgaccggctgactgtggttggagagaagggctactctatggtgagggcctctcatggagtacggaagggtgcctggtattttgaaatcactgtggatgagatgccaccagataccgctgccagactgggttggtcccagcccctaggtaagctggggccttaatatggacatcacagcagatagagaggatagaccatctggccaagggctaaggcttcaaggctgttgggtttaccagattgtgggcatagaattcagttcctgagggttgagctggtttgctattcccgggatatttttgtaattctttgcttgtgagaaagtttttaagcaattttacaaaattgaccaaaaaacataaaaagaaataggatctttttccttcagcaaactagatttgacttgcaatcttctgacttcctgtgtatgtttttattgggacaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggtgagtttgtcctctcccggcagattcctggctttgaaggcctgtggcagccagtgcttatcactggcttgtgtgatctcttaggaactgacccacagctcacgttttttcctaacctgttgctatgacattttcagaataacagtaacaatcggtgcacaaatagtcatccattcattcttctacccatctatcatttgtctttttttagtgcactacagagaaaatgacagacatcaggacactttcccactaagtacttcaggatacataagctagaattcagcctgtttaattcattcttttgatacaaaatgtatataaaatgaagtacacaaattttaagtgtacattcactgagttttgagtttgacctaaactgttgaaatgtaggatccactaggcatgatggttcacgcctataatcccaacaatttgggaagccaagctgggaggactgcttgagcccacgagttcaagaccagcctgggtaacatcacgagaccccatctgtacaaaagactaaaaaagtgccgatagtcccagctacttgaaaagctgagatgggagaatcattcagcccaggagttcaaggttactgtgagctgtgatcacaccactgcactccccccaaaaaagagatgtggacacttaccatcacctcaggaagtttcctcatgccttttcacagttagtcctcacccccacatagaggcaaccactgttttaactttctttcccaccatactttaatttgtacctcttcttgaacttaaatgggctcatgcagtctgtagtcttttatatctggcttttgagactcatccattttgctgcatatatctgtgcacccttttcagtgcagggtagtactccattgcatgaatgtgccccagtgtgtttatgcattttcctactgacagacacttgggccgtctcaggtttggggctactatgagcaagatgctatgaatattcttgtacagtctttttggatcattggatagttacatatttagctttataagaaattttccaaactcttttcctaccatatatgagggttttagttgctgacatttatgattgtctgtcaacttaattttagccatttttgatgggtgtgtagtagtatctcattgtgagttaaattagcatttctttgatgacatactgggcatttttcatgtgcttttcggccactcatatgttttttgtgaagtttctcttcaaatattttgcctgttaatattgctattctgagacttctctgttcttttttttttttttttttaagtttaaatttttttggtagaaacaggtttggtattttttgtttttttttttttttccatgttgcccaggctggtcttgaactactgggctcaagcagttcacctgcttcagcctcccaaagtgctaggattacaggcatgagtcactgcacttaatagtgtcttctgaggaaccaaagttttagtttttatgaagtctgatttatcaaatttttcttttatacttatttctttccatgaatttaaaaaaaaatctttggctactccctgtcatgaagatattctcccatgttttcctttgaaaacatcatggtgttagcttttacacataggtgtctgatttaccttggattaatttttttttttctttagatggagtctcgctctgttgcccaggctggagtgcaatggtgcaatcttggctcactgcaacctccgtctcatgggttcaagctgttctccagccttagcctcccgattagctgggattacaggcacccgccaccacacccagctaatttttgtatttttagtggagacagggtttcaccatgttggtcaggctggtcttgaactcccgcctcggcctcccaaagtgctgggattacaggcatgagccactgtgcccgaccagatttttatgtatagtatggaaattcattttttttccatatgattacacaattatcccagcaccatatgttaactctttcctttctccactggatttctttgatgcctttattgaaaatcagatgtttgtgttaaggaaaggtttacttcagagctctgtatttcagtgatctgtttcttgtcctttatgcatgtatcacagtgtcttggttatcatagctttagagtaagtctttaaatttgatagtggaaatactctgagtttattctgataataagcagcctacagtctcatttttattgattatatcacactagtgacttattgtaccatcctgcctcccggaactctttaaatgtataccacactgatgcctggttttacagaacacagaggtctgcacttaaaaggattctgtaggtgttttttcaatgattcatttacattacaaaaaaaattttttttcctttaattaaaaaaaaaaacaaattttttgaccagacactgtggctccacgcttgggaggccaaagcaggcaaatcacttgaggccaggagctcgaggccagcctgggcaacatggcgaaaccctgtctctacaaaaaaaatacaaaaattagttggatgtgatggcacactcctgtaatctgagttactcaagaggttgaggcatgagaatcgcttgagcctggagggcagaggttgcagtgagccaagatcatgccagtgaactccagactgggcgacagagagcaagactgtctcaaaaataaataaataaataaataatttttagtgacatgtccacacgacagaatactatggatctattcaaaagccgcatatatactgattataaaatggtctctaatgtagttgccaagttaaaaactcaagatgcaagaccaaacttataatatgttaccatttgtatggctttttgggctttttttttttttgtatgtttatctggtgttttattttgaaacagagtctcattctgtcgcccaggctggagtgcagtggtacgcagtctcggcatactgcagcctctgcctcccaggttcaagcaattctcctgcttcagcctcctgagcagccaggattacaggcgtgcaccaccacgcccagctaatttttatatttttagtagagacggggttgcgccatgttggccaggctgatctcaaattcctggcctcgtgatctgcctgcctcagcctcccaaaatgctgggattacaagcgtgagccactgcgctcggccacatgtgtgtgttttaattttgaagacaatatatgcctagattctctggaaggataccaggacactggaacagtgattacttttggcaggggaaactgggtataagggacatagaaagagagactctcgttttatatgcttgtatatcttgggaattcttcttttctaaccatgtttaatacatatatatgttaagaaattgaaattttttaaattaatgtcatatatttctctggaagtgaatagttaaatagactcttaagaaccagtaagaaagaggtgacccagagaccacctgtgggaacagatgggaaactaggacggggaagaaggtgaccttcaaaatattttcatagaataagggattgtaggcttggtgcggtggctcgtgcctgtaatcccagcactttgggaggctgaggcgggtggatcacctgaggtcaggagttcgagaccagcctggccaacatggcgaaaccccgtctttactaaaaatacaaaaagtaaccgggtgtggtggcacatgcctgtaatcccagctgcctgggaggctgagacaggagaatcgcttgaacctggcaggccaagattgcagtgagccaagatcacaccactgcattccagcctgggtgacagagtgagactgtctcaaaaaaaaaaaaagaataggctgggcgcagtggctcatgcctgtgatcccagcactttgggaggccaaggcgggtggatcacctgaggtcaggagtttgagaccagcctggccaacatagtgaaaccctgtctctactaaaaatacaaaaaattagccgggtgtggtgtaatcccagctactcgagagcctgaggcaggagaatcgcttgaacccgggaggcggaggttgcagtgagaagagatcacaccattgcactccagcctgggcaacaagagtgaaactccgtctcaaaaaaaaaaaaagaataagagattgtagactcaataaacgtcatttttttcagtgagattattggaaaagatgtgtgaatttagccacttttatgggtatttttattgtggtaagcatgtatgtattatgtattttctcacgtttcttactaaaggcctactgaaaatgttttaataaacatgtgccatctggtattttttaagaagtgtgtaatagttcaaaatctagcaaaactcaactgcaaagatttttaatatctgttgtagagctcaaggggttaacactatttgtgtgcggatgcgtttttttcatgatgatggagctgatgctttattgtgcctttttttctttcttggttttcaaggctttgataaaattcaagagttatttgtattttgaggaaaaagactttgtggataaagcagagaagagcctgaagcagactccccatagtgaggtgagtcatggccataagaacattagaatcataaggccttgagcgttaggacccattccttcattataaaagtgaggaacacgaggcccaaaggggaatgaaggggcatctggtagccccactggccagcggcaagctcaccctctgcttattgtgttttgctctttatgtagtaccatgcttctgctgttagagacatgatcctgttctttcaggataactctgtagagaaaagtgtataaaaatagtggcctgcaccaccccatctgggaggtgtacccaacagctcattgagaacgggccatgatgacgatggcggttttgtggaatagaaaagggggaaaggtggggaaaagatagagaaatcagattgttgctgtgtctgtgtggaaagaggtagacatgggagacttcattttgttctgtactaagaaaaattcttctgccttgggatgctgttgatctatgaccttacccccaaccctgtgctctctgaaacatgtgctgtgtccactcagggttaaatggattaagggtggtgcaagatgtgctttgttaaacagatgcttgaaggcagcatgctcgttaagagtcatcaccactccctaatctcaagtacccagggacacaaacactgcggaaggccgcagggtcctctgcctaggaaaaccagagacctttgttcacttgtttgtatgctgaccttccctccactgttgtcctgtgaccctgccaaatccccctctgtgagaaacacccaagaatgatcaatgaaaaaaaaaaaaaaatagtggcctgttgggaaatctacaagagactgaggaagcaagtccagtgtctttattctttatcagaggaggtatcaagtccaaagggagggaacctggagtgggagagtagaccttgtggtgtggcccaggggcactaggagctgtaacgtctcactcagtgtccttcagaactttctctgcctccacttccggggttgctggaaacatgtctgcccaaggtcatagcacagtcagagaaaggctggcacatctgggccagccacaagcaccaaaaataaaaagggaagtgggatgtagaggaagaaagttaagctggaaacatttttttcataaaaatgctaatgctgtgaggccacccaggacactaatagaaggagatggaggtgaaataaagaaacgagtttcagctgtttttaggaaagaaatactaaagagaaataattattagatctaaagatgcaataaccagaaagccccctcttgtgggaagagaaggcagccttttctgaagaattgaagtggtcaagagaggatattcagtgtaattctgggagagaaaggaggaacatgaggattcagagatgtgacataagagtcttagagaacttcaaagtgaaaaagcagaagtgagaactgactcggggaaaggaattgataaataagcacgcttaaacaggtgtggtcccaaggagtccatggaaggccagcttactttaaaaaaaaaaaaaaattttgtagagatgaggtctcactatgttgcccaagctagtcttcaactcctggcctcaagtaatcctctctcctcggcctcccagcttacttttataaatacagtgcaatgaataataaaatatagaaatgtttggtatatgtagcacaggaattcagaaaacaaagccccggactttgagaccagtctgggcaatacagtgagatctgtctctataaaaaaattttaaaaattagctggatatggtggtgtatgcctgtagtcccagctgcttgggaggctgatgtgggaggatcacttgagccaaggaggttgaggctgcagtgagccaagatcacaccactgcactccagcctgagtcacagagtgagaccctgtctcaaaaaagaaaaaaaagcctgaatagtgcatattaacatgctttgaaaaatcgaaagtattataaaaattgaagatgttgttattacacaagttatgcactgttcttgggtgagtgactagcagtctggcagcagcacttctaacatattttcctagagagttctttttttgtttgttcttttttacagttctgaagtaaaaccatggtttttgtttcagataatattttataaaaatggtgtcaatcaaggtgtggcttacaaagatatttttgagggggtttacttcccagccatctcactgtacaagagctgcacggtacgtacatgtttccatcccatgagcaaaacttgagggaagcagatgaatgggttgtgatgacaaagttactgagtgctggaacgaaatccaagcagcctcagagtggcatgcgcatgtgttgttaccattactgtttagtccagaaacagtttgggcatcttagggagtatttgctggatagaaaaaggtcctgcagtttgtgtgcgccatacttttcccttgagcacgtggtgtggtgttaccgttcagtaggaaggatataaatacacatacacaaatcctcctgggatgtcatgataacccaccattattagtcattgttgcttacaatgatttttttttttttttttttttttttttgagacagtgtctcactctgttgcataggctcaccatagccttgacctcctgggcacaagtgatcctcccacctcagcctcctgagtaggtggggtgtgctaattttttggtttttgtttttgtagaggcaggatctcactacattgccctggctggtctcaaagtcatgggctcaagcagttctcccagctcagcctcccaaagtgctgggattacagagaggcatgaggtaccacatctggcaagttttttttttttttttaaatatgatccaaacatgaagaagggtactatcattagggcctgttggttttaaaaatatataggtagataggtagatagatacagatatatagaaaagttggggctgggtgcactggctcacgcttgtaatcccagcactttgggaggccaaggtgggtggatcacttgaggtcaggggttcgagaccagcctggccaacatggcgaaaccccgtctctactgaagatacaaaaattagctgggcttggtggcacatgcctgtaattccagctactcaggaggctgaggcaggagaatcacttgaacccaggaggcggaggttgcaatgagctgaggtcgtgccactactccagcctgggtgacaaaacgagactctgtgtcaaaaaaaaaaaaaggaaagaaaagaaaagaaaacttaggccagtcgcggtggctcatgcctgtaatcccagcactttgggagggtgactcaggcagaccatttgaggtcaggagttcaagaccagcctggccaatgtggtgagacctcgttgctactaaaaatataaaaattagccagatgtgatggccacgcgcctataatcccagctgtgggggaggctgacgcaggagaatcacttgaacccgggagatggaggctgcagtgagccaagattacaccactgccctccagcctgggcaatagagtgagactccgtctcaaaaaaaaaaaaagggcgggggtggcgctgggcacagtggctcacgcctgtaatcccagcactttggtgggaggccgaggtgggcagatcacgaggtcaagagatcgagaccatcctggccaacgtggtgaaaccccatctctactaaaaatacaaaaattagccgggcatcggccgggtgtggcggctcacacctgtaatcccagcactttgggaggccgaggcgggccgatcatgaggtcaggagatcgagaccatcctggctaacacggtgaaacctcatctctctaaaaatacaaaaaaaaaaaaaaaaagaaaaaaaaaagctgggcctggtggcgggagcctgtattctcagctactcaggaggccgaggcaggagaatggcgtgaacccaggaagtggagcttgcagtgagccgagattgtgccactgcactccaacctgggcaacagagcgagactctgtctcaaaaagaaataaaaaattagccaggcttggtggcacgcgcctgtcgtcccagctactcaggaggctgaggcaggagaattgcttgaacctgggaggtggaggttgcagtgagccaagatcatgccactgcactccagcctggtgacagagcaagactccgtctcaaaaaagaaagaaaaagttaatgcatgaagatttccatgtacttttagtctgtcagtaggcaccattgaagcaggtaaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagtctgtggtctgtgcctttctccaaggatgaatttgagggcttaaaagttttaaaaagaaaaagggctggacggagtggctcacggcagtaatcccaacactttgggaggccaatataagagaatcagttgagcccaggacctcgagaccagcctgggcaacatagcaaaaccccctttctacaaaaaaatacaaaaaattagccaggcgtggtggtacatgcctgcagtcccagctacttgggaagctgaggtgggaggatcccctgagcccaggaggtcaagggtgcagtgagccgtgatcgcattgttgcgctgcagcctggacaacagagtcagagcctgtctcaaaaaaaataaaaagtaaaataaaggggaaatgcgggctggaggggaaagtaggagggtatggtcatccacatgttgcaagagaaaaggagcagataggggaaagtcaattatgtattcatctcatgcccggtaaatcggcacttcacataaggtaaggtgaacataaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctgtgagtaacattacaaatggctgcatgtgtcctcagcatctccgtggctgctgtagtcaccgtgttctgtttctcattcctcctgcagatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggccgggcgcggtggctcacgcctgtaatcccaacactttgggaggccgaggcaggtggatcacgaggtcaggggttcgagaccagcctgaccaacatggtgaaaccctgtctctactaaaaatacaaaaattagccgggcgtggtggcgggcacctgtaatcccaggtactcaggaggctgaggcaggagaattgcttgaacccgggaggcggaggttgcagtgagctgagatcgtgccactgcactccaggctgggcgacagagcaagactctgtctcaaaaaaaaaaaaaaaaaaaagaatgaggcttctaggcactgtggctcacacctataatcccagcattttgagacatcaaagcagaaagattgctcaagaccaggagttcaagaccagcctgggcaacatagcaagatcccttctcagtaaaaaaattagccagacgtgatgacacatgccagtagtcccagctactctggaggcttaggtgggaggatcccttgggcccaggagttcgaggctgcagtgagccatgtttgcaccacagcactccagcttgggcgacagagcaagaccctgtgtccaaaaacaaaaaaccctttccttttggattcatatataatttccttatcttcctttttcttttctttctttttctttttctttttttttttttttttttttgagatggagtcttgctctgtcactcaggctggagtgcagtggcgcaatcttggctcaccgcaacctccgcctcctgggttcaagcaattctcctgcctcagcctcctgagtaggtgggactacaggcacgtgccaacacacctggttaattttttttcgtatttttagtagagacggggtttcattgtgttagccaggatgatctcgatctcctgacctcatgatctgcccacctcggcttcccaaagtgctgggattacaggcatgagccaccacacccggcctgtcttccttttttcaatacatcagtcttacggcaaagacagccctcccaggattgcccaaagtccctcctgcatttacctctctacctcggttaataagtagagtggctcaccactggagggtgacatgctgctgcagaatcaccatgttatgcctgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaatt

SEQ ID NO: 13618 - DNA, 59853 bp, Human
tgtcgcccaggctggagtgtagtggctggatcatagctcactgcagcctcaaactcctgggctcaagccatcctccttcttcagcctccacctccagctaatttttaaaaatattttgtagagacaagggctcactttgtttcccaggctggtcttgaacttctggcttcaagtgatcctcccgcttcggccacccaaagtgctgggattacaggcgtgagctgtaatttagttgtttatttactcatttgttcaacaaatacttattgaatatttgctctttggccagtcaagggatttcatgagtgtctactatgtgaataacactgtgttggccactagtctgtcacctactggtggattagaaaaatagcgcgaggaccattttttcttttcttttctttttttttttgagacggagtcttgctctgttgccaggctggagtgcagtggcacaatctcggctcactgcaacctccgcctcccgggttcaagcgattcctctgccgcagcctccccagtagctgggattacaggcaagcgccaccatgcctggctaatttttttgtattttagtagagacggggtttcaccttgttggcaaggatagtctcgatctcctgacctcgtgatccacccgcctcggcctcccaaagtgctgggattacaggcataagccaccgcacccggccaactcttttcttaaattagccagggaggcgtgggtgggttgggtgaggagttgggtggggggatctcattcagtattcaaacttctacaagtttcggggttgaggtgggtgatggtaagggaacaggccctgccactacctttcatagtgacttccatttgtgtaatatttttggtccactgagagctattattttatttgattcttatgaccatcttgtgaaggagtatcaacagataccccgttttgattttatcagatgcatgatttgtcctacatcaaacttcataaatgatggacagaatggaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgcctcgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttacagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctggccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgtttgttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactattggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccccgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctttcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgcatcaatagaagtgtctgctctgttcccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgtgatccgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaactaaaagggaaaggtaataaatctcacttaacatctcccttcgctccctgggcctgcctgaaagttacacgggagcaacgtgcgtggccacatctcagctttgcccaactgactggtgtgtcgttggtttgttccagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaaggaggtcagcctggacaggtgaactgagttgccttcagaaaggcctgtctcaggcagccgcagcaggcttcacgatgtccatgtatcctgtttgcctgctgccgtctctcctctcccaagaggggaggtctgcgtgttgagccagggaggaaggagcctgcagcctgctcagggtggtggctggtgactgcggggccagggcttgctgctgtctctcggaatgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttggaaattaagtcagctttgcctgtggtttggctaggaataaatatttacctgtgtgcccctacagagatgacacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagtggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacaggtaataatactttgactcccaactttttgaaggcattccttgcttgctattctagtggtggaaggtgtgtatactaacaccttctgggcggtgaaggttcatgaaatgcctgcagaaacattcattccactttctgctcgcagttgggtgaaatacagagaggtggagatggggtgcctctcaaggtttgaacttcaccagccccaacttatgccactctctgtttcccccgaaagactggtcttaggcaaacccctgggagagggctgctttgggcaggtggtgttggcagaggctatcgggctggacaaggacaaacccaaccgtgtgaccaaagtggctgtgaagatgttgaagtgtaagtgatgcttctgtccttgcaaagaaaatcttgtcccattccaagcaaacagcaggcctcgggcccagcagaacagcttctctggtgcctttgctgcccacacctgctccgctgcctgcttggggttacctgggagtggagggggtgttctgcaccttgagattgttctatgacgtcactctgttccttggcgtcaacctgggctgtggtcaggtgtttatcctggatccatcgcttgcaggctttcctcaccacatccctgcccactcactaccacctattgcaacaacggctcccatgagagggaagagaaaacaagtttggatgaagtggggaggagagaatcaagtcccagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataagacttgcttgaacccgggaggtggaggttgcagtgagccaagatcacgccattgtactccagcttgggagatactcccgctgtctcaaaaataaaataaataaataggccaggcacagtggctcacgcctgtaatcccagcaccttgggagggtgaggcgggtggatcacttgaggtcaggagttggagaccagcctggccaacaggtgaaaccccatctctactaaaaatacaaaaagtagccgggcgtggtggcgcatgcctgtaattccagctactcgggaggctgtggcaggagaatcgtttgaacacgggaggcggaggttgcggttagccgagatcgcgccattgcactccagcttgggcaacgagcaaaactccatctcaaaaaaaaaaaaaaaaaaaaaaaaaaattagccaggcattgttcatgcctgtaatcccagctgcttgggaggctgaggcaggagaatcacttgaatccagaaggcagaggttgcagtgagccgaaattgcgccactgcactccagcctgggcaacagagtgagactccatctcaaaataaacagacaaactggggctcttaccccaatgttgctcgggaattttctggactatgctgggagtaattatttctctgattttttttgggtagtagaatggatttcccaggtcccctaagaggaggcaggagatgggaggttggccggggtgtgctgctgggggtggggtttctttgaggtgaagccaaacctgctcacctgctgctggccccatggcctcttctcctgtgcctgcaggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctgggtaatgccagggtgggaacagagcccccctagtcttccagcctgtgacttatcatcttgtggtggcgttgtggatgcactgagcactggccctgtgtgccctgtgtgttgtcttaggctctctgggaactgcagagtcaggagcaccagtgtagccaggtggccttggggtcagactgatgcagggtccgatctgtgcactgccactttctgcgtagcctcaggcagctacttagcatcttaaaattcttcaaatacaaaataataataatatcagctgggtgcagtggccaaggcgggaggattgcttgagctcaggagtgtgagaccaggttgggcaatatattgaaaccccgtctttaaaaaaaaaaaaaaaattaaaaaattagctgggtgtggtagtgcgtgccgatagtcccagctactcgggaggctgaggtgggaggctagcttgagcccaagagtttgaggctgcactgagccatgatcacaccactgcaccccagccggggcgacagagcaaggccctgtctcaaaagaaaataaagtataacaatacctgttgtagaattgttatgaagataaaatgaaactgtctgtgagtgttgagtgcagtgtttggtgtgtaagggctggcctggtttgagcccagccccatgtggacttgctgtgctgggaggcaggacctaggagcatgcatcgctgcagacgcagcagaggcataaggggccagtctttggggaaggaagggaggagcgcttgctgtgatgagaagcctggagctggcagagaatgttagaagagggaaagcaaaggttcggggggcagagcagtgtggcagaagttctatgagacaagtcggctagttgcatgggtggcggccgcccagagccttccagctccctcacctccccgcctcccgctctcccttcctccttcctcagtgcatacaccgagacctggcagccaggaatgtcctggtgacagaggacaatgtgatgaagatagcagactttggcctcgcacgggacattcaccacatcgactactataaaaagacaaccaacgtgagtgccgacaaggccgccctgtgctggtggtttcatctgagaagcaaggagtggggtgggctgagaacccaccccccagtcccttcccacttgtgccctcatggccctgcctggggccactccaacctcccctgtgctgctttcagggccgactgcctgtgaagtggatggcacccgaggcattatttgaccggatctacacccaccagagtgatgtgtgagtttgtaatagcaattgccagggaggtgtgggatagagagcttctagcactgtagagtcctgctttctccctggactgaggagtcctctttctgccccagagagaaaaacaaaacattgtctgtggccattccctctgctccagatgttgaaaggctgatctgttctccatgctgtctcctggcactgccctgggtagaggatttgtgctgggggaggggaggcggagaagctctaacaccctgtggctctccgcccatttgcaggtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtaagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggtaaggctgcccgtgccagagccagagctcaggccgtccccactgcgtgcacgcacctccctgagcagggaggaggggcccggcccatcgctgcttcctctcgcccatcacaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagagaaaatgaaatggccgttttacttagaggaccaaattgggtctcctgaggaaaggaatccagtttatctaatgaagatgttgtgccatgaaggcactgagtctgtctggtttcctgagggttaaaagattagggctgggatcaccacagcattaatcaatactgcctttccgtctcttctaattgccataggctggagatcatcggtcccttggccctgctaatgtaatgtattgatctcaggtaagtaagattgagcatcaaatgaggcaagaaatctgtctcattgttaatgaggttgctgtgcttattcgccaccactgggtggagccagcgagctgaagtttcagttggcattaggtg

SEQ ID NO: 13619 - DNA, 59853 bp, Human; identical to SEQ ID NO: 13618

SEQ ID NO: 13620 - DNA, 59853 bp, Human; identical to SEQ ID NO: 13618

SEQ ID NO: 13621 - DNA, 59853 bp, Human; identical to SEQ ID NO: 13618

SEQ ID NO: 13622 - DNA, 59853 bp, Human; identical to SEQ ID NO: 13618

SEQ ID NO: 13623 - DNA, 59853 bp, Human; identical to SEQ ID NO: 13618

SEQ ID NO: 13624 - DNA, 59853 bp, Human; identical to SEQ ID NO: 13618

SEQ ID NO: 13625 - DNA, 59853 bp, Human; identical to SEQ ID NO: 13618

SEQ ID NO: 13626 - DNA, 68392 bp, Human
aacagttccccaggacacttagtgaacacacagatttccagactctgctggcaatttggatttttttaagaaggctggcggatgattcttgggcatattaaagattgacaacgagttctctactcactgtggctaggaatacaaaaggatgggcatagaggggaatgggaaccgaaagattagagcacgagtcactgatcagccaggcaggggtgacctcaggcaagaaaaccttcagaggtaaaaccaggtgggagttatttacagtagatcatgaaagatggggagtgcgggaactatgtcagtcaccacagggatgcaaaggaatgaaaagataagagaactattcaggaggaagaacaggtcctagtgtatgctagttactgatttgctggggtaatattatttcccagaaacagaaccctgtgtcaaatccaggagcctgggggactgtagaacctgaagttttactgggtaagcataaacctaaaactacaacagttggataagtggtgtgatatatttcacatggacctcctgcctagttcacttctttatagtcgctagaacactcatgacaatttatttctgggaagaagccaggatgaattcgaaagcatcctgacaccccacccctttcttttctctagacttcaggttaactcctgcccttcggttttggtaaaactaccctgccaagccttatcttgtattttgctcctgtttttgttatcaaatgtgtaaaacagtcacgatgaatatacatgccaactgctttcagaggcaacggttagtctcttgcaagtttcaacgtgcacattttggagctgctgtctctgtgggaacctgcaggcacctcatggatgcaccacaactcggaaattacagtaccacctggaacaccttatccaggcaaggagatcattaagcctggtgtttgaggcaatcgattcacttggaagaaggtgctttggtggttttgagaggaacaatccctacatgaaatccctccatgggaaatggagaacatcagctatttcccattgccttcaaacctaaagatgtcgccaggcctcttggcttgttactgaagcagcgaaataagtcagaaatcaaagacttagaagttacgaaaagaaaatctcaaaaaggagaatggggtcaggcgcggtgtcaggcctggaatcctagcattttgggaggcagaggcgggaggatcgcttgtggccaagagttcaagaccagcctgggcaacatatcgagacgcctgtctgtattttaaataaataaatatggagaatgggaaacccatcaggctgtaatctcacagggaatttagtaccctttacctaagacaagacctgggcacttgggaagcctccccgagtgcggtttggggagggggagggcatcttaaattccagtcctcggtcactcttgtggctttgccaagggattttcaaatcccgggaatgccagggatggagatgaacaggctgaaatcccccacgctgccagggttagggaggggaaaacaacagtccacagcggccgcgaaggtttgtatttttttttttttggtaacaaggggcttgtgtgcagtccaatatcaccatcgccgtgaagtcacagtggcaagatgaaaatgtttaaaaaaattttaaaaaggaataaggaaagaggaagaggacagcgtgccccggctcagaaaacggtcctcctctgccccggacgccggcggacctgtggggtatgaccgaatctccccgcgcagccggcaagccccggccctcagtcgggccgcgaccagcgtgacgccgcggtagggggatccggcgggcgcgcggccgtcttcaaagccccggcgccgccgccgcccccgcgcgcgcgcgcgagtagtacggtccgagggggcggcttctggggcgcggctccggcggcagctgatgcgcgccccgccggccgggaggcgggagtccgcgagccgggagcgggagcagcagaggtctagcagccgggcgccgcgggccgggggcctgaggaggccacaggacgggcgtcttcccggctagtggagcccggcgcggggcccgctgcggccgcaccgtgaggggaggaggccgaggaggacgcagcgccggctgccggcgggaggaagcgctccaccagggcccccgacggcactcgtttaaccacatccgcgcctctgctggaaacgcttgctggcgcctgtcaccggttccctccattttgaaagggaaaaaggctctccccacccattcccctgcccctaggagctggagccggaggagccgcgctcatggcgttcagcccgtggcagatcctgtcccccgtgcagtgggcgaaatggacgtggtctgcggtacgcggcggggccgccggcgaggacgaggctggcgggcccgagggcgaccccgaggaggaggattcgcaagccgagaccaaatccttgagtttcaggcaagtacacggcgtccccgctgagatgcagacgcgcttgcctccatccatctgcgactccctctgtgtgcgtgtgtgtggtcgccacccgcgaaaccgtcctcacggccgtgccgcgtccctgcccggagccgggtccccgtgtgcgtccgaaagttcaggatcttctgtcctcccgtggggtttctggcccccgtttcgctaggagagttccgcacccaacccagaatctgcagtctctccgcatccccgctggcctcggtcactttctctaagcttcgacccccagcccccgcccctccacactggagcaacgtcactgatctaacccagtgcaacttagggcccccccgtggggaagaagtcgctccccggcccttcccggggccctaccgtgtacccaaaacgcagccgcggtgaagaaggtcgcgtgatgacaggcccctggcagctgctgggaaatggtggtctctgccgggctgtcatccgcgtgattgcggaaggcaggtgacaccattcttagcctcgggcccagggagttccagcaggtagaggcctaccgagcaaagaggaatgcctagcatcggcctaactcgggggtgggaccagtattaattgttaaagcctctgggaaagggctcttgtgacaaaaggagtctgttggaaaagcgcatttttcaggtgtctgagggaaggatgacctcgaaaataaatggtgctggagaaaagctccagggaatggaggagctttcagagagacaggatgccagcctgagaaacccaaggagggcactgctcagagaccgcagttgcctcccgcaggtcagaccctgctgaggaccggttggttgtgaagttagacaaaagtgctggacttttagcctctgtgaatatgtagatttcaaagggtgtcggaaataccgttgaaagtggtaattcctcatttttcctccttggcagctcggattctgaaggtaattttgagactcctgaagctgaaaccccgatccgatcacctttcaaggagtcctgtgatccatcactcggattggcaggacctggggccaaaagccaaggtaaagaaaaacttgcatttttcctgcctgttttgtttcaaaagttttgaaaaatatcaatgaaggaaggaaaaaagtgtaaatttaggaccatttaagagagtttgactaagaaagagctgtttgaaacctcctggcttatgtatttttaggggtgtggtgatcgaggctttctcctctgagtagagtttgtgcatttgcagtataagattatcattatcaaacattcctactaggcctttctcctcagcccctaaaaaaatatgtatagtaatgaagtaggaagatcatgtttatatttgacttcacaaattcctcaggctaagttgctttctactggggtgtggctggagacaaaaattacaggtaagacttgacttaatttttgatagggaggttcttaagaggctttttcggaatcactcacctcgcccacttccatgcagggatgtggtgagagcccttcagtctacttaggaaaacctggcacatggattccctcccagcccctcagagcccagcccttcatctgcaggagcttccgttgtctcacttaattagtagaaaccttttttgtcacacagccagttcagaataaaatttcacctatcccaacagaattcatatgcttatttactaaatagagtgcactgtgattcagcagtgaagtcctgctctctcgagctaacattgtggagggagaacctgtgaagggttaagcaaaatatctatgtcagcttgtgtgaagcactgtggagaaaaataaagcaggggaagagaatagggaatatggagtggggatagggaaggctgaaggggagttagtgggggcattcatgattaggtgacttgaacagagacctgaaggcagattgagggagcaggccttggaggttcctgaggtgggaacccttccagcagaaggagtggcatctgcaaaggtctgacagcaccagcctgctgcagggaggccgtaaggtggagggttcatggtacagtttgaggaccagccaggaggtcagtgtggactgactactcagagagcaggaggagctgaagtcagcgtggtcagaggaggtccagatgctgctgcagtgaggatttggttttcagtaaggtggaaagccactggagggcatatgcatttccaagggctgccataacagagtaacttagcggcttacaataacagaaattattctctcacagtcctggataattgaaatcagaaccagaagtctcaagtcaaggtgttggcagggccttgctcttctgaaggctccaggaagtctgtccttgcctcttctagcctctgctgggtgtctgcaatcctttgtgttctttggcttgtggcagcagaactccagtctctgtctcaacacatggccatcttctccctatgtatctgtcttaccgtgcccttcctgtgaggacaccagtcgttgaagttagggcccaccctaatccagtttgacctcatcttaacttggtaacatcttcagagatactatttctagataaggtcacattcataggtactaggagttgggactttaacatatcattttgagagacataattcagcccacaacagagagctttgaacagagggattgtgattcagcttcttttgtaaaaggctccctgggctgctgtgtggagaagggactctaggatggaagtcctttttatgtggtttctctgttccagtatctggcactgtcaccctgaagtggcagcgccagctttcagttatctagctacctaaactttgtgctgattgtgactttctcctctccctaataagtatttttattgcttagcaacttcttcgtaggttgcctagggaagtcaagttactctggtaatagactgcatgatggagctggaattattggtaaaatgacatcagcaaaaagctgatttggttttgctttaaattgatagctccatgctgtgcttacccagctgagaattcagcaataccctcaacttgccctaggctgcattttgccattgttctaggcagggacaacatgggaataggcaagcttatatactggagaatttgtgtgcgacgcatagctgtgtagcactctcagtgatgaagataacacttattcctcatagcttcccttttcttccgtaaagattggcagatcagaagggagattttgaagcttgaaagaactatttggtggcctttccatcaaatttaaataaagctcataagacacatgttaaggagctgtttgaaagcctttttgaattgccatcagcttgggcggcccttcctcatcgttttgtcagctgctagactgattcatcccgccagattctttgccaattgaatagaggcctggatgacctaggcccccaaaaccacagagacccaattgtttggtccttcctgtaccagtgactctcacatttttttcattctctctaaaaggaaaacttttaaatgtttatggatcatgaaggctctatggggtagttcatgaatgcagactgtaattgtaggggtagaggagtgtccagtccaggaaacaaccctgcatattatgaaggctttcagtttagggtctttaaacaataggatgattgctcatcaacctggtcgtaccctgacttccagggtccttgggtgcaacatccggagctagtccagagtaccgccaatggccttgtcacacatacacagcaaatgtgcaaagacagccagagcacaggtctgcctggagaggatttcagtgggcagaaagcccttcagagtcatttcatattgaagtttaatttctgggactggataagttccctttctcccaaaattattgattgttttgttcctggtaaagatagtctttcatacttttgtggttccaagacatggttggaccgcagttataaattatataagactaaatcattctggaagaatgatttacgaggagttagtcaggagttggagttgaaatatgtaaacattctggcttcctggtacataatggccctcaaacgtgtgggctacatttaccatacccatggctcctgtgctgacttctgtatagttctttgaactcagggaaacatctaagactattttgaaatgacttttcttatactggaactgctttaggaacttgcagtatctaaactctataatgactcttcctaagagttgtatgccaggagttaagtggcggataaggttgtagattttttttgaagccacatatagaagcaggttttaggcttactggtaaaataaaactctagctaaagatatttcctggaaataaccagactggtagctgtaaagcttgggctggtctgtatttgctatctgtctgttttctcccactaaagttgtttaatgctgctgctgttgtggtggtctttctctttgctgggaaatatattggtgaagaaacatcctctaggaatggacttttgaggaggtacaatctcaagttcatcctctgttttgttttgctttgagacaggatctatgtctagactggagtgcagtagtatgatcatagcttactgcagcctccaactcctgggctcagatgatcctcctgcctcagcctcctgagtagctgggactataggcacacactaccatgcctggctaattttttgttttgttttgttttttgagatagagtctcgctctgttgccctggctgaaatgcagtggtgcgatctcggctcactgcaagctccgcctcctgggttcacgccattcttctgcctcagcctcccaagtagctaggaccacaggcgcccaccactacgcccagctaattttttgtatttttagtagagacggggtttcaccgtgttagccaggatggtctcgatctcctgacctcgtgatccgcccgccttggcctcccaaagtgctgggattacaggcgtgagccaccacgcctggccagtttttttattttttgtagagatagggtcttgctatgttgcctaggctgatctcgaactcctggcctaaagggattctcctgcctcaccctcccaaagtcctgggattacaggcgtgagctaccatgcctggcttttgtgtttgcatgtgtgtttatggaggacttaggggttgtggctttgtgtagctgtttcagtcacaaaaactgcagtgggtgccctctgccccttgagtttctccttcaccaacatagccccccttccccaaacacacacacctttatctacagattgttacctctctctgagaaagagaatcttaattagtgtagaagctctcacatcacccttggaacaactcgttaaacctctccagtttgatgtgttaattaaatgcctaggtatttcaaacacaaactgtagttctctggacttttccccagaatagaagaaaagagataaatgggatctgtgcacagatatttactgcctcaggcctgtgagggaatgccaagttgtttgttgacacaattttggtagtctcgatcagaatcagcaaactgtgactcatagaccaagccctgcctgtcctgtttttttgcatggccctgaacagaagaatgagttttacattttttgatggtttaatggtgatgtgtgaaaataatgtgaaatccaaatttcagggcccatcaatggtcacacgattatgtgaatttactaaaaaccattgcatcatatattttaaagggtggactgtatggtttgtgaattatatctcaataaagtagttcttaaaaaaaaacaaaacaaaatttcagggcccatcaagttatatatatatgaaatatatattttggtagatatggggtcttgctatgttgcccaggctgatcttgagctccagggctcaagtaagtgatcctcccacctcagcctcccaaaatgctgggatttcaggtttgaaccaccactgtcatccccataaataaagttattggaatacagccatactcattcattcatgtattgtctatggctgcttttgctctacaatagctgggttgagtacttggaacagagaccaaatgtctggcaaaagtctaacatatttactatcttgtacagaaaaaaaatgtcaacctacatctatacttattacaatttcagtaaaaatacagagtttaagtaatttgggaaaatggctttaagaatgaaaaggtgcaaggttatacctgctgaacaaatgaactgtgggcgtgaggtgccattagtctaggcctgcatgttcagggaaggcccaggggagagcctgatgtggcctggctatttgtcatatttgcaaaggggaagtgatgtaattggtctgcaatgaacttgattttcaattgactcaaagatctaaggaggaataaaaattatttaaaaaggaaattagggaagaatggggagaatattggaatcatttaatagaagtacaaacacatagacttttaacttttgcccattaaattttttttaacattttattttcttaaattttttttaaaaaaatagtgatggggtttcactgtgttgcccaggctggtctcgaactcctgggctcaagtgatcctcccaccttggcctcccaaagtgttggggttacaggcatgagccagcctcacccaacccattaaatgtctttaatgtaacttcgggtgtatgagaatttgtaagttgactgtgcagatctcttaaaaggttgatatggtgtatttttagaatgttttagactgcacgtgtgtgtgtgtttgtttgtgtgtgtgtgtgtgcgtgctatagaaaacacagcatggaaaccttgttaaaatcagaggctttgattttttattctaaagctttgagttatatgtttaatcagatactatgtgaaaaattttcattaggtacatattgaagtgttccattcaagtctacaagtatatcctcctaaggatttagtttaacatcctttccctgctccaacaagggaatgctttattagagtttcctagaaataatgggactaattaggacctttcatattacctagtccagcagtccaacccatgtggctccttcaacagcatcgcagcctaatgcttttaatttaattttaaatttttaatgttttgctgtgattgcctcttccacagtttgatttttttgtactgtataattccatgttaaggtatttaaagcttgaaaatcttagcatgatatagctactttgttttttcatgtatttttagctctgaagttggagattccaaccagctaataaatgagatcagagtcatgtgtttttttgttgttgttgctctatcacaatgtaaatgtgcccctaggaagcacctgcttctatatggtgccttacccaagggagtgtcttcctggggaaaaaagtgtagtttttccagcagaaacttgtgagagtgcagaaccacagaggagcaacagtgtctgaataaaaaattccagggcagggaagcaaagtctacctgcagaaaggaaagattttagtaactatcaaatcacaatttttcttttaagatgagtgacaaaatcaagaccttgcactcccccattttgggcttacccaagcatcgaataaagcagtagaacttactttggtacttgcgggtggcagagacactttctacctgtgtatgtgttttgggagccggcagtccttctaaaattatattgctgccatgtaatgtcccacctacaaaatggatgtggcctaaagccatttaaacatttaaatgaaagagcagttgcagtgtctttttcaggttaccagttatactgcccagaggaaatcttggagggtataaaccattttgtcacactctcctaaatccagagtagcgatgggagataatggtttatccacccaaaacaaccctctcagtggagatttcataaccaaggttgctaaattgcctggtgactattaaatctgggcttagaaaggctttgctacttgtgagttcaagatctcaccctcacctttgcatgtacatgacctaattttatgagttcaaacaaacatgattagatccccagggtttagattgatgatggccagactcacaagggaataataataatggcatggagtattttattaattcacaaatgaaaaatgtatcttgacagtttggcagatgcagatactctcctagccagtcgaggaccctctttcttatatcatagctggaaatatgacaataaatgattgatctccagctttcccattacaatattcccacctagcagatcaccagctatctgtttcagccgtatttatttattagatgtgttgggaacaagtaatctttgtttgcagcatcttgtttgatttttatgaccatgattctgcgagataggacacaagtgatttccatttcacagattgggaaattgaggccagagcctttactgctagtagtggacctgggttttgaattcagcttttaagattgcagatccagagctctttggaacatattatacagcttttctctccaggaaatttgtgaatccctctctgttgttcactatctgaagagaagacatatcagaggaaataaagggtcttaaaatgttgccagagcagggtgtgtgatgggggaaagcatcgtcttaagtatcctgtcatgtgatagtagtttaaaaaatcaaaaaatacatcttccacatgtgtgaacttggcacatattattctgaagtatgaaatgtattttaggaagttgaaacatcagaagtttggaagcttgcagcatgatttagatataaattaatagtcaagcaaaaatcatcactggataagtgcagtgggattgaaaacattttgcttcctcaatgcctagcttcagctcatcagtgaaaaataaagaaggagtagacaaattcagtactagcctttgcattctgtctccacctgagtcatgcatggttgagaagaggcaggtgtgtggaggtgtgtgcggctgccaggggctctgcgcctgttttatggtagatagaggagtttttaagaggcctttgttggtgatctctggctgcataacaaattactccaaaactgaaaacaacgaacatctcacatagtctttgtagttgggaaatttgggagctgggtggtgtggctcaggtcacttttgagaatgctgtcaagatgtcggctgggactgcagttgtttaaagacttgactgaggctcaagaatcctctcctaaggcggcttactcatttgcctgggctgtgagtgctggctgttggtgggaggctgcagtcctcaccatgtggaccactgctgggttgcttgagtatcctcacagcatggcagctggctgccccagagtgagtgatccaagagcaagcaagatagaaactgcagagtcttctgtgacttagcctcaaaagtcacacttatttccacagtatccttttggttacacaggtcagtccaagggcatgtgtaccaggaggtgagacatataggggccgtcttggaggctggctaccacaaagcccttttccactttttaaaaaacttgcatgaaaggatatacaagggtatacattcttagatggcaaagcttttcccattgctttcttcctttggcgtctcttcactatgcccttcctaaccccactccttcttgctgccctctttcttaaacaggagcagaactggctgaagaaattatatagccgcctattggcttgtggtcctgccatggatgtgtctcatgcacccagcatgctggctgagattgctctgtctggaggcccctctcttgctgaacattcctccctcttcttctttatccagcatcagcttctcagctccatgtgggtggttgctactttgtgagagaggcagttggtattttgaattttccagtaattatttctgaagagatgcacattatggttgtttggcagcaacagattgaagttacacaatcccagatctctgcacaggagccccatctgttagcacgtgctctttccccccttgctcttcctgccagaataggttggggatgggggagaagttttgtggggagggccttctatgatttctgtctgtggaaggggatttctactctgtctaaaatataacctcaaacaaatccagatggttccagaacccatgggcatctcatgagtgagaagagaagacacattcattgctggattggcttctctggaggaggctttggcttcctggtgggtggacacttcctgataagcaagtcccatcctcttaccttataatcttggcctttagagatacggtttgggtctctttttatttttcttccttttttttttttagagacagggtcttgctgtgttgcccaggctggagtgtggtggtacaatcatagctcactgcagcctcaactcccagtcttaagggatcctcctgactcagccttccgagtagctgggactacaggcgtgtaccactacacctggcttgggtgtctttttaaataaaatagcataaagtgctgttttggaaatttgaagtgctttcttcatccttagtacaaacttttttcagtttaccaagtggttttccagattattctttacctgtagagtcttaggttttagggggagcctctctcaggagttagaggcttatctcaggagaacagcagtgtagctggtgccctgtctcttaaaaaagcaatgaaatttgccctaccgtgacttctgggtaatgtttttgtttgggggttttttggaggttaggaaggggtttaaacaggtagtttgttgtctgggttctgcgtgtgtgtgtgtgtgtgtgtgtgtgtgtgtgtgtatgtgtatttttctgctttggttggtgagacagcttaaaactatgatgtacctaagaggatggtctgccttgactcacccactcagaatcccgctgacccacccctctcccatgcttccggggatcctgggccccagcagttgttggggaaatgtgagctatgcagcccatacccttagattgtatcccgcattcctggaaaagggcctattgtacggttgttccaaccctggacaataaattgtgtacttctccattttaaggctgatgactaagtgagaacgaacatatataaaatacacttcaactttggaggaatcagagagactgggaacccaaagacatgaaactgggggaaaaaaacactcaaattttggacttttagcattaatgctaatatacatctgattaacagtctcctcagggcagaccacttgagcagaaagggttggtgccagaatcacgcttgtttccctcctgaagcccttgattcagtgtgggggaggagagctgggagggcaagaccaaggcacggaaaggaggagtgggaccttcagggcaaagggccaagggaagagctatgccaagccatcccccagccgttagcctagagctgagctgcggcatcactgaacaattagctaggccttctcagtatgcgacagatgaggtgaggaggagtcctttatgtatcagacacttgccctgcagtgggcactgattgagcatcagctctgtcttggacgctcagtttctgctcccagggatacaaagagtaaggcccctgtggggctccgagtctggagggagctagccctgtcctgtttcccagacctcttggccgccttggcatcccaagaagttttagcagcaaaagatagggaatttgtgagggaagaaattcccccgcaaatctggaggtcaaatgttaaaaggaagaaggcaaatgttaaaagttagaattttaaaaatccccctgcccacaaagtaaaaaaagccttttgggcttgacaattataactctaggatgtttcatataccatacttggctacatctgttgtggaaaagagggatgatgtcatttttttcacctctttctgtaaatagaatttatgtagcacatgtgggcttcctcaagagaaatttaaaaccccaaattgatgggatggtgagacctaccacctctctcaagcatgtgtctctccaagtgacacacataagacactatttaaagcatgtactttggatgtgtgtgctggctcactcctgtaatcccagcactttgggaggccaaagcaggaggattgcttgagaccagcctgggcaacaaaatgagaccccgactctaccaaaaacaaacaaacaaaaaattagcagggcatgatggcttgtgcctttagtcccagctgctcagaaggctaaggtgggaggatcacttgagcttgggaggttgaggctccagtgagccgtaatcgccccactgtactccagcctggacaacagagcaaatctgtgtggtatagttgaacattttactagaaatcacaggacattcctcctgctccatttccctcgggtctgagcctccatgttcttttttaaaaatagttttattgagatatagtttacctgccatacaattcaccatttaaaagctttatgatagtttttaatttatcgacagagttgtacaactattatctcaatttaatttttagaacattttatcacccccaaaggaaaccctatacccattaggtgtcacactccattcctcttccttcccaccaccagtcctaggtaactgatgatctagtttgtgtctcaatagatttgattatctaaacgtttcatgtaagtggagtagtagaatatgtagtcttgtatgactgaatcagttcactaaccatgttttcaaggttcagctatgttgtagcaagtatcgggactttattccttttttattgttgaacaataccccattttattgatatactatattttatttacccgtttattggttgacggacatttgggttatttacacttttggctatgatgaataatgctgctatgaacattcacatcatggatttatgttttcatttctcgggtatataactaggagtagaattgctaggccatatggtaacttcatgtcaaacattttgaggtactgccaaactttttcaaactggctgcactattttacatttctgccagtagtatttgagcgtttcaatttctccatatcctctccaacacttcttattgtctgtctgtttggttatagccatgccagtaggtgtggagtagttttgatttgcatttggttttcatttgcatttccctaatggctgatgatattgagcaacttttcatgtagctattgggtatttgtatatattctttagagaaatgtctattcagattctttccccactttttaattaggttatttatcttttttatcactaagttatatattctagatgcaaattccttattagatatgtgactaaatattttcttccattgtcttttcatttcttgatggtgtcatttgaagtgcaaaagttcttaattttgataacgttcagtttacttgttttgtctcttatgccttgatgtcatgtataagaagattttgcctaacccacaatcacaaagatttacttctttgtcttaacagttttatagtttgagctcttacatttagatttgtgatccattttgagtcagtttctgcatatggtgtaagggagtagtctagcttcattcttttgcatgtggatatccagttgtcccagcaccatttgtcaaaaagactattcttttccctatacaattaactttgcacccttgtcaaaaatcagttggccataggtacaagtattgatttgtaaactcttaattttgtttctctgatctatatgtctctcgttatgctggtaccaccacactgtcttgattactatagctttgtagtaagttttgaaatcaagaagtatgaggcctccaaatttgttcattttttcaagattgttttagctattctgagtccattgcatttctatatgaattttagaatcagtctgttaatttttgcaaagaaggcagctgggattttgatatggattgtattcaatctgtaaataaatttgggaagtattgctgtcttaacaatattaaatcttccaattcatgaacatggggtgtcttccatttatttaggttttctttaattgcttcaagcaatgttttttgttgttgttgtttgtttgttttttgagacatggtcttgctgtgtcacccaagctggattgcagtgatgcaagcatggctcactgcagcctcaacctcccaggcttagacagtcctgcccagcctctctagtagctggaatcacaggcgcatgccaccacgaccgggtaatttttaaattatttgtagagagagggtttccctatggtgcccaggctggtttccaactcctgagcttaagtcatcctcctgtctgctgctcccaaagtgctaagattacaggtgtgagccactgctcctggccttgcagtttttatagtataagttgtctcagtccgttttgtattgctgtaaagcaggggtccccaacccctgggcctattaggaatgggccacacagcaggaggtgagcagcagggtgaacgagcattactgcctgagctccacctcctctcagatcagcgatggcattagattctcataggagtgcgaaccctgttgtgaaaggcacataccggggatctaggttttgcactccttgtgagaatctaatgcctgatgatctgagctggaacagttttatcccaaaaccatacccctacctcccatctccccggtccatggaaaaattgtcttccatgaaaccggtccctggtgccaaaaaggttggggaccactgctgtaaaggaatacctgaggctgggtaattctaaagaaaaaaggtttatttggctcacaattctataggctgtagtagaagcatggcacaggcatctgtttctggtgagggcatcagggagcttccaattatggcagaaggcaaaggtggagcaggtgtgtcacatggtgagagacgagaaggagaaagagagaaagagaaaaggaggcgctgggctctttaataatcagatctgaggagagctaatagaatgagaactcactcattaccttcaggacagcaacaagccgttcatgagggatccacccccgtgacccagacacctcccactaggcctcacctacaacactgggaatcaaattttaacatgagatttgcaggggacaaatatccgaactacatcaacatcttatatttcttttgttaaattatttcctaaatattttattttttgatactgttataaatggaattgttttcttaattttttttggaattttcattgcaagtgtgtagaaatacaattgatttttacacattgatcttgcatcctatagccttgttggtttcatttatagttttttggtggattccgtaggactttctatatgaaagattatgtcatctgcaaatagagatagttttacttcctttccaatagggataccttttatttcttttcttgccagttaccttggttaaaacttctagaacagtgttgagtagaagtcgcaagagctgacatttttgtctcgttcttgaccttagggtgaaaacattcagtcttttatcattaagtatgacgtcagctgtgagtttttcataaatgccctttattgaggaagttctcttctagtcctagtttgcttagtgtttttatcataaaagagtgttggattttgtcaaatgctttttctgtgtgtattgagatgatcatgtgtgttttgtcctctgttctgttgattgttgtgtattatattaattgattttcagatgttaaagcaaccttgcattcctgggatagatcctgtttgtttgtggtgtataatcctttttatgtgttgctggatttggtttactagtattctgttgaggatttttgcatctatattcaataaaagatgctggtctgtagtttttttttcccccttgtgattcctttgtttggttttggcaccagagtaatattggcatgatggagtgagttggaaagtgcttcttccctcggtattttttggaaaagtttacaagcaattggtattaattctttaaatgtttggtagaattcatcagtctggtccaggtcttttctttggaggaagttttaaatttaccagtttaatctctgcctgttttagattcattcagattttctgtttcctcttgagttggtttcagtagtttgtgtctttcttggaattgatctattttatcgaaattgtctaatttgttagcttacagttacttatagtattttttcttattttttaatggcattaataagccctactgtgccttttacacagggttgatttgaggatcaagttaggtaatgtttatggaagtgctttgaaggctatataagtatgaagtattttatttgttctaaatttttaattataggaaaacagttgttctagaacaaattttcattaaatttctttgcatttttcacactcaatgtcaagagtagcccactgttagcactgttgcaatttttttttttctttttgggatggaatttcgctcttgtcacccaggctgagttcagtggcgccatcttggctcactgcaaccctccgcctcccgggttcaagcaattatcctgcctcagcctcccaagtagctgggattacaggcacctgccaccatgcctggctaattttttgtatttttagtagagatggggttttgccatgttggccagcctggtctcaaactcctgacctcaggtgatccaccaacctcggcctcccaaagtgctgggattacaggcgtgagccactgtgcccggcctgttgcaattttttatttttcagatgggttctcactctttttcccagcctggagtgcagtggcactatcacagctcactgcaacctcaacctcctaggcttaagcgatcctcctgcctcagcctcctgagtagctaggactgcaggcaaacaccactgtactcagctaatttttaatttttttgtagaatcagggtctccctgtgttgtccaggctggtctcaaactcctgggcccaagtgatcccccctacttagcctcccaactgtctacagtttatgaagttaacatttgtgatttgctcctcttttgtgagttgcacttgaggggagagattattgcccttgttaccaaaggaatatgaactaagattgagttgaaagggcaattaaagtgatttttggacctatttccctatttcttgagagatagcagaacatagatcctatagtatcaggctcaaagggcatcagtgccccattagaaagtcatctttgggctctgacccatttgttcctggctagcattgagagcagctgtttcctttcctccctgaggaatcactgagcgtggtctattctttggcttcctaacctctctcatagcacataccttagatgaattatctgcattcccacctcttcccagcttacttctaagtcaataataaaggtcctttaaaaacacaaatcagttggctttcaaaaataaagcatcattttttctagagctttcttcttttgctgaatacgaaaacaaatgtaaaaaggaagtaactcattgagaaagggaagctggtgacacaggaaatgactcctttaaaagcagaagtccagctgcagggttttctgtgcaaatgtgttgtgggccttgaggtggcagtcctatgaggcggtggtagggctttcccctgattcagtactcagctggtcccaaggggctttgagtgtggcttttgcctccttaactggatgctgaataggctccttgcacttattttgggactccgttgtgcctgtgcccagcacagggtgtgctgctggtggtaaggacctgtgcttggttggttggttgcttggttggttggttggttggttggtgatctgagaagataactctgtggttcaattttagggcttcaggtcctggcaaaactgccagtttaaatgaattacagagtgccgacattgaacatctggtttggatctttattagaatttcttaatactatggcttacagtcaattgcttttatatgtttgtaaaatttcaccattagtgctgagccttccaaatttgtggcatcctttgtgtgtcttatgtggcccttagtggcagagatgcacacttggggcttggattcagcaatctaggccactgccttggtaaccagggcttctattctctagttgtcagaggcttgcttagtataagacatattgcaacctgggcagttgtgtgaagctgtgaggtcacctccactaatgaggacagagtagaggagcgaggggataattctatctgtttgagatacctggccccagtgtggtcgtgtgggttccctgtctgacttctgggtgctcagaagcatggccccgggggtctgtagagacatgccatctgcttccatcctggctccatgcctgcctgctctcagtggtgtgacagtacagagcaatgaccttgactccgtcatgccatcagcaggaaccctggagcccttccctggtttatggtccacttgggttttctcaggttcatcctgtgaatgaagagaaattggatgaacgaagatagctctagaattaattgagggggggctctctagcatgattgagtcatggtctgcctgtgtgtgtgtgtatgtgtgtgtgtgtgagagagagagaaagagagagagggagagagagagaaaataaattccatccctctgtcttgggaggagaaagagggatggggctggctaggttgaggatggggtcctgtgatgaaatggaagcagaggagaagtgggtagaaggggacttggttttgggtaagaagatatttttgtgcttgctaagaaggattctaggcctgtttcttactgctcagtagactgtgttcatgtatcagtggctaacctgtacttgtggaatatgcggttctcttctataccagttctctgattctccagccccagctgggttttcaaaaactcagttctattctgatacttacttcctcgagttagcctcagactccacaggcttaagggctcaatctcacaaaactgctctcgcttcagatgctaattgcaagtcccagatcccagtcatctgcacttgtgtctgacttggctacaaattttggagttttcataccctcatccaggtttgataattcattagaataactccgagaattcaggaaaatgctaaagtttactggtttgttataaaggatacaactcagaaatagccacatggaagagctgggtgtaaggagtgtgcagagcttccatgccctctctgggaatgccattctccatgcacatctaagcgtttgccagcccacaagctctctgaagctcatacttccgagagtttttataacttggtcttcagcccccttcccttccccagagatggaggtggagagggctgaaaattcccatcttctaatcatgcatttggtctttctggtcgtcagcccccatcctgaagccacttggatatgagatattgtttatgtgttttgaggtcagaaagagagccagcgtgtgtatgtgagaatacaggagacttgtccaaattctggcagctttctcaattatatgtcagctgtctagaaacccgtaaaaagggctgtctatctaaaggagaggaagtggtggacgaatctgaaaggagctcttagacaatgttttgccatacagttaaaatctgggagggaaaagtcaagcatagctgagaataatgccaaatctgaagtgttaatgcacattgttttccaagtggttgctgttttatctcttcttaaatgagattctacatgtaaaagcagctaaccagttgattctcagtatgttagctgaatacatttctctgaagtttcaaaaatattttgtgataacatttcccctcttctaagactttcaagttttttcatagatttgaattttaacccagtatattttcaacataacagggtacaaactagaatattaagctgtttccctcaatccttaaaattttgcattccataccttttcttttaaaaatacagagagggagagaactctttttactgcaaatagtctttatcctgaataagcataaaaagcatctactgtttaagatcacccgtgggcgattcacacaaccttttagatttagggaaggctgactattgaaaggaagagtttcattaacagcaacaaatgggccagaagtggaaattttggtctatttgtggatttcctctgtgtttgcttttaattcatctactgatctaatctctgtctgtattcaccaagccgccaggcaatgctgtgcttgtcagaatcaaactcatcaaactccttctagagagagagcctttcagtgccctggaagaaggtttttagggaacacaggatttctgtaaaaatggaaaggcacatgaaggtaggttagttacataacagtgctttcagatgaaaagcaaggcctgacagctgtggcccaaactcttcattatgggagattgggacctggagcctactgaggatctgggtatgtaacttcttataaaagtgacttgtggtgtgatacttgaagtttaggttctttcctttcctttttcttttcatttcccagggacttgctctgttgtccaggctggagtgcagtggtgtgatcatagattaccgcagcctccaacttctggactcaagtggtcctcccatctcagcctcctgaatagctggaactacaagcatgtgccaccacacttggctaatttacttttattttttgtagagatggggtttcaccatgtttcccaggttgatcttgaactcctgggctcaaggaacaccccctactttggcctcccaaagtgttgggattacaggcgtgagctgctggtcctggcctagtgttttagggcagcactaggtatatggggttagctggtactgagacacttgctgatagtgtaaatgcaaatagaatcttacccaaacataccttttcaagttatgtggttagtttgtttttctctttttttttattctcagggctccccaaactggtttaagtaaatgagcattcttctcccacccaccgcctctgcttgtttggaccttctcttggtgactgaagatgccagactgagatatggggtctgcagtgacttggtatagggctgggcaagtttatttacctggcacctgccccgagctggccaagaaatgactgggccgggggtgtattttcagtggagttccttcagccctctgcccagcctggggactgagcggggtggtgtttgttttccttctgcattccaccatgacagggccatgcgttttacaatgtagcagataaggctccctatcactgatgctaactttgcataaatctcttgattcccagctgcttgactgatgtaggaacacaagtaccagtgagaggagcatgtgggggtgaagccatctcatacagtactacccttcctaggtgtagagtgaggagatgtgccacggctgttgacccttcttaaactgcagagcgtttgatgtccagggacagttgttggggcagggtcagacttagagcttttgtcttgtgctgagatgtgctcctttttctttcctcccccttccctagctcttggacggctttgccccatcactgattggtgcacacccccttttgagaatctcagggactcagtttggtaaaagcagctggtggagatgatggagagaggaggaagactcttaaaggagtgggtatatgtggaagaatgagggaaaggccctgtccttgtgttatggagattagggtagaaatagaaagctaggagagagtttggcaaaaggtgattctcatagactcctttctttgggggctgtgggactgatggtgaaggagtctgggtaacaggaaaaaaaagaaccccaagaggtggatgagtgtgggacctacagaaggaggggaaaagggcttctcagctcctgacagctgagtgttggtagcgctttacttcccttccctttaacccttaggttttctggaagctgtagggaaagaacacatagccctggatattctggctctgggatcctatgaaggagaatggtagtaaatgtttaggagtccatgacaaaaagagtgggagagaaattatgtaactgtaaaaaaactttaaaaaactaggatccgcttccaacactacatacaaaagtagaacttctatttccattgcccagataaaggactatcaagattttgccatacttgcttccaccatcctctttttctttttttcttttttttcattttgttacttaggtatttttaaaagcaaattccagatatcatgtcatgataccacctatgatcatgtcattatacctgtgatgtaattatcaataatattactcttttaatttaaaaatatatttaaaattcaggttttatcttacattagattcatattttttaggtaaacttttttttaaataaacttctggctgggtgcagtggctgacacctgtagtcttagcattttgggaagctaaggcagaaagatcagttgaggccaggagtttgagaccagcgtggacaacataataagaccccatttctacaaattcttttttttaattagctgggcacactggctgtatgcctgttgtctcagtttctcaggagggtgaggcaggaggattgtctgagcataggaggttgaggctgcagtgacctacgagtgctccgttgtactctagcctgggtgacagagcaagaccctgtctccaaaaaataaataaatatttaaaatttaaaattaggatttaaaatatgttaaagctcaaagatgaaagtgtagaatggatatcacttattattatgtagtattcagtgtgaattacgatgatcacatctatatccatggctctggtgatgtcaaatattattcccagcccagatttcttctctgaacatacttctacttattcaacatctctgcttcaaaatcccaaaacaggccaggcatggtggctcacacctgtaatactatccctctgggagactgaagtaggaggatgatgtgggcccaggagtttgagactagcctaggcaacgtagtgcgaccccgccatctgtacatacaaattaaaaactagctgggtgtggtggtgtgcctgtagtcccagctacttgggaggctgaggagggaggaaaagttgagcccaggaggtcgagattggagtgagccgggatcacgctacagtattcaagcctgggtgacagagtgagaccctgtctctaaaataaataaagtataacaatgtatttaagctatgtttaaaatttttttgaaatgaaatatggaatgattaaaaaaaaaaaaacctgaaacagatctcaacatgtccaaggctaaacccatggccccactccaacagtccccaagcattcactagtatttcctgaatctcactgaatggcactagtcttctagtttcaaaggctaaaacttacaaatcatctttgctacctcctcctacttcagtcctgtatccagcttatcacccagccttatcagtctcacctcatttcctctctagagcataacttctcctcctgttgtgggaagtcagggaccctgaacggagggactggaagaacataaatcgtgaagatttcatggatatttatcagttcccaaaattaatacttttataatttcttatgcctgtctttactgcaatctctgaacataaattgtgaagatttcatggacatttatcagttcccaaataatactcttataatttcttatgcctgtcttactttaatctcttaatcctgttatcttcgtaagctgaggatgtatatcacgtcaggaccactattgtacaaattgattgtgaagcatgtgtgtttaaacaatatgaaatcagtgcaccttgaaaaagaacagaataacagcgattttccgggaacaagggaagacaaccataaggtctgactgcctgtggggtcgggcagaatagagccatatttttcttcttgcagagagcctataaacggacatgcaagtaggagagagattgctgaattcttttcccagcaaggaatattaataattaataccctggggaaagaatgcattcctggggggaggtctataaatggccgctctgggagtctctgtcttatgcggttgagataaggactgaaatacgctgtggtctcctgcagtaccctcaggcttactaggattgggaaattccagcctggtaaattttggtcagaccggttctctgctctcgaaccctgttttctgttaagatgtttatcaagacaatatgtgcatagctgaacatagactctcatcagtaattctaattttgccgtttgccttgtgatctttgctttgccccttgccttgtgatctttattggcctcagaagcatgtgatctttgtgacctactccctgttcgtacaccccctccccttttgaaatccttaataaaaacatgctggttttgcagctcaggggacatcatggacctaccgatatgtgatgtcacccccggcggcggcccagctgtaaaattcctctctttatactctttttatatctcagactggccgacacttaggaaaaatagaaagaacctacgttgaaatattgggggtggattcccccaatacttcctattcattagcatcacccttgtcaaagcccctagaataaaatactagcagtttcacatgttccatttttacactctttaatccttttccacattgcaactggggtctgttcaaaatataaacctgagtatattctctgctgcttaaaaactcatggcttcctgttgctcttagaatagaaccagattcttgacaaggcctgcaaggctctgtgagcatggtgcctttctatttcccatcctcatttttccccttcattctttcagtattatttaatcaatatctctctttcctgctagtctctaaactgcatgagaacagagccctcctcttttttgcttgctgttacgtccccagtgccaagcacagagcccagtacataaaaatacttaggtatttgttgaatgactgagtgaacatgtgagtgaaatggaggggtgaaccattcctgatggatagggagctggcttctctttgcactcattgcatgattgtttgttttctcttatattgagttgaaatccactttcctcttaatagttgtgcatatgatccaaattttttccctttacctcaaacgcccttaaaatttttgtagactctatcatgtttcttagttttctagactaaatatcttagactaattgtttacagatacaccaccttgatccacattcctctaaggacgtccatttttgttcacaatttttttaagatgaggagctcagaactgaattcagaatctaactgaattcacaatctcagatgttatgtgatcaaggagactacaagaaactgttatggccatgaagagatgaatttaacatatggtttagcacccaggccttagagtttcgacagatttggtaaaatctgtcattagtggtaaagactgatgtcttggttcaataagatagtcccggtgagctcttagtagcccattgcctagtccatccaaaccctcagtgcattttactcaatcctgttgtcattgatgtttctgtttatctgttaataggatctgagattgcatatgctttgtgctcagttatgccaccatgggttgtattgagttgcaatcacatgttaactccaatcacatgttagaaaatgttgactggttgctcaggtaggtctctcatcctgtacttatatgcaggttttctcttcacctctgggctccttgaagacattgcataggacatggttgtaatgcccatcctttcatatcagaagggtttatgtgtttgtctctcgttaggtgacatcagttgatctcagaatcttgggacttgagttctctgtgcactttagtttgaatacatttggtctcggcagaaatccactcacactagctcaaatatgtatacatcattgagaaaggggcgtttcatagaaattaagctggggcagtgtaggtaggcctttgtgggcattgaaaagtcctcaggtacctccattctctatcacttgtccactgggataggatggtcttctgtctttattttatcctgacctcagcctcctacagatctacttactgtcttaattcagattcttgagagagagaatctgttatttgtgtcacttggataatcaaatagaacttatttaggaaaagactaagtagaacaagggtctactgcagtatatctgatgtgatattaatattctgtaggtccagaggagccattggacatcaacagcttaaatgttagggatgcaaatgggtactgagttcccaggcacagtctgatagtttcagggtcagaattttatgcagtgatcagatttgaatgtttggaagttaaaaatacagtcattcaccatataatgatgttttgatcaacgactgactgcatatatgatgtgatcatgtaagattataataccatatttttactgtaccttttctgtgtttagatacacaaatacttagcattgtgttaccattgcctacagtattcagtacggtaacatgctgttcaggtttgtagcctaggagcaataggctataccataggtatgtagtaaatataccatctaggtttgtgtcaggtacactctataatgatcacacagtgacccgcacaatgatgaaatcacctaatgacagatttctcagaatccgttgttaagcaacacataactgtattccctattccacagaacagggtttaaataatcagactgtttcaaaaataaatggaaaacctctcatgtctggcctagaatcacctctctatagacagaagtactaaaagaaccaaataaaaaatccattggaaaacaaacccacagcaaatgaaaggaggtagttcttgtcctaacatttaatataggctaattagtttatgggtaaatacagtttataaattgtacacaagaaaatacacatgtaataccaatattttagaagtagaatttttatttttagcaaatccatcatgatttacttaggtaacaagttcttccagtatatcagtttgatttatagtaaaatgtagtgtaaaatagttttctagatggagaaacagtggctccggaccatttcttgcttgtcagcatatggaaagggtggctctcccaccatgccacaccatccactcctgctgggcgcaccaggataaagatgttaaaatacaacctcttgtatagggttttcaagatctgttacttagagtgggatcatctgtggtacaactgagagatgctgaagttctccttaaaaggtcacgtgtattaagttcctagaacgcctgttcatctccacttatttccatatcaccatttttagagatgcacttcccactttaaccatagttttcaaaatcttaaggcagtggaaccttttcctcaaaaaacaaaaattatgtggactctaacatataatagattttttgtttgtttgtttttttttgagacagagtttcactcttgttgcccagactggagtgcagtggtgcgatctcggctcactgcaacctctgcctcccaggttcaagcgattctcctgtttcagcctcccaagaaactgagattacaggcatgcgccaccatgcccagctaattttgtatttttagtagagatggggtttcaccatgttggccaggctggtttcgaacccctgaccacaggtgatctgcccgcctcggcctcccaaagtgctgggattacaggtgtgagtcaccgtgcccggcaatgtataatagattttaaggtgatatatattatagttgtaaagattaaaaacattagttttaaaaacagtgggatttgtgagattgaaacatgcaaaataactaaatcagagtctaattaaaaactaagccggatgtggtggcatgcacctgtaatcccagctactcaggaggctgaggcgggaggatgacttgagcccaggagttcaagatcagcctaggcaacgtagtgagaccatgtttaaaaaaaaaaaaaaaaaagaataaaatttatttcagtagtgtttggattacatgttattgaaagaaccttgatttatgcaggtcagtagttgcagataagtttttaaataattcagcttagtacctgagagcgtgccttaattaaactattccaaaagtctgtaagaggagcagaggggaatttgtgtttcagatttgagttattaacaatatctaacaattcatccaatttattaattttatagatgtaaattttagaaatagtacataaagtggttcctcatgagtttaaatctttttggtagaaaatacaaaactaagatatttagaagtatcattttaaaaaaatctcagataatttagtgctgtgtctgttaaatagtcactgttaaaaggcacatttcctgttctggatgttctcagattctccagcaccaactgggtttccaaaaattcagttcatttcttaaactatctgtccttagtgcagaccccacaagttaaggtctcagtcccacgagactgccgccacttcagataccagtcacaagtctcagtgcttctgagcaactggctataaatttggggattctcataactcctcttctcagtttcagtaatttgctagaacaactcacagaactcaggaaaatacttatatttactggcttattgtgaaggatacaactcaggaactgtcaaatgcaagggatacatagggcaaggtatccccatacctgcaggggtgcagagcttccactccctctgggcacaccaccctcccagtaagtcaacatgttcaccaacctggaagctccctgtccctgtcatttaggggtatttatagaggtttcatcatgtaggtgtgattgattaaattattggccttggtgattgagctcattttccaccctttctcccctccctggaaggagtggggacggtgctgaaagttgcaaccctctaatcttggcttggtctttctggtgaccagcccattcccgcagctgtcaagggacccccagcacccagtcattcattaacacacaaaagacactctgaccagtcaggaggttccaggggttgtaggagctctgtgccaggaactgaggacaaagacaaaatacgtatttttattataccacctgtgttgaatctaaaaagctgacaataagcaccaaaacttaaaaggagtgataactatctaaaccttgatataatcaagactcattgttgtacaactggcctgtcttttaactgagccagttgtacatggaaacacatggatatttgcagccttagggtgctgatggcttgtttttagttgtctgcctccgcatcatcagcacaaagaaacaataacacatttataacagttcacatacatggacagagataatagactctgtacacataagtgaaattgtcagtacagtttaaaatgttcttgttaaaattttgtgtgtattgcagttgagtttttaaactttttatttatgaaaagtttcacaactgtatgacagagaaaatagtacaatgaaaactcccatatacctattcctggacaacagttaccaagattttgccatacttactatctcttttttaaaaaatccttttgaaatatgttaaaccaaattctgattatgaagcactgagacgttttaacacattttagtattaataatagttaaacatatatttaaaagaaaaattttaattggacatttgtagaatatctgaagtatgtttgtgaagtataatttgtaaaccagtacccaataataatcatagaagattcatgagaaaggtgtgtgaatgctttaaaaaagctattccaaatcccagctacttgggcagctgagatgggagaattgcttgagccccagagtttgaggctgcagtgagctgtgatcacaccactgcactccagcctgggcaacagagtgagagacccctaaaaaaaaaaaaaaaaaaaaaaaaaaacaggctggacgcagtggcttatacctgtgaccccagtgctttgggagaccaaggcaggcagattgcttgagcccagtgagaccagcctgggcaacttggctgtcctgtctctacataaaaaataaattaaaataaaaattagccaagcttagtggctcatgactgtggtcccggttacttgggaggctgaggtgggaggatcacttgagcctggggaagtcaaggctgcagtgagccatgatcaggccactgcactccagcctgggtaacagagacactgtgtcaagaaaaacaaaaataaaaactatagctatgatattccagtggtacttgactctgatcctggattaggattaggaagtaggattagagggtcatcttttaatttcctttaaaatcatgagatattataaccaattcactgagtttttctgtgctactcttgtttcagatatctacgttaggaaatcactttttgctttaacgaaattacctcattcacaccttcctaatatttgcagcacttatcctagtaagaccacaattaaaaaggatttttatttttcacaagtgatttagagaattcctggtccgacttagagacagaggttctaaagaaaaaataactttattgttttacaatttgtgtcttagtaaaataagggctatttgttttaaagccatttccatatctggtttttcaaattagctttcttatttggttcttttagtttttaggtctacagagagatgattctgagctggtcacagtagattttttaaatttatttttgaaacagtctttttaaattctgttctgtggatacatggctttttttttttcttcttttttttttctttgagacagagtctaggctggaatgcagtggcgcaatctcggctcactgcagcctccatctcccgggttcaagtgattctcctgcctcagcctcctgagtgactgggactacaggcgtgtgccaccatgtctagctaatttttgtatttttagtagagatggggtttcaccatgttggccaggatggtctcaatctcttgacctcatgatgtgcccgtcttggcctcccaagatacttatgtttttaacattcaaagattcagatctgttcactgcataaagttctgaccctgaagctgtcaggctgtgcttaggaactgtctcagcaccaatctgcctccctgcaccatagctgttggtttctaaatactcctccagaccagttttaccctacagaatgttaacatcacataataatacattgcagcagactcttgctctatttatcctttttctaaatagctcttttggtgtacttactattcgtatcacttggataatgcacatacacaacttgggataggaaaattcattttagggtgttgtgccagctcttctctttcaggctgtgctgccatccttcctgaactttagagatgcttaataaaagcaaagagggaagaacttgctatttgtttatatgaattcaggtaagagaggatacttaccagtgacagataattctttaatagatggtttttgtgtttcattttagaatcacaagaagctgatgaacagcttgtagcagaagtggttgaaaaatgttcatctaagacttgttctaaaccttcagaaaatgaagtgccacagcaggccattgactctcactcagtcaagaatttcagagaagaacctgaacatgattttagcaaaatttccatcgtgaggccattttcaatagaaacgaaggattccacggatatctcggcagtcctcggaacaaaagcagctcatggctgtgtaactgcagtctcaggcaaggctctgccttccagcccgccagacgccctccaggacgaggcgatgacagaaggcagcatgggggtcaccctcgaggcctccgcagaagctgatctaaaagctggcaactcctgtccagagcttgtgcccagcagaagaagcaagctgagaaagcccaagcctgtccccctgaggaagaaagcaattggaggagagttctcagacaccaacgctgctgtggagggcacacctctccccaaggcatcctatcacttcagtcctgaagagttggatgagaacacaagtcctttgctaggagatgccaggttccagaagtctccccctgaccttaaagaaactcccggcactctcagtagtgacaccaacgactcaggggttgagctgggggaggagtcgaggagctcacctctcaagcttgagtttgatttcacagaagatacaggaaacatagaggccaggaaagcccttccaaggaagcttggcaggaaactgggtagcacactgactcccaagatacaaaaagatggcatcagtaagtcagcaggtttagaacagcctacagacccagtggcacgagacgggcctctctcccaaacatcttccaagccagatcctagtcagtgggagagccccagcttcaacccctttgggagccactctgttctgcagaactccccacccctctcttctgagggctcctaccactttgacccagataactttgacgaatccatggatccctttaaaccaactacgaccttaacaagcagtgacttttgttctcccactggtaatcacgttaatgaaatcttagaatcacccaagaaggcaaagtcgcgtttaataacgtgagtgacagtgggcgctgggtgtcgtgctctgtgtcttgtctgttgagtttggcagccagctacttttggctttggtgaactgaatttacctttgaggtgcaccgaggttcatacaaagcttataatgttatcctgcagtcttcactgtttggcttaactgttgtgtggaatcagaaataccagaggtttccttttcagattgttgtcttttttctgaatccttagcttaatcagctaagctcttttcccttgaccctagagacttttttatgtttaaaaaaaatagaccagtcacggtggctcacacctgtaatcccagcactttgggaggccgaggcaggtggatcacttgaggtccagagtttgagaccagtctgaccaacatggtgaaacctgtctctactaaaaatgcaaaaattagctgggcgtggtggtgcacacctgtagtcccagccacccgggaggctgagacatgagaattgcttgaacccaggaggcagaggttgcagtgagccgagatcacgccgctgctctccagcctgggtgacagcaagactccatctcaaaaaaaaaaaaagaatggcatgagatagacaggtagagatttgatggttttcagaaatcctggctggactgttaggagtcgtgttatagacaattcaaatgtcactgctggccaccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccactaaaattgatgagaattcttgtctccatgtgtaatttctggctcatcagccaggaggtaaaatttcaataagaatcaagaatattttaaatgatcagttaaaactgagtaaattagttggtttagtcaatcccccatctctcctgggaaattatctgacttttgcaaggtccttggtgttttcagtgtaattacctaaggtcctattccatatcaagtttcagtttaactttgctacaggattactttatcacaaaacttgagtagatgataatacaatcatacatcacttagccacagggtaagccacagggaaatgcatccttaggtgattttgttgtgtgaacatcgtcaagtgaacttactcaaacctaggtggtgaaacctactacacacctaggctatatggtacagcctgttactcctaggctacaaccctgtacagcacattattgtactgaataggtgctaggtgtggtggcttacacctgtaatcccaacactttgggaggccaaggtgggaggatcccttgaggccaggagttcaagaccagcctgggcaacatagtgagacacccccccacacacaccgattccctgtctcttaaaaaaattttttttaattagctgggagtggtggtgcatgcctgtagacccagctactcaggaggttgaggcaggaggattgcttgagcccaggaggttgaggttgctgtgagccatgattatgccattgtactccagcctggctggcagagcaagaccctgtctttaaaaaaaaaaaaaaaaaaaaactactataggcagtgtaacacaatggtaagtatttgtgtatctaaacatatctaagcatagaaaaggtacagtaaaaatatagtataaaagataaaaaataatacacctgtatagggcccttaccatgaatggagcttgcagaactggaagttgctctgagtgagtcagtgagtggtgagtgaatgagaaggccttggacattactgtacactactgtagcttctataaacacggtacacttcagctatgctaaatttatttaagtttttttccttcaataatagattaagtttagcttactgtaacttttactttatcaacttttaaattttttaagaagttttgactcttgtaataaaacttagcttaaaacacaaacacatggtacagctatacaaaaatattttctttatatacctattccataagttttctttgtgtaaaattatttatttgtttactttttaaaatttttgttaaaaactaagacacagacacacacattacctaggcctacccattacctaggcctactcaggatcgtcaggacatcactagacaatagtttttcagttccattataaccctacgggaccaccatcgtatgcatgactgaaatgtcattacatggcacctgactgtatatccttttgtggccctaaaaagggccacattttactaaaaagtttgagtaaaatgtagatataaagaaggaccaatgagatgcaggatgaaatatgggagtatgagaagcactgtgtttgtacttgtcactgtagatcagttggggaaatgcttctcagcattgctatgacttaaagaaaaactccagatatcatggtgacttacagcagaaaggaagacgcccagaggtttaaagagcagaaggatcaacttcagtaccaagaaagtagagagatataggaaccagttcctcagcagccccggaatggctaaggggagtgaaatgtcattagtagctctcgatctgttctttgattatatataagcagttaaatggttgttggaaaatattattgattgggtgccctcttttgtggcttttaaggttggttactcctctctagacagcacttagggtatgtactgggcacgtcactgcctaggtacttcctcccctaaatgtgggatgcttctgcatactgaagttgataaggagtcatttgtgagtctttgagttgcatgcaaccaatgcattaaataagatgaaatctgggccaaagaaagggtaatttattctacactttatattcggcagcaagaagcaccgtctctcgagtcctgccaccctcacccagtagcctttttcccctattctgtttttgttgaatgaacttcttgatctaatacacttaatagggctttttttaaggccttatgcaatcaaaaatcttgtcgtcttgttctttttagaagaaaggagtgctagacctcttggaagtttatttttcatctgtaaatttgaatttgtggcatttctgagtgtttctaccagtctcctttgtagttgaggtctgttcatcattcactcactggtgataacattcatgaatacgacatttttaatttgtatctcacctcatagaaagaattgtgcagcttttacatctgccagactagagttgaatattccagtctttacatgatttttttctccatctgtctgtctctttcctgtctctaattttgttggtgcatcaggactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaacttatgtgcttgtctttgtattttttctcacaaaagaaaaaaagttgcaaataattttttctctttttttggtcacagtggtgtttttcctggaaattctaagtttattagaacagaatctgaattagtcctgtgatcacaagttgtgtgctaatctacaaataacagatggttcaagcttccccagtttcaggctttgtgcagcgtgtgacattcatcttccatcttactacttaataggaatggtaacagtttactcacatatttttacttttatactttttattgatgacagttcttctctgtgagcacacaagtctaactggaactgttttatgagacgtctatggcttttagtgcaataaagaatttttaaagaatttggtccagcgtgatgatttttctaatgaatgtcaaagccaagcgagtgaggctcagaggaactgaatgtctccagctgctaaggctctactgtctgcaaagcttttggtggcgtgtaattaaaaaccatagacatcagagtgctactgtttgacaactcatagaagcaagctgagggggtcttttcagagaatgagccccgcttgtaggtctttgcttaccccgtctctctggagaaaactcagaggcataaaaggtgtccctgcctctctcctgcggcgatgtatgatttgtgtggtgctgtatgctttggcttctatccgcacacactgctgtctgctccatttcataccttgacaattgtcagtgtgattgcaaactggcttgtttgtgtttcttctctttccaggagtggctgtaaggtgaagaagcatgaaactcagtctctcgccctggatgcatgttctcgggtgagtctgtgcccatctccagaatgtctctgagaccaggggtcctccagtgggagtttgcatccccctggcgggtggttcaaaaggactttccaatgggtacctgagtactcagctttaagaagccaatttccagatccttactgtccctgaagagaaggcccctgaagacaagggaaccctttcacaatgactcttttttttttttggtaaaattcccactttaaatgctacaaagatgcatcaccacagggtgtgaaagtctccagggcaccgaagggaagatctgaaatactggtgtaggttctaataagataattgactctaataactggatggtatttttcttaagtcagatggttttctaattcattgctttcaacaatagaggaaaacctgagttgtcagctgataggtctaaaaataatgtttgatggtagatttttttgggcacataacttggaaaggggttcaaagaattgaaaggcacttatgttacagaactactttctgtttcatctattgtttatataaataaggtttcttaatgattatattgataaaaatagaaaccaggaataaaattgatgttgacctttgttacattctagcaataaataatatccatccatgaccgtataaactaattgcaaaacaaagcgaagcccaggcccatctgattgcaatgagatccttttgttctttttaaaactttctcagtatacttattacagaaatacattcattggttaatagagttcaatttaacataacttttcctctacaatttggatcagaaacttggtatatggtgtaagatgtaaaaaaggggtgtgatgggggaaatttgcaatctgagttatttttcatctgttaacaaatgtgtaacattctccctcagattttgctaaagtaggcagcaagaactatgagaaatttatctttggttttctttaaaaaacaaaaacaaaaacccaaaacccatatatttagtgcactgtaaaagtttttaagaattagtgcaataaaacattttgtaattgatataacaacttacttttgtgtctgataatacttatcaaaacttgcaatattttgaaaataagttgtgcattaataaatgtgataagtctccagcagaaaaaattttaagacttaaagaaaaaagtttcacagagacattggatagagacttttaaaaagactttcaaccatgcagatgtttttcatttggatagtttcttgatggaagtgggatggaaatacagatttagagaggaaaaggaataacataaatttctgacttattcaggaacttgttcatttaaatttacatatggtatcaaatcactaaggtaactagatagcattaagtaaattcaatatttagaatattccagatattacattctttgcaattatttaaacttatgccaaaaagtttttagatgtcacttgaaaatgcaatgggggacatagattttcaaaaaaaaattaggtatatgagcaaaaaaattgaaaaccattgtcttaaaccactgaaactgcttgcttataaacttaacctagagaagatcattttttaaaacctcagactcaagttacagaaactaggttctataaaacagcatctcacaattgaaagactccaacttcctccttgctttgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcccgtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgttgctgtaaaggaatacctgagaatggctaatttataggaaaaagaggtttatttggttcatggttctgcagactgtagaataagcatggcaccagtgcctgcttctggtgagggactcaggaagcttccaatcatggtggaaggcaagggggagcaagtgtgtcacatggcgagaggtgggaggaagagggggcggggaggatgccaggctatttttaacaaagatttcacagaaactaacagcaagaagtcgctcattaccacaaggagggcaccaagctattcatgagggatccgctcctatgacccagccacctcccattaggcctcacttccaactgttgatcaggtttcaacatgagatttagggggcaaatatttaaactatatcaaatggcctataaatatgtcatatgtttgacttttttgtgattgttatactcattgtttaacttagagaaataacaactgacatgtatggtgccttaccatgtacaggcattgttttaagtgctttgcatatactcattcatagcaaggtgttacccttttctcacttcttcagagaaacaaagtaagtcaaagaagttaagtgacttgattaaagtcacttggctagggtaggacagaaaagtggtatctttttcctcaccacaaggttcatggctgagacatctctaacaaaagatcaacaagagaaaagtgtacaaatatatttaatataagttttacatgacattagagcctccagaaatgaagacccaaaggaacagggaaaactgtacttttatagatagttgtgcagaagtataattggaggacagaagggtgtgatctatggtaataaaccaggggaacttagcaagtcctgtttgttccaattcctcttggtgtctgtgtctttcaggataaggacattgtttttctctgtgtacagggaggacccctcttgtaatgaggtcttatgaactattttcaggggaaggtctgaggggttgctttatggcctgcttcaggaaagggggcaggagaggggccgagagacctccctgcttctgctgtgtcctcaaatgcgaaggcaccatattttggtgaagtgtgttctgaacctcatcattagtaaatggtagaactacatttgactctaagcagtctggttccatggtcttttcgccacaatgccaaagtatgaagagattattttcatgatactaggctactgtaaattttcctggtacagatgtggtaagttgagattgaccagtgcactgtaaaatctttcttaacatgccaatgaggaacctgggctaaccagggtggaagcctcttattgatggactcatcagatcattctagagctaagcccctctttcttgggaccccagttacatccttggccttaaactttacttatgaaaagtttagaaccatgttcctgactacattaaacattattaaaaactcagatcttcttaacataattttattcatgggcttttatgtatagaattttaaaagtcatgatctgccattaagccagggaagcagatggaaagtcaggacttggagcaatttattccccctggcctccttctcatcccaggcctcagtctctcatctataaaataatatgccaggcattgttcctgatttcttccaatactgtcttctgccctgacatctttcccaaagatattgttcaccattcccccagtttcttggggttaatcctgagtattcttaacacctgccttggtttttttccatctgaagtgtcttcctttgctgcctcttacacagatctgcacatcccttcaggtctctccagcatgcttttgctcccacatttcctttcccccttcctgttccacagtacctagcgcagtgtgttaattacaggaaggtaatattataaacttactgaggttagagactaccactcatctttgagtcacctttgacacagtacatggtaaacatttattgaattatattcttcctcactagaggaaattccttcaacaaaaatttatgtagagagctggggccctgtacatacagtgctgtcttcaaagttagcaaacagcaaggggaacatatttaaacaagtggttacattgtaactgatcagccgcatcacaagcaagtggaggctgcggtcctgggtgtgggaatggctacaggccctgttaggtgaatcctgactgtgtcctggtgagtgtccccttgaagctgggtcctgatggatacttactagatgttctccaggaaatgagattttcacacagccatgggaagaaagctgccacgttggtaaaaggcctggttgctttctgtaagtatctggccaagtgggaaacaaggtcataccgtggaatctgggcttgatcctataggtagggagggggaggttgaaggtttttgaataagggagtgatggtcacatttgtgttttaaataattagctattgacaacaatagtagttagtgattgccatgtggaggattgtaactttaaacttttgtatgcttttctgtatttttatgtttactttaatgagtgcatcttctggttattttattttttatttttcttatttttgagactgagtttcgctcttgttgcccaggctggagtgtggtggcgctatctcaactcactgcaacctccagctcccgggttcaagcgattctcctgcttcagcctcccaagtagctgagattataggcatgcgccaccacgcccagctaatttttgtatttttagtagatgaggcttcgccatgttggctaggctggtctcctgacctcagatgatccacccaccttggcctcccaaagtgctgggattacaggcatgagccactgtgcccagccatcttctggttattttaaatgtcatcctctaccctagtagagtagaggatagacctgagacaaggaagcccatttgaaggggtggaggggagaatgagtttagtttcgctgccttgaattttaaagcttattatcttatctgctgcattaattagatcaaggccacccttctgggctggaatttaaattcactccgacttgatgattaaaaaaaagcattcagtgttacacagtgtcccctttctgaaataatgccacagttagtacgacacatttttccaaacttttaatggacacaagggggcagccttgctgttctttcagcctgaaggctgacgacctgtttgtggctgactaaccatgtgctcctcttctgaatgtcatggacttataacagcactcaacaaaatgccagcgctccttttaaataaaatcttaaaatgcttttcatgtgttcataagtcattctcgcctgcactggggtttccaagagcctttcactagggaggaaaggaaccgacttcttgggataactataaaaatgactttctgtcttaggcatagagaaggagacgtgccagaagatggaagaagacgggtccactgtgcttgtaagttcctgaatgtggagggccgggtggactcaggtttctttcagtatttgttttgaagcccatgtgaatttgttaaattctggtcagtgttaggtgatgaggataaaatgtaaatgagatagtttcttcacttgaggaacacatagtctctgcattgtaaccctagccgcaggtagctgtggagcacttgaactgtagctactcagaaaaagaagaagcataaatgtctcaactttttatattaactacatgttgagatgataatattttggatgtcttgggttaactaaggtttattattatcattattattgttgttattattattattatttgagacagtctcactctgttccccaggctggagtacagtggtgcaatcttggctaactgcaaccttcacctcctgggctcaagtgatccttctaccacagcctcccaagtagctggaactagaggcacgtgccaccgcacccagctagtttttgtattttttgcagaaatggggtcttgccatgttacctaggctggtctcaaactcctgggctcaagcaatctgcccacctccgcctcccaaagtgctgggattacaggcatgagcccctgcacctggctggtttactcagttcttttttttttttttgagacagagtttcactcttgtcacccaggttggagtacagtgacgcaatctcggctcactacaacctccacctactgggttcaagcagttctcctccctcagcctcctcagtagctgggattacaggcatgcgccaccacgcccagctaatttttgtattattagtagagatggggtttcaccatgttggccaagctggtctcaaactcctgacctcaggtgatccacctgccttggcctcctgaagtgctgggattacaggcatgagccactgcgcccagcccatttactcagttcttaaactttaaacttcctaattcccaactgattcatccataaaatgagtagcacccatctgccttatcaaagtggttgtaaggataagatgaaatgacaacgtgaaagatttaagctgtaaagtgctagaatacactagtgtgctagaatacactgttgtgttagaatacactggtgtggtgttgataggaaacacgtggaaaagagagtggaaaggaagagagtgaaaaagaaaaatggcaaacactgtctctgaagccagctggtgaggaacatatcatatgctgtgaccttttaaaagcaactccttttgaacttcccaacataaattaatttctgcttccttagaacattgaataaacattgtataaagaaatttcaccatgcaaaacattgaatgaaaaaatcatctatttaatccatcattcactttttaagtttatctgtgttgctctgaagtccattcttatgtggtcttgtgcccagcagtaggtggtggctggactaaggccagagtacaatcagtggtaggagtcagtctctccttgcttttcagctgttgttccacagcatttttcacgtaagaagttaacttttctttttaagttttaaatgttttaaaaggtgagttcatttggcttttttgggcacgtctctgttagagtacggcaggggctgatactgctctcttgtgattgaggacaaatgagcacagtcagcacactgccacagattagtgatgcgaattctccacagccacgggaatcagtggcatctgtgctcactgtaaatttgcaaccgggagtccattgagttctgttgtctatagactggtctttgttggtcctcaattgtgaatgttttgagggactgggagaagcactggcaaacatgaaataaagcccttttggaaggatatgattgattgatttagcgtcttcattaaagacatattagatggcccaggcctaaaacagatcttctggccaattctctgtgatggtagattctataacaagcttgtccaacttgcttaattttgttgttgttgttctgattggttttgttttaggcttttagcagcctgaagccatagtttttagtttctgtctctagtgataagcggaaaagagggatgaggaaggggctttactgccccaaccagaaacagaaactaagaacccatgactgcattctctcccttggacacccctgtgaaatgttctgcactttttgataagcaacttaaaggactaaggaatgtaaaaagttaaatcctaggagactggaaaagatggctaaagtaggcaagggcatacattcctgccctgacacctgtaagagttgttgcattttgagtagtgaggtttgtaaatgtggccaggcagagaggagagtggctggggagagtcggcaggctgaagagcccactcacctggagacattaaacaccatctaaggtttgatctcctaccgcctgctcaggatgctgcctcttccagaccccacatgtgttagcattgagttgttaagcaggcagactgaattcatttaccctctcaacaaatgaatgagatgctgaactctgtaatggatgttgatgttttcctggctatgaagatttttagggggcgtatttcccatattctcacgaacttggtagccatggaaagcactgagagtctgtttcctaaagttgacttaacctggggactctggcttaaactaagaactcagaagagactgacccatgaaatgttgttaatttagaatcagaagtttaacagtgaggtgaatcaagtctcaacttgacctcctgtattacctccctttaggcaagtaaaagtttcttgataagaaacaaggcacaggaagttagtgagatgattcaaatgtccaggggtgtatcagctatctgctgctgtgtaacacattactccaacacttaaagcaagtgtttattatctcattgtttctgtgcgtcaggaatcttgggcagctttgctgggtgcctctgactcagaatctgttacaggctgtgcaatccaggtgttgatcagggctgcagtcatatccaggcttgacttggggaggatctgcttccaagctcactcatgtggttgttggcaagtctcgggtccccactggctattggcagagacatcggctccttgccacgtgggcctttccctgtagcttctcaaaacatggaagtcagagtttgttcagaacctaacctcagaagtgacatccatgacgtttgccatattctaatgagtcactaggtccagcctacactcaaagggaagagattacagagggaggggattagtactggaggtaggggttactggggggcattttagaggctgcccactgcaagtgccttctggttctagtggtagatttttcccaagagagaaaagagaggttttgtgggtaccttggacttctgttggcatggtgggctgccctcccccaaatgctgctggaacatgggcactgccagcttgtggcttttgtattttgcttttctgtggcctgagacaggtttctattttgggcccatggctgaggtctgtgaagctgcatgctaaaattctgtttctgagcattttctagagagagggtaaaactataatgactctgaaaaatttaaaagccactcatctacgttcaccttggactttctgtttagtgttgattcacacaagatgtaactgattgattataatcagtaactaattgattagttatcccacatttaagattaagattattccaggtcactttggcattttggatgttcccaaagtattagatgactcatttatataaaaagtttacttctggccaggcgcggtggctcacgcctgtaatcccagcactttgggaggccgaggcaggcagattgcaaggtcaggagattgagaccatcctggctaacacggtgaaaccccgtctctactaaaaatacagaaaaattagccgggcgtggtggcgggcacctgtagtcccagctactcgggaggctgaggcaggagaatggcgtgaacccgggaggcggagcttgcagcgagccgagattgcgccactgcactctagcctgggccacagagtgagaccccgtctcaaaaaaaaaaaaaaaagtttacttccgtaggtaggaggaatagccagcaaaaacgtcttttaggaaggaaaatagtacaaagtccatgttctcatgaaaagaaaagtttgccagtgttttgctctggaacctgagcttatgaaagaagctcctcagagcttctgagccagcacctcagagggcgaagtgctgccagaagggagtggaaaacttagtagcaaggaagaaccaacacacaggcatggtccttgacttatgtatggccattttgcatatgggcaacaatggcacacacccagcaggctgggttacagcaggaggtcgctgcggagcagcggaagttcaggatgatcctgaatcatccgggtgaaagggtgggggtgagagttcagagttcaaatatatttgctatttctgccttcttaggcctgaaagttagtattttagaaacatttccatctgcagtggctaaagatacatacaaagcatcaatatgtaacaggagcagctgtcacttgtttttgtttttgcttttttaaaaaagaaattcccatttacatggagcttatccccagaaacttaatcatgggtgtgtttctcttttatccatgtggttctttggtgactgaccgctattataagtacactttctcccttttagatcagaataaaattctctaggttatctgctcaacagaagctaagaccactctgatagtcattataacagtttttctttagttacttccataattagatttgttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatgggatctgcctcagcgaatcagacaagacagccgtgctcaccttaataagagaagaggtaaaagctctcctgtttagtctgcttatcactccatttctttgtaaggcccatgtaccagcaggtagattgcatctctgctggctcaagttatcacaggctggaagttcttattacctgcagcttgtttaggtcgtaaaagggccccctgtggcagtggtgctggagtcctgacattctggtctccagggtaaaatgttgacaatctgaaatattcttaagaattttgtacccttctttatctttcagccctgacatttaaaatacctaattttgccagctttgctcccatgtgtaactaaatcagtgcttttattttacagaggatatatgctaatgcctaaaaacatttgtaatttttttgcagtaatacacagttgtttcctactttcatccattctttaaaccgttcaactctccgattcctgtattgtgtttcttgaacagcctttgttcaaaatagatcactgctaggcctttcctggttatctgaaaaatacgaaagacactgttgtgtaccattaataagttgcccaccctctcctgtcatatatctatgctgtattttgtgtgtttggtttgtgtgtttcttgacaattccacctgttcttaaaggaaggtgtggcaattttatttttatagtttttagttttatagttttttttagttttaatttttatagtatgctgaaagtggttaagcacctcagctgtaggtcttttacagctttctaaaatagcatcaagttggtaatgagggatgtcagctagtcctgttttcaaaacttgggagcagtggtaataaggcccaccaaaatctttttttttttttttttttgagataaaatcttggcgcagtagctcatgcctgtaatcccagtgctttgggaggccaaggcgggcggatcacctgagttcaggaattcgagaccagactgaccaacgtggagaaaccccatctctactaaaaaaaaaaaaaatacaaaattagctgggcgtggtggtgcatgcctgtaatcccagctacttgggaggctgaggtgggagaatcgcttgaacctgggagacgaaggttgtggtgagccgagatcgcaccattgcactccaacctgggcaacaagagcgaaactccatctcagaaaaataaaaataaaataaaagacaagatctcactctgtcacccaggctgagtgcagtggcacaattatagctcattgcagcctcgaactcctagggtcaagcgatcctcttgcctcagctgcctgagtagctgggactgcaagcacgcaccactgtccctggccaaaatcttgtaaatgagaaaaatgacttgatgtttttcctgggagttaaactatgagatcaccacctaatggatcaaagtaaagaggtgcctgattacctgaagcacacaggatacatccttctatgttcttgagatcctaataaatataatgaaactaccaattaggaagagagcggcacggccagggaagtacagtaagaggctgcccatgcaagcccagcccagggcaaatagagtttgaggcaatgaatttagagtatttccttccagttagcaagagcatcccaaatatgagcctaggttccaggctaactagcaagactctacccataagtgacggatgctatagctagatgtagccagctcatctgagccccctccttctgactccatttctatgaagctgtcagaaatctctatagaaagagaatgtgttgctcatgccaacttccagtggtctgactttgtggcagtttcactctggtggcctggcatcagccgtgattacatggccttagttaagagtgaatacctgccaatcagatggctctgttcttggtgtctgtcccagtcagggcctggccctgcagagctgagagctagaccctggaccaaggtaaagttcacagaggctgtaaatactacttgggatttctgagagatgttctactcatctttattcccgtgtctgcatcccagcattcagtgtggcttagaatacacttttccaaatggttacaaacatttaatattgaagtttatatttctaatatagattgaacatcttgggttagacctggttgtgtgctatttcagttcccagtcttaaatgcaaattgtaatagattgggtaaaactaagctttattgtactctagataattactaaagagattgaagcaaatgaatggaagaagaaatacgaagagacccggcaagaagttttggagatgaggttagactggaggttttggggaggggctggatacttttatgcactgttagatttgatacagatgaagtgatgacagtgtttgcttgccacagaaccaagtgttgagagcttgagggctttgctgtttgcaccttgctttgtgattgagaatgttatttcaggagttattgctaaccagttattatattcaaatactgtagtttatcttgggttgttcagaacatataacatgtaaacagaacccacataattcttatcttcttagaactgacagaaatttgtatcaaaatatccatttggaatacagaaaaataagatttatccaatgatagagacactgaaattcataatactacttttttttttttgaggcagggtctcactctgtcatccaggctggagtgcagtggtgtgatcatggctcactgcagcctcaacctcctgggatcaactgatcctctcccctctgcctcccaagtagctgggaccacaggcatgtgccaccatgcctgcataattttttttagagatgaggtctcgctctgttgcccaggctggtttgtaactcctgagctcaagcaatgcacctgcctcagcctcccaaagtgctgggattgcaggcatgagccacagcgcctggtccataatactttttaaaaattaattatgcatgagagtttcaaattacataaccaccaaatagatgatagaaagcttgttaacaagaaacaaaattgattgacttgaaatcgaaatctttttatttttcctcacttttagaaaggagagttatgagccatgaaatgactaaagatgaaatcaaagtagagaagaaaaaaaggcataaataattcacacacagtgtggtcaacacttgaatgattaaaaaacattttaagtatatccctctaatttgttgctcttttattatttgtcttttaagcatttcctaggtgtaaggccctttgctgggcttgatggaaaggaagggacattcctgctcttagagagcggtagccatccataataaccaacttggatatgacgtcaaaagtgatgggggcaccaccattgagggcaggggaggacgtgatgcgactcacagagcacccagcaccggactgggtcagaaggacattgtcattcttcactagaagaaaggttaacccaagaggttgatctttaaagtctttgaataagtgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataacgagagccccaaagcagataaatggattacatacattgtcagtgtacgttaatgtgtttaattgtttgggacagcatttctccaactttcattgtctgaaaatcctcctctggtaataagttctttttttctcatttaggaaaattgtagctgaatatgaaaagactattgctcaaatgattggtaaggagaacattttgttttttgagggtatgagccataggatctgtcttagtctgttcagcctggtataacaaaatatgtaagctaggtagcttataaacaacaaacatttttcatagctctggagacaggagagttcaaggtgcccacagatgagatgtctggggagggcccattcctcatagaaggggctggctagctctctggggtctcttttataaggacactaatcctgacataatcacctcccaaattcccttccatgcccactttcaccctgaacatactcacacactggggattaggtttcaatacacaaatttggggttggggggtggcataaactataagaccatagccggatccatttatgattttcagaccatgtcacaaacttgtatttgtgctgtcacttagatacagtcgtctcattattcgtgggaggtatgttctgtaaagttgctgcaaacactgagttagtgaatactaaacactgctcctggcctggcatggtgtctcacgcctgtaatcccagcactttgggaggcttgggtaggtggatcacctgaggttgagagttcgaaaacagcctgaccaacatggagaaaccccgtctctactaataatacaaaattagctgggcgtggtggtgcatgcctgtaatcccagctactcgggaggctgaggcaggagaatcgcttgaacctgggaggcggaagttatggtgagccgagatcgtgccactgcactccagcctgggcaatgagcaaaattccatctcaaaaaataaataagtaaataaacactgctcctagggaaaagacagagttagagtcttgcatctggccacaacattttcattgattgatcagtatataaccttgttttacgtgtgttcctgtttaaagacaccttatttaatatatatagttgattcattaacattgagctcacagtcagcggcactttggctcacgtctgaacagagcttctgtaatgtatgtattttaaggaaccttactgccttcttgtgcttggtatcactagacagcactgtggcactgcccttggaggccacttaaaacagtgaagtctccggcaaaaagaacacaagtgcaacaaacatggcctgaatagaccaaaagaagaacacttgtttatagaatgaatcaagaaggcagagtattgctttgttcactgtcagctgagagcgtgcatatcaggtgactaaagcatttttgcactctgcacacatccacaaatgactgtcaaagtccaggaggatagattttaggattacaaataaattttagcaagtaggtgaattgggaggtatggacttggtgaataatgagggtcaactgtagttaggttcattttagaagatggcaggccttgaattctgtgactgttggtggcctggtcacatcactaacacccactgggagcatcctgtgttttggtgcagggttcttactctagtgcagattgtaatttctctgcatcagacccagcggtgcctttacaaaacaacagggattgatcctcctgcatggaatttagagtctcttctcatctatatcataaggattgactccctaaaccagagtctgtcctttctccactaaattgccgaaatgatactttctatcatccacatcacctaatgccttcccagctcagggccttaccacagctgttcttctctatggaatattctcccaggtagctgtatggctcacatcctcatttctgtccggtctatgctcagatctctccctgagagcaggtactctctgtacagtaacagccccctccccgcccccattcctccttaccctgccttgttctttccccatcacttgttaccacgcgtctcccccaactagagtataagccataagagcgggaatttggtcacatccccggctgtgtccctaccacgagaacactgcttgtcttctaaggagtgtctattttttgaataaatatgtcattccttttgacttgtgattcccagaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaaggtagagtgttttttccctctgtctcctggtgtatttccagtagtgtatttccttggtaactggtcatcaaatacatatgccagaggttgtgggtatccttttaaataggagctcagggcctactggccttgtatcctctattccagtgaagctggatttttttccacatttttccttctttggttgttcaggcatctggcccactgggtgccatgtcttggccattcctctcctgtgtcaagccaataagccccaggctgtggcgtagactgcaagaactgttaattgaaccctcagacctcaggtgaattctagaaatgttctttctggtaattcaccttttcagttttagtaaaagggattagaaggaattccatgtctctgaaaaattcaagctgcatattctagaagacattagtataatgtttcaaatttagatgtaaatgggcctgttgatttaatttaactttaccatatcaaccagacacaattatagcaatgaaatggctttattttcatattaaaataaaaatgaaactggccagtttatcaaatatggaaatcgaattgccattcagttttgaataactgccttcctaaagtaggcatattggtataactgacccttactgtatgatattgaaaattaacacatgaagacattatgtagaatttcctcagtgagaattacatgtggctatttcaaattactgcagagtatgaataaaagccatctgaattaattagatttttccattctttaaaaaatgaaaactctgatatgtggtagattagaagaaacaaaatgacctgtttattttcaatttttgctttggaacagaatgaagaagccttgaagaaatgtgctcaggattacttagccagagttaaacaagaggagcagcgataccaggccctgaaaatccacgcagaagagaaactggacaagtaagagcttgtaaatgttgaatttcactcttcatgatgttgtgggaagattgagagaggaaaacaaaatcactgtttcgcaactccaggttgtatttttatgtgtgtgtttatttcactttttaaacccttttcccattgttaaaacattaaaaagtaaaaaaaggtatatctgctcctgcctccttccactgggttcccatctttctctatgccaggtaatcaccattgttggtttctgttttttcttcctattacaatttttttcttttttatatgattatagcatacttcgctatttttgcttagcaatataattttgagaatctttccatgtcagtgcaagaagagcttcctcttttttttctaatagccacatggtattccattgttggaatgtatcatttatttaacagtcccctcctgttagacattaaagttaattcaaatgtcttgctgccacagacagtgctgtaataagtgacctggtaggtgatcgttttgcatgcctgtgagttatctttatgatctgtatgttagaaaaggaattgctagaccaaagcatatatgaatttataattataagtgttgtcagattggccccattagacttttatcatttgatagccctagataatatatgagagcatctcttttttctacaactgtgccaataggtcaacgtttttattttctgcaaatcaaataggtgaaaatggtatttcaacataggtatttgtttttggcaagcaacagagcatttatttatttattttattattattattattttttgagacggagtttctctctgtcacccaggctggagtggagcggtgcaatctaggctcactgcaacctcagtctcccgggttcaagtgattctcctgcctcagcctcccaagtagcttggattacaggcacacgccaccacacccggctaattttttgtatttttagtagagacagggtttcaccatgttggccaggctggtctggaactcctgacctcaggtgatccgcccgcctcagcttcccaaagtgctgggattacaggtgtgagccaccgcgcccagccccagagcatttattttaatcaatgtaattttgatttgcatctatcttatgaatgaaattgaatatatttcaccattcatttattaatatatttgctttactatgaattactctattctttgcccattttcctattgtcattttatagattttatatattagggacaccagccctttgtgataagaattttgaataatttttcaagtttatcatttgtcttttgcgtccacctatagtgttttttgatattcagaaatttacttttatgtgctgaaatgtattagtcatttcttttacagcttctggattctttgtcatagtaacaaagatcttccccatgctggatagaaaatattctcccatgttttacttacactttatggcttagtttttttaatccttaaatctaatacatttggagtttatcctggggagtgttatccaacttgattttttgttggttttttttgagacagagtctcactctgtcacccatgctgtagtgcagtggcacagtgtcagctcactgcaacctctgcctcctgggttcaagtgactctcctgcttcagccttccgagcagctgggattacaggcacccgccaccatgcccagctaatttttgtatttttagtagagacggggtttcgccatgttgggcaggctggtctcgaacttctgacctcaagtgatccgcccgcctcggtctcccaaagtgcaggattacaggcatgaaccactgagcctggcctcccaacttgactttttaactaaaaggtaatacatgcttgtacattttgctgcctaaatttctatctgtagaagcagaagttcccctgtccccttcccactcccatagtactgtattagatttcttatgcattcttctccataggttttacagatgcctctatatattatacgtaggtttattgtatatccctctagtcgtttctttgtgtctttataaatactatgattttgaactataaaaaatatttacaatattggaatcacattagacaaatttcctttttcccttaatagcatatcctgaccattttttcatgtcagaacatatagctgaatctaattctttttattaggtcgtggaactatagcatttctttattgatgggcacttagttacaaacttttttacattgaaggtaacactacagcgaacatcctgtgcactcactgttatgccaggtgggagtatttctgtgaatacataactgaaagtggcattgctgcgttggagggcatgtacactttaaattgccctggtgactaccacattgcccgccacaaggcagcgccagttttcagccgcccattggcacatgagcctgcctgtctccttgtatctcggcccacacaggactgtccttgttaatttttgccaattcaatcaattttcaaagcttatcattttaatttacatgcctctgattgctaatgaggctttagcatcctttcatcagtttaatggctgttcatcaactgacatttatggtttttaagaatgcctttcaggccgggcgcggtggctcacgcttgtaatcccagcactttgggaggccgaggcgggtggatcacgaggtcaggagatcgagaccacggtgaaaccccgtctctactaaaaataaaaaaaaaaattagccgggcgtggtggcgggcgcctgtagtcccagctactcggagaggctgaggcaggagaatggcgtgaacccgggaggcggagcttgcagtgagccgagactgcgccactgtactccagcctgggtgacagagcgagactccatctcaaaaaaaaaaaaaaaaaaaaaaaaaaggagtgcctttcacatctcattaataaactcattccctgtaggcccgtgtctcacagatgtcagtggttagtatcccaactctagctgtgatcgtctccaaaattatgcagtctgcttttgtactggtctaaaaaaaaaaaaaaaatctaagactgttatagaaaccatttgctagtgagatacaaattttgaagttgtctgtaaattgaatttttataaattaaaatggaattatttaggtcaccgatttttgttttttttctctcatgcagtcaattctttgaggcctgtgcctcacagatgtcagtggttagtatcctgactggctttgactagtggctaatcatgtgctttttgtctctttattacacccaaacaccataaacagagccaatgaagagattgctcaggttcgaacaaaagcaaaggctgagagtgcagctctccatgctggactccgcaaagagcagatgaaggtggagtccctggaaagggccctgcagcagaaggtacagaaagggacctgatctgggtggccacagagacgtttggttttcctcctcagcagtgactcacttaatgacagatctgggtgaaagaggccttggctttctactcagacatttcagtccagctcctttctgaactgatccaggtggaaacaaacaagtcaaaccattaaattttcaagcacatcatgtggaaatcatccacaggcagggtgcagagaggaagttgcattttaactgaagttcagaacagcttcctagttggggtcatgagactgcctttctttctttctttgttttttatgcaatatattaatatgaagccatcttcccccttcattgctttagatcagtggtttgcagttgggggcagttttgccctccaggggatgttaggtgttaggtaatgtctggagatatatttgtttggttgtcaccactgggagatgctgctggtatctagtgcaggaagccagggatgctgttaaacatcctacaatgcacaggacagcctctgacaacacatttacccatcctaaaacatcagcagggctgctttgagaaactgctatagataaatgaaaaccaggactagcaacaatccctgtttctcactaagcaatttttagctttccgtttttatatgtctccggtgtattttctttactgcatttccaattatgtactcatacctgtgccatccattcatcaagagcaggagtttttatcacagggtctgttagcccctagaacggtgctccctgggagattcagactccagcatccctagatatgctaatggattgagtgagacccagatacttatgtttttgacaagtaccccagataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatagtcaagtaagaactgctctacagaaggacatatttccttggatgtgagaccctattttgaaatagagtcctgactcagaacaccaacttaagaatttgggggattaaagatgtgaagaccacagtcttgggttttcatatctggagaagactatttgccatgacgttttgttgccctggtatttggacactcctcagctttaatgggtgtggcccctttagggttagtcctcagactaatgatagtgtctgctttctgcatgaatggcaatatgggactccctccaagctagggtttggcaagtctgccctagagtcatttactctcctctgcctccatttgttaatacagaatcaacatttagtcttcattatcttttttttttttttttgagacagagtttcgatctattttaagtatgtgaagaaaatctacttgtaaaaggctcagatcttaattaaaaggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggcagctgctggcctagatgttggtttgggaatattaggtgatcctgttgagattctggatccagagcaatttctttagcttttgactttgccaaagtgtagatagcctttatccagcagtattttaagtggggaatgcaacgtgaggccaactgaacaattccccccgtggctgcccagatagtcacagtcaaggttggagagtctccttccagccagtgacctacccaaaccttttgttctgtaaaactgctctggaaataccgggaagcccagttttctcacgtggtttctagcttcttcagactcagcccaaattaggaagtgcagaagcacatgatggtgaaaaacctaggatttggcagccttccagaatggtatggaatctgagggaagatttatgtttcgttttggaggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatattctggttatagttctaatatggagatgttgtgtgcaatgctggcctgtggtggtctgtgtaatgctttaacttgtatggaggaggccaggctcagagctgagatgtggcctgaaccttccctgtatcgatcctttaatttagaactgtcaagatgtcactttctccccctctgccttttagtggtatctgacatatactcaaaacagtaatttcctggtcacatcattaactgctaattctgtatttataaagaattttcagatggacatgtacaaatttgaactcaaaccatccccagtccagatacagggcagcgtgtaggtgaccacaccagagcctcagcctcggtccttctcagccgtcgggataggatccaggcatttcttttaaatctcagaggtagcagtaaacttttcagtattgctgttagcaagtgtgtgtttgccaatagatacccattatactaatgtgccaagtaaatgttcattgcacatctgcttccactgtgttcccacgggtgccatgaagtgtgtgaggagcccctcatctggagggatgagtgctgcgttgactactgctatcaggattgtgttgtgtggaatattcatctacataaattttatatgcacagtaatttccctttttatatgtcaagtaactatttgtaaaagttatactcacaaattattataatgattactaatatattttttccatgtttcattgcctgaataaaaactgtttaccactgttagatttgggggtgtgtgtggtgttggtacttttcctggttataaattgtatccctgaatgtgaaaatttatggcagccctgcttttatgagccccatatttcaacctaaaaataggaaagatcacattttctctacactcattttgtgcatgtggttgggtgtgtaactaaaaacaaactttggaattcagatactgccatgtagatgtcgtgcctttgcatctgtgcaaacaaagtttttagctgggtgcttcttggttttgcttagagacttgttgtctgccctggcatttttcaagtcaccccaagctttctgactcgaaggacctggggtaaggcagaactatgtaaatagtgcagagcaaagagttgctgtgttttgtttcttctaggttcaatgcggtaccaggaataactttttaaatactggctaagccaactctccactttaaagggataggagattgggcaggaaattttgtgggttgtattacaggaaaagacaaattaagaggatagttaaggcttcattttacaactagctggagatccacttaggaaaatcagagaactatcacttttcttgctgtttgccacatcttaagacagtgcagcctctgtctgcaaat

SEQ ID NO: 13627 - DNA, 36311 bp, Human
  misc_feature (1)...(36311): n = A,T,C or G
gcccagcatggcgaaacctcgtctctaccaaaaaatgcaaaaattagctgggcgtgctggcaggcgcctgtaatcccagttacttgggaggctgaggcacaagaattgtttaaacccgggaggtggaggttccagtgagtcgagatcgcgccactgcacactacagcctgggcgacagagcaagactctgtctcaaaaaaaaaaaaaaaaaaagaaaagaaaagaaaaaagatctgtcaaccataaaatgattttttttttttttttgagacggagtcttgctctgtcgctcaggctggagtgcaatggtgcgatctcggctcactgcaaccttctcctcccgggttcaagcgattctcccgcctcagcctcccgagtagctgggattacaggcaccgccatagtgcccagctaattgtaggaacggggtttcaccatgttggctaggctggtcttgaactcccgacctcaggcgatctgcccgcctcggccccccaaagtgctgggattacaggcgtgagccaccgcgccaggcccgtaaaatgaaattttaaccatagattctaaattgcgtattcacagagtaactgagacgattgcaacttatttaaaactatgtgtaaatcatcttgaaacaagttaatgagaaagatcacatgattaaaacaataaaaaatgttgcttgaggaataatgcacagacggaatttagaaaaaaggaaagccagaacaactgcagacggttcttttcgcttttgtataggactgagctcctcttccggacaaaaaccaggaataagggaggtcttcttagtaaaagcaaaagtaaattgtcttaaaaaaaaaaaaaaggttgcaagtgatttggtctttccagaaaagtcaataccatgtctaacagtggtctctactacaataacctgaaggtgctaatgaccctcacagtaaaataagctagcaaatggccacaccgtagagcgcctacatttactgccaattaagtccaactgccgctgtcttaatattttcgctttttaatgaatcctctctctaggtattccgatccatccaccggtaacacgctgatacttcgaaatactgcaggcaggagtggacgggggagaagccccccccctccccgggcttctttcgtgttcgggcctctgctgccgcgatccacggaagcaagaatgagttccatcgcttggggctcaccagctagagggctggcggaggctgcgaggggcagaagtagcagcaggctactgggtgggcaagcggtgtgtaccgcagctgtggaggacatcgacgcggaacgcccggattgagctcagaacacaccggccccgcccgggactcattctacaagcttcttcggaagaggcgcccgcccgggaggaagggtctaaccccgggctccaccgggaggagataaactactcactgtcaatgtcctcgatgaggctggcggtgccaggcatatagttcattttgaactgaaataatgctgcaatgcacagcggcgggaggccagcgcgtccaaaacctcttccctcctaccgcagtcgccgcctcggtgggaccaagcccggaatcccgaccgagaccagcacttctgccccggctttcagccgccgggggctgccggaagctcctccatattacccttacccacttcctgtaacacgtgtgggcccccaggaagaggcggggcagccgtaccgttgggggacaccctttccctgttcctgttaagtaggtaagaggaaactccattggataaatggcgaggaaacgtatactccctcttaaggaacacggtgtcttccttcgtctccgggttcccgagaccccagagtcactgacctccgtccctcagctttcggggttcggcagcagaaggggcgggcccgggcctgggattggctggcgtcgtccgacccccttcgctgctctccattcgcaatcgcccgcgggcgcctgcgcgatgggtcggccgtggggagcggggcgggaagcgcttcagggcagcggatcccatgtcggccctgaggcgctcgggctacggccccagtgacggtccgtcctacggccgctactacgggcctgggggtggagatgtgccggtacacccacctccacccttatatcctcttcgccctgaacctccccagcctcccatttcctggcgggtgcgcgggggcggcccggcggagaccacctggctgggagaaggcggaggaggcgatggctactatccctcgggaggcgcctggccagagcctggtcgagccggaggaagccaccaggtaagctttgcaccctctgtccttgcggggaggtgagggcccttggggctggggttcgtaaaggatcgggtttcatacttgttttccttatgtggaggagggtgtgttgcggggggtgttggagagaccgagactaagatcagaggttggggggacatgcttgtgttccctttgcccctccttttctgcttcgaccccaaaaaatatgtttattaccatttaaaaaagaaagatcctgcgcggacttactaagcttagcagcaggctgcagatctctctcctgggagcggtgctgggtaggggtggcacggatctactgctccagctctagcaatttatcctgcgtggctggcaggccggctctcccggggaagggaagtggctgcagcccccgatgccgctcagggaccctcccgaggggaaggaacctttgcgaggaggagggatctgggcatttagctgtttgcccctaatgccttgcctgagatcgaatcatgaataatcagtgttgtaaagtacctttacgcggattgactgatttaattttcacggcgactgcaaggtaaaatggcattacagcggcccttttttttgttttcgaataaggaaccggggctctgcgaggttaactcacttgcctaatacacttggacctgcaacattttattctccgttttcctgccggacatatacttctgctttgttaatacagtcttctgggtagtgggttgtcgttctgcggtggcagcatacctctctgttcgttcaagaattatcctcatttgttgaaaatgtaatagtgaaattctcgtacattgctggtggggatgtaaaatggtggaaaatagtttggtagttcctcaaaacattaagcattagaattagtctatgacccagcaagcccactcctggctatatacccaagaaaactgataacgtatgttcacataaagcttgtccgcccatgttcatagcatcattattcataatcgccaaaaagtagaaatgtcgttttttttgttttttttttttttgagttggagtctcgctctgttgcccaggctggagtgcagtggtgccatctcggctcactgcaacctccgcctcccggtttaagcgattctcctgcctcagcctctcgagtagctaggattacaggcgccggccatcacacccggctaatttttgtatttttagtacagacggggtttcgccatgttggccaggatggtcttgaactcctgacctcaagtgatccccctttcccctgcccctcggcctcccgaagtgttgggattacaggcgtgagccactgcgctcggccccaaatgtcattttattatttgagttataaagtgagtgaacctcttggagccctggttctttattcgaatacaggaatgttgtaaggacataacgactgatgcatcgataaacaaaatatggtgttaatatattcattcaatggagtattatttggccttagaaaggaatgaactgctgatgcatgctacaatatgaatgaaccttgaaaacatcacactacgtgagctaagtcagtcagaaagactgcatattgtgtgattccatttatatgaaatggccagagtaggtaaatctagagacagaaagcttaatggttgccagaggttgggggactggcggtgtaggtgagaatatcttaatgggataatgaaatgttggagagggtctttctcaccaacaccaggtcgagctttgtatcaaagttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccactgcactccagcctgggcaacagagcaagtaccttgtcccagcaaaaagaaaaacaaaaattagccgggcgtggtggcgggcgcctgtaattgcagctagtctgagaattgctcaaaccagggaggcggtggtcgcagtgaccgagatcatgccacgaactccagcctgggctgcctagcgagactatctcaaaaaaaaaaaaaaaaaaaaaaaaaaagaggaagtaagggaaaagagttagagttgagaaaccttttgagctaaagggagaaaagtaacaagtttggagttggagcagaggggcattgacagctattggtctcctttcgtggtggagtaggaagctaggtcatcttacagtaagggaagtagaatgggatgctctgcaaaatttatgtggtaaatgtttgaaccagatgctggggcaagagggacaacacagagaagcatttggaagagatccaaatgagtttgaaaagttaaaaaattatgatggtcagtataggagcataaggtgatttgttagtgattatgaaccatatagctatacaaataacttatgtactttactaataatttttgtccaattcttatgaaaaatataagcaaatctgtaaatggaatttatgtagtacgagtgctactgattcctctgctgttagatttgcttggactggggtttcagtttgggggaatgttggtaagtcattttggaaaatgtaatcacatatccactttaaaggaattgactccagtcttcagctgggattatttatttctcagaagaaaggaaataaattagttatcttgcataattttaatcaaattttctttggcatagaactttaattcacattattgtggcttgtgaaaacattttattacctttgttttagtttgtatttcattcaacaaataaaaagtttggaaagagttaggcacatgataaaattggtaacttagtttatagaatagagttcagcttcagccagtttcctgtgaaaccaaatgctatttcatagaattagtgtcatgttgggagggccatgagctacagactttcactgttactagggatatttttagatttgtcccattttgtccaaaaggaggaaaaaaaagacaaagacattatttttttccttaagacaataaaattatactttttagtgcttcattgaggacattctttttttcattaaaaaaattatggcataatttacaaaaagtaaatttcactgtctttagggtatagttctgtgagttttgataaatacatacaattacataaccaccaccaccaccaccaccacaactgagctatacatactgacccatctttttttttttttttttttttttttttagacagagtctctctttgtcgcccaggctggagtgcagtggcgaaatctcggctcactgcaagctccgcctcccgggttcatgccattctcccacttcagcctcctgagtagctgggaccacaggcgtccgccagcaggcctggctaatttttttttgtatttttagtagagatggggtttcaccatgttagccaggatggtctcgatctcctgaccttgtgatccacctgcctcagcctcccacagttctgggattacaggcatgagccactgtgcctggccacctttaagcttttgcaagtgtaatcaaccaggtaagggtggtaagggctatttcccagaacttctcctgccgactcaaaagttagattcttctgagtaaaacaggctcttcactgttttcaaggttattccagtttccctgtattcttctatttaatctcagctgccacaatcagacagacggaaagcataaggacacttttttccttgcatctgtactggaaaccttagcagcagatagcagtcattctttttgatgcttaaatgataccatattatgtcaatgggagtccctttttcttggcttctgattcctttggacataatctattgattttttttttctttttctttttgtggagaacaggttctcactgtattccccagggaggtctcaaactcctgggctcaagctatcctcccgcctctgcctccctaagtgctgggattacaggcgtgagctaccgtgcctggcatgacccattgatttttgatagcttccttgatttctggtacaacaagatgtctcaggctttgtatatattttgtcccaagacacataatcagccattccttaagaacttgattgtatttttctcccaagtggagaattacatttagaaaccgttaagtcaggatctgagcaggaaaacagaaaccacactagttagaatttgatttaggaaattagctaaacaggttattggagttatgaaaagggaaaaagagaacacagaagtaacagaaaatagtaagtggaggaagcagctacaattcctggggctggggaataaagggaagaggttggagtgattatagccaggaaacttggaagaatggccgggcgcagtggctcacgcttgtaatcctagcactttgggaggctgaggcaggtggattgcttgagcccaggagttcaagaccagcctgggcaacatggcaaaatcctgtctctacaaaaaatacaaaaattagccaaatgtggtggtgggcccctgtattcctagctactcaggaggctgaggtgggaggatcacctgagcccaggtggccgagggtgtggtgagctgtgattgtgccactgcactccagtctgggtgacggagtgagaccctgtctcaaataaaataaaataaaataaaataaaataaaataaaaatataaaaagaacctggaaacttggaagagtggccaggaggtggcgcctcctacctggtgcagatacctctgaggacgttcgggtcggagagtgttgttgactgactgctgcgtacaggttgaatggcattgcggtgttgacactgacagaaacagcagacaggaagaagcaagtccactgtctcctcctctagcctagcatagtgtgttggcagaaccagaaagcaagcaagctggggagggagaaaggtttgtagacttccagccttacatcacagagccaagtatagaatgctgtgcttgcggccgggcgcagtggctcacgcctataatcccagcgctttgggaggctgaggtgggcagatcacgaggtcaggagatcgagaccatcctggccaacatggtgaaaccctgtactctactaaaaatacaaaaattagctgggcgttgtggcgcatgcctgtaatcccagctactcgggaggctgaggcgggagaatggtttgaacctgggaggtggagattgcattgagccgagatcgcaccactgcattccagccagggcaacaagagtgagactctgtctcaaaaaaaaaaaaaaaaatagaatgctgtgtttggacctgaggggcaaggggcaataccttaatacttggtacagaaattacagttgggtgcctggcatatatactaattgttattgtgttgtcattgtgtctagacctttccaaagggcagaattataaaataagtattttaaaatagaaaaataaatgagttcatatttatattaattcaaatttaacattataggaattttaacttctttgtatattttatatgaaaaaaatcttgattcctaacttaattacaaatatttgcacaatctaacaataatgtataaaataagttcaaaataatgccaggttccagttctggcatgacagcatgaagaattctgtggacctagtccccagtgaaactggtgaacattaattttaaaaaacaacaaattacagtttctggaaatggtcctagggaatatagcaaatgaagaaacacctttttttttagacagagtctcgctctgtcacccaggctggagtacaatggcgccatcttggcgatctcggcttactgcaacctccacctcccaggttcaagcgattctcttgcctcagcctcctgagtggctggggtttcaggtatgtgtcaccacacccagctaatttttgtatttttagtagagacagggtttcaccatgttggtcaggttggtcttgaactcctgacctcgtgatccacctgccttggcctcccagagttctgggattataggtgtgagccaccgcgcctggccatgaagaaacacttgttcaagaaaatctacaaaagtcagtaagaacattgggtctgtggtatttgaactaaaagctcctccatccctccttttttgcagctagtgagatagaaactttactctagagggtgtagccaagaacacagggctccagctccatgtattccacctcatagcctcagtcagaaggttttcatcctaggaggaggagtagcgtaccaacatttctcattttgcctcagatgcctgtcactgaggcaaaattctaggtaattgtggctgagtggtggtggttcctttctttcacccagtccctactcctaggatggagacttgaccttgggcaaggcactgctgaaaatactggggctctgatctcctttacccttgcttttcaagccgagaagccctaagtctacagcctcccttcccgtgggtactccacttcgtaaagcagggatgccattcagataaacacaccattgtccccactctagctgtagagagtggctcagatgttttatctggaagcagaagtaggctgtaaaacaggtagctcctaatcttttcctaaaggaacaaagtatggagaagctcaggagtgtggagaaagtcaaaaaaactgcggaggttgttgtgcaaagcaatagggaagagactggttagattcactggagatgcaggataaactagtaggccagctagtttgctggagagaaccaggaaaagaagaagctaggaggagccctttggtatcagaacaactctcaaacactgaccttgggaactaactgtccctttagagggacccaaatttgatctactcagtctgtggagcaatttatgcctcagggtgttattaaaaccagtagagcaatcagctggaaattagtgaagctttaacaactagatgtggtcaaggaaagatacactcaaagaaagtcttacaaaaatctttgtcatccaggatgactgtgggcatacccaaggctgtgccttctaatgagcaatatcacatacttcatacttgaagtttgagggcaaacagactttgcaaaaataatccagctggttactaaacaaatgagcaaatgacaataacaagcctaaggtggaaaaggtgggaccagtagtactcagagttgctaaaatgtctagtttccaacaaagaattatgagctatgcaaagacacaggaaagtatgacccatacactggaaaaaaagcaggtaacagaaactgattgtgaaagtgaccagatgtcacatttaatagacaaagacttcaaagtagccattatatatgttcaaataactaaaaaactatgattaaagaagcaaagaaaggtgtgtgataatgtcatgtcaaatagggaatatcaataaagagatagcaattatatattaaaaaagaaacaaatagaaattctggagttgaaaagtacagtaactaaaatgaaaaattaactagaggagttcaataggctagaactgacagaagaaagaattcatgaatttgaagatagatcaatacagattatgcaatatgaaggagagaaaaaagactgatgtgttggagaagtgtcagacaccattgaacacaccagcatatcagaaatgattaataacaaggttaatataacaaaagatgcaaatatgctcttttcttctcagattctttaaaagacattatataaagtaataagtataacaatataatgttgagtttgtaacatttgtagacataatgtggattacaataaaatcacaaaaaaggggaaaaggaacagacttatataggaatagcattcctgtatctcactggaattaagttggtataaatcagaagctgattctgatgagaagcatattgttagcccagctgggtgctgtggctcacgcctgtaatcccagcaatttgggaggccaaggtgggcagatcacaaggtcaggagatcgagaccattctggctaacatggtgaaaccttgtctgtactaaaaatacaaaaaaaaaaaaaaaaaaaaaattagccgggcgtggtggcgggcgcctgtagtcccagctacttgggaggctgaggcaggagaatggcatgaacccgggaggcggagcttgcagtgagccgagatcgtgccactgcactccagcctgggtgatagagtgagactccgtctcaaaaaaaaaaaaaaaaaaaaaaggaagaagaagaagtgtattgttagcccaagagtaactgctaaagaaaaaaaaagtataatcattaagttataatgctacatttgaaaatattcacttaatgcaaaagaaagcagtaaaggtggaataaaggacaaaaacacatgagacatataaaaaacaaaaagtaaaaataaaacatgtaaatccagctatatcaataatattaaatgtgcatggattaagcaatctagtcagaagacagactggattaaaaaaaaaacaagatccaattatatggtgtctaaaggtggcacacttaaggtttaaagatacaaatagtttgaaagtaaatggatggaaaaagaaatataatgcaataaagaaaagataaatgtttgaggtgtcagatatgccagttaccctgttttgatcattacactttatatacatgtatcaaaatatcacatgtatcccaaaaatatgtactacttttattaattaacaaattacatatatgcacatataaatacatatatatacgtgtatacacatatatatatgcatgtatacatatatatacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaagaagctgttaatgttgctaaggtgtctgaccaatcttccaagttgattagcctgccatgtgccaggtgcagtttatgtgctatgcaagtattagggcagcatttgaactaaagccttcctcatttttcagaacttcattctttaactaatagtgtggactcttgagaggagcatggagggcgattcatggagtagggtgtgaacagcacggaagttcacaatctcaggctgtatctctggaagcagaagatattgtctcacccaactgttaataaagttcgtgaggttttctcagtattattcaaactcggttgagttgcttctgctttgttcttaagtccttctttttccttttcttttctttctttttttgagaccaggtctccctctgtcacccaggctggagtacagtggtatgatattggcttactgcaacctccacctcctgggctcaagcgatcctcccactgcagcctcctgagtagctgggactacaggcacatgccaccattcccagctaatttttgtattttttgtagagagggggttgcccccgcttatcttaaactctttgagtttaagcagtccacctgccttggccttccaaagtgctaggattacaggcatgagccactgtgctcggccccctttttttttttttttctgtttctcaggctggagtgcaatggcatgatcacagctcactgcagcctcaatctcctctggctcaggtgatcctcccaccttaactgcttgagtggctgggaccttaggcatacgccactacacctggctaatttttgtattttttgtagagatggggtctcactttgttgcccaggctggtctggaactcctgacctcaagcgatccacctgccttggtctcccaaagtgctagaattacaagaatgagctaccacgcctggccaagtccttcatttttatgacatactttaatatgtaacagaaatctgttctgaagtcctagaagcattttcttcctttttggattccgtcttatgactctaaatggtgcaaggaactcctgtattttctttgctgtgctccaagtgtcaacctaaaataacaacagagagaaggactcttcaaagaaatgaatctgtttggaaataaacagagaattacaatttcagatgcgcataccatagataatcatcccctacatatctggagaagttgtagtaaggggaaacttttaaagggaaagaggagaagtccatataagctgttttgagacaaacatcattggtcacaggggcctgttgtaggagctgatgttactggaaactcattgctaagcgagtgttcttatgaagatggcttatgtgaaactgcagtcttgaggaattttttttttttttttttttggacagagtttcactctgtcgcccaggctggagtgccatggcacgatcttggctcactgcaagctccgcctcccgagttcacgccattctcctgcctcagcctcctgagtagctgggactacagtcgcctgccaccacgcccagctaatttttttgtatttttagtagagacagggtttcaccgtgttagccaggatggtctcgatctcctgacctcgtgatccgcccaccttggcctcccaaagtgctcagattacaggtgtgagccaccgtgcctggttgaggaattttttgtgataagtcctgttacagacatatgtaggacaagcaagatgagtagggcctacagggattttttgtgagtttttagaaagccctgtgatataggctgggtgcagtggctcatacctgtagtccaagctacttgggaggctgaggcaggaggataacttgagcctgggagatctaggctgcagtgagctatgatggtgccactgtactctagcctgggtgacagagtgagaccctgtctcaaaaaaaaaaaaaaaaaaagtccttgtgataatacttatcgcagacatgtgtgcatgagatcccctccttcgtgacctccccctccattttgggtctgatgtaagtgactccatcttggcattggcaactttcacacaagctgcttttcagacaaagacttaaaaactttgccacgtttctgaaataggatctttagctcatccttaacaaacatctttagcaactgcaaggctgttatataatctgattctgtgttcttttgtaaacatgcatgtgacagctttgtgatctgtcaggacagtggttatttgggaaaagaagcaatgaactcatgaaggcatctcaaaaccaggaagtaattccaggaatcaaggaaattttcaagcatcaaaagtaatggctggccagatgtggtggctcacacctgtaatcccagcactttgggaagctgaggcgagtggattgcttgagcccaggagttcgagatcagcctgggcaacatggccaaaccctgtctctacaaaaaatacaaaaattagccaggcatggtggtgcatgcctgtggtcccagttacttaggatgctaaggtgggaggattgcttgagcccggagtttgaggctgcagtgagccgtgattgtgccactgcattctaccctgggtgtcttggggagaaaaaaagtaatggccaggcatggtataatcccagcactttgggaggctgaggtgccaggatcacttcagcctaaaagtttgagactagcctggcaacatagcgtgacctcatttctatttaaagaaaaacaacaacaacgaaaaaaaaaacaaaaacaacgcctgtgagaagggaaaaagaaaaaaaataaacaacaaaagccacataaaagcaatgagaatcacacactaaagtaacatgaacccatctattggtttcaatgggttatcagtacatggccgtcgtgtatttattcttggagtatttccttggagtattttgaagcaatttcagatatcattttatcacttataaatacctaagtatgtttctttaaaatataaggaagttttaaaaacataaccacaatgtttttaaacatttttaattaaaaattaaaacttaaaaggaaaaaaacaaccttaaaaataattatttcatatcattaaatatctggtcagttctaacagtaaaatatttatttagttagttagctagttgaagacagggtcttactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtgtgattgtaaataatgctgcgatgaagaacttcatgtctataactttttctctagttgaatcatttccttaggatttctagaagttgaataacagtacaaaaagtcacataatgttttattaagtctccaattgtgtgtgtgatgtattacggagttctttgtttatgcccgaagaccttaacagcctcttagtagttttaacatagtggtggttcatggtcttctgctcagggaatgcattgctgactgtttattatacctcatcctgcatggaattctttggtcatgggtatcctcatacctaaagtgggaaagattatatagtcttcgagatagagatgagtataggaaaactggattctgtgttttcactgtttttaaagggtaaagtagaaattaatagaacacgttgaggtgatcatttaaatttagcattaagcttgaatctttttttaaaaattacttttttttttttttttaaatagatggggtttgactatattcctgaggctggtctgtaactcctgagctcaagtgatcctccctcctaggctggatgcagtagctcatgcctgtaatcccagcactttgggaggctgaggcgggtggatatgaggtcaggagttcgagaccagcctggccaagatggtgaaatcccatctctactaaaagtacaaaaattatagcatgcctgtaatcccagctacttgggaggctgaggcaggagaatcgcttgaatctggggggtggaggttgcagtgagccaagatcttgctactgcactccagcctgggtgacagagcaagactccatcttaaaaaaaaaaaaaaaagtgatcctcccttctcagcctcccaaagtgctgggattacaggcatgagcctgtgcgcctgcctagcttgaatcttgtttggattattaaactgaggattctgggtgtggataagagtctgaataggttatttaaaactacagtgagcaatatatgaggagtttgttgttggtatcatttgggatgcagagtgatggtgtaatacaaagaactggacttcagagtcagatctgggttcatgtcatgacccagccatgataatactaacaacagtcataatacaaataattaccatttattgagcatactatatgccagacactatgctaaaccttttatatatgtcatcttatttaattttgacagtaatcctcaaagatacgtttatgatcttcattttcctgatggagaaactgaagttagggaaggttaaatacaaagcctatggcagagctaggtctgtctctatagtctttttaaataatttttttgttttcttatactttctgagacagagtctcactctgttgcccaggctggagtgcagtggtacaaccatgactcactgcagccttgacctcctgggctcaagcaatcctctcacctcagcctcctgagtagcttggactacagatgtgtgccatgaggcctagataattttttttttttttttttttttgagatgaagtcttactcttgtcccccaggctggagtgcgatggcacgatcttggctcactgcaacctccgcctcctgggttcaagcgattctcctgcgtcagccccccgagtagctgggattacaggcgcctgccaccatgcccggttaatttttgtatttttagtagagatggggtttcaccattttggccaggctggtctagaactcctgacctcaggtgacccacccgcctcggcctcccaaagtgctaggattacaggcttgagccactgtgcctggcaatgcctggctaattattttattttatttttgtagaaacagggtctcactatgttgtccaggctggtctcaaactcctgacctcaaatgattctcccaccttgggctcccaaagtgctgggattacaggcatgagccactgtgcctggcctgcattagtgattaacatcttctcaaagttttcaagtttaggcattaagtcagggcatttcagctcttctactaattcatctttttttcactcaacttggtttttttcagagtttgaattcttatacaaatggagcgtatggtccaacataccccccaggccctggggcaaatactgcctcatactcaggggcttattatgcacctggttatactcagaccagttactccacagaagttccaagtacttaccgttcatctggcaacagcccaactccagtctctcgttggatctatccccagcaggactgtcagactgaagcaccccctcttagggggcaggttccaggatatccgccttcacaggtgagttgttttctattgggaaaaaaatgaattcaaagtctctgcctcttgtaaacagtggaagagcatctgttcatactagtgctgatttaataagacacttctagattgggaaggcttttatattgatgcctttcttatttgtggcagctattgcagtaaatggactttggctgaaggtcataatcataaatttttatactgaaagtaatctttagagagttgctgcttgaaagtttccctatcttagccttttttttttttttgtggcgtgatcttggctcactgcaacctctacctcctgggttcaagcaattcttctgcctcagcctcccaagtagctgggattacaagcacgcgccatcacgcccagctcatttttgtatttttagtagagatggggtttcaccatgttggccaggatggtcttgatctcctgacctcgtgatctgcccccctcggcctcccaaagtgctgggattacaggcatgagccaccgtgccaggcaaatcttagccttttttagcaccctgttaggttcttttttttttttttttttttgagacggagtctcgctctgtcgcccaggctggagtgcagtggcacggtctaggctcactgcaagctccacctcctgggttcatgccattctccggcctcagcctcccgagtagctgggactacaagcgcccgccaccgcgcccagctaattttttttgtatttttagtagagatggggtttcaccttgttagccaggatggtctcgatctcctgacctcgtgatccgcccatctcagcctcccaaagtgctgggattacaggcgtgagccaccgcgcctggccaggttcatgtttttttaatattctgtgaataactatgtttatttctctgttcacttcaagaggagttctaacatgtctttatttgtgcttccttatagcatatgggtccgtttgtttatagtatctatgggacagacttgggtttcatccattgaatttttaggccttattccttctgagttttattgtcattaaatctacccctggtatctttggaaccaactttttgaggcttggagaaattactgcagctgattaattagatttactacagtttagtccggtagcagctaatgtatactctgttaagaagagaggaagcatctcagaatctgcctgtagcagaatatttttattataagtttttcacaatgactggtatatttcttcttctcaatctagaaccctggaatgaccctgccccattatccttatggagatggtaatcgtagtgttccacaatcaggaccgactgtacgaccacaagaagatgcgtgggcttctcctggtgcttatggaatgggtggccgttatccctggccttcatcagcgccctcagcaccacccggcaatctctacatgactgaaagtacttcaccatggcctagcagtggctctccccagtcacccccttcacccccagtccagcagcccaaggtaggagacctaaatgttgttcctttaatgtgtgtgtaattaggagaacataacatggtttatatagtttctgtactggtttgtgttaaatggggactaattacaaaaagttggtgactacttatctatagctttacctcagctcggtttcctttttcttttttttaatagactttatatttagagaagatttagattcacatcgtttttgttaaaagacagaaagatacacattttctgtttgttgtaattcttctaaacgttaaatgcaaagatgcattttactacttcaaataatctatgaacagaagacaaaaccaatgtgaaatatctgtagcatgagcttgtatttaaaccacagacttgaacattatcacttgtggctgtgttccttttcaagaccttgcttgaggtttttaaccttttaggggaaaaactaattcttattaattaggtcacaggatggactatgaggtgctcatggtgatggacctgccacagggcaggttccagccattataactcaaaaattctgtgccttttgtctgacagggcactcccttttatcttcttaggactgtgtttttttgcaaatgattaaggagaggggtccaattttattgttagggaatcttttcatgtacctttctggtcaagtgaaagatgtgggctaacaaatttgatgttgatgcattcccattaaaacagctcttttcctctttttgctctcccactccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaattgtctgtttaataaaaagacatttattaccattattaacagtcattttagagccaaatttaagaaaaggatattgaaagggtctttattggccttgtttgggtaactctatgctgttagatagaagagacttaggtaaataactttttatgtctgaggtgagtacacaatattggttcttggaaaaatagctgtttcttcataagatacccaagtgataattttttttcccctagactgtcaggcctatgagtaaatactaaatctattagctgtccccactcataaaccaaaccaaaccaatacaaacagatgaggagaggaaatgtagtaaaaatactggctgggtcttatgattgggatgagtgattttataagataatatggtgataattttattctaggattttatttttggcctaatataggaatgtttaaaaaaggcttttctatgaaaattagaaatttatacttgaaattaaaagtctagaagggggaggaccttaaagctaagctaccagtaagacaatgaataattcagaagagaacactattcttttactgactgagtgcccaagatgccaatttccatgaagtcttgatttatatatatgtacacatgttatgcacatacatgtttgttttctaacagttattttttaagcttttgagataattttagacttacagaagagttgtaaaagtagtagagttcttgtatactctgcacccaccttgcccttatgttaacatcttacgtaacaatagaacatttgtcaaaa

SEQ ID NO: 13628 - DNA, 18303 bp, Human
tttgtttaattatacattggaaactaacaaggttctggaggaatttcctggttttggctataaattatgtggaccttttttaagcagccaaaacagaagatttcctttacacggacgattgcatggttatttcttgaatatttgacttgatcccatgaaggtcaatattttaaatgtgatgcagttgtttctttatgctatagacttgtagtctgtctgcattaggaaaagttttgaacaacctaatttgtttgaacacagactacatgaattgtgtaagtgtgtaaagctgtttgcaggaatataccaatgtgtatgtttggcagaggggcaaattgttacctcctgaatcactgtatatgccatgttttgcgataagattgcttgcattttctgctcaacaatgtgtatcttctgtttgggaaagcactagtgatggattactttttaaagcaatacatttagcttgcaaattgtgcctttaaaaaaaaaaataggcagacttttgagggccaagaaggaagctgtccagttttccaaaaatcctttttccctgctatcagaaatgtgaaaccaaatttagcaaccaagattaatgaaaagatgggttttccattagtgctgtccctatcttgttcttggctttgttatgtcctttcccctagactgtatcccgacaaaatgtcctagtaacaaattgctttttaagctcctgttctgggaaaactaagcattaaaattgattattctaaaacataaagtggactaaagccatcctattttataattttctaatgcaaagtggtttagtatagagttaacacttagaagtttatagtttactgtttttattcttatgtactgtaaggaccatatttgagtttttggtctattcctaccattgtttctttgtggggaggagttggggcggtttgggggattggttttttttttttgtttttttaaactacaggtatttgtaaaacaatgtttgggttcaaacaaattagttgttaaacatctgtaatccagttttctgtaaatgttgctgttgttctaagctctgttaatgttaagcattctttgtatataaaattacaataaaatgttaaaactggttgcttgttttgtggatgaatgtaaagacaaaccccaatgaatggctgatatgagtgctaaatgcctgaagattcaacttaactagaaatcactcccttagaccctgcttacatctagaccttgtatatcatacctcaaagatgaaattcataaaacttatctgaagagtttaatttaaaattataatgctcaatgcacatcttttgcacttgagttgaaactaacatcactacctaaagagccttctacttctaatatctgctgcataatacgttcagtcattctacccccatccctacctccacattgtaagtataaattagtcttaatgctctgacacttgaattatttttaaaacatcaagtgtttctattctaacttaatatcagtctttaacttgtagaaaagtagtatgcaagtcttaatgtaaggtacaaacagggtctaaggtttgagtgcccccagaatgactttcttcagccttgcagacacctaaacatcatgtaattacctaaggaattcccaagtgcctcttccaggttatacgtgtaaatagctgtttttatgcaagattagttagatactgctctttacaggatgagtggtgttgtctttggctgtgtggtcttaaatgtgtttctaatgtgtgtgtcaaataattacctgttaaacagactgccaatctggctgaagccaatgcttctgaagaagataaaattaaagcaatgatgtcgcaatctggccatgaatacgacccaatcaagtaagttcataaatattttatactaataggaacttttggggtgggttttcccccccaatcaaaagcactattttttcaaagtcctcgtatacatgtaattttttttcccccttttagttacatgaagaaacctctaggtccaccacctccatcttacacgtgtttccgttgtggtaaacctggacattatattaagaattgcccaacaaatggggtaagttcaaagcagaaactatggtatatcttactttttttcctttggaattgttccttagctatcttatttttcttggttaatactgccttctgtagacaatggcaaatgagcatggtctctggagccaaatttgccaggcttcaaatcttggttctggcacttggctgagtttgggcaagttacttgatctctataagcctgttttttcttctctaaaatggagataaaatagtacgtacttcacatagcagttacaaggattaaatgagatcacatatgtaaagcactacaagtaatatagtaagcactgtataacattagctaatttattaaataaagataactgctttttctcttcctcctcctcttcctttttcctctgaataggataaaaactttgaatctggtcctaggattaaaaagagcactggaattcccagaagtttcatgatggaagtgaaagatcctaatatgaaaggtgcaatgcttaccaacactggaaaatatgcaataccaactatagatgcgtaagtatgcaaattaggtatgacctgtggagactccagtcagtcccagggtatagtgttttaatcttgggcttgtaactttgctacttggattccttgagaactttgtataccaaagccattagtctctacatcttgcatttctgtgaggctgcagtctgctccatttaaagcaaatttaaaatggatttggggattttttgttaccagtgagtgccacttcccttgtagtcttctaattttttctttttctgtcattccctgctttcttcctcattcacatacatactcccacataatcttattatatatgctacttgcatttttaagtgaacaaaacagattgtaatcattttgagaaacaggaggcttaagaataaaagctctgcatgatgttgaggcaaatttaagtgtcaggcataaatgaaatactgaagtagcttgaataagtttggatatgccatgtgagtcttaagattctcaagtaaggtttattttataaaccactagttcagatcaactatagctctataaaacaccttaatgcctttttttttttttttttttttgagaccaagtctcgctctgtcccttaggctgaagtgcagtggcacaatctcggctaactgcaagctccacctcccaggttcacaccattttcctgcctcagcctcctgagtagctgggactacaggcgcccgccaccacgcccggctaattttttgtatttttttagtagagacggagtttcaccgtgttagcctgaccttgtgctccacccgcctcggcctctcaaagtgctgggattacaggcatgagccaccacgtctggcccttaatgcccatttttaatgtgtattcagattttatattatgaaccagtttttaatgaaatggacagacatgaaaattcagtggcagggttcaactagataacctcccattttatctgcttttattaatgtagtcagttacttttttgattaccttcaacagttgtgatctcacatactatacagcataatattaagtgttctttggactgctgttctctaactttgttgagcataagaatttcctacaaaagtatgttaaaaggctggccaggtagagggaccttgggcaaaaaaaaaaaagatcctggttgctccgcccccaattttgatttagaagttatgtgataagaccctgattctacatttttaacaggttgtccaagagattgtgaagttaggggatcctcagggcatcaatttacagaattaggtgttcatgttctcagtgaaaaaatacatacatatataagaacagttcctcagcttcatgctataaatattgttgaagtgtagtgtagtgagcaggtggggatgatgatgaaaatagctatgccatagaatgatattgaaaagatcttgtgtttttgaatatgtacttcagcaaatagtgttttcgttcacagataagaatgttttcctaaactcccaaccctgctcacttcctcaacttcacccccatctattttttatcagtcaccatcctgtgtttttgtggttcatcattgaacagtctgttgttatgctgtttctaattcagagacatttcatagatgtttccaaataactttagcttgaaattgattatttttacagacacaattaagagcagaccgcttcatctatattatgtaaaatttttaagtaaaaatttgtgttggaaaaattagtatcacctgtaaaccctaactaataattaacttcattgcttttgaatgctgaaatacaaatgcccaattgtgccagacacacagcaaatactggggaaagatgggaatctaaatattttaaatgaaactttcaccctcttcactaacaccactgataagcaactcagactcttcttctgtttctttttctatcctctgttctcctctttttttcttttttttttttttcttttttctctcttttgggcagtgggagactcctctttcacaaattgggaacaatggggcataagcaaattgatacttatttctggaatcgtggtgatgtctatggagcaactgcaacacaaataacacacctaaggtaccctactctgtacagccgagattctttcattttcagcattgagataaacacactctgttcctgaatgaaatagaaagggtttctctagggattcctgtgttttgcaaatttgcctgattacagagaagatgggggtgtagaagcagtggtgacaagtctgagaatagctatttttattttttaatactatatttaatgcccaacatttctgcaaaatgcatttctacaaaaaactggacctagaatgtctaatgaggtgttactttacatttttgtaacaccgattttgatcatttaagtcactaatgcttcttaattgactataaattgattaacctctcttaaaatactaataagtagatcatgggttttggtatctcattttattaattatttgtgtggtaatgacataatatttcccttgaactatctttccttaattgtataatgtcagtactaattttaatttcccgtcttgtggcatttactccaataccttcacaggtttgagagacttttgggttatggagaaggggagattttttgggatttttaattttaattttcatttttatttttttcaagaaacttgatagagtaggaaaaattgtgattatggtgttgtctaaattcaagtcttgtctttgtcacttaaatagaactttatggcacagaacatttcgctttatttctggccctcagttcttaagagtgacgggttctaagatccttttattgtttttgtagcatttctttgcttctttttgttatgcttgtttagacttttgtgtctttgtttagggttaggttgtacataattactcccttattttagaagatatggtgcttgtctaaactaatttggcattgcgctgaattatgtgttcccattatgttatagtagaacatgtagcatgagtactctgccttcttaacaatggtaaaacatgaaaactttcttttacagagaagcatatgcaattgggaagaaagagaaacctcccttcttaccagaggagccatcttcttcctcagaagaagatgatcctatcccagatgaattgttgtgtctcatctgcaaggatattatgactgatgctgttgtgattccctgctgtggaaacagttactgtgatgaatgtaagaagtgctgaatcttggaagatgtatattttagaatatttgtatttacttggaatggctcttcccaacctcatatgttttaataataaaataaataatgttgatgacaagtgttgatcaatgagcattaagtagtgagaagtctgtttttcttgctgtatcttttttaaacaataacctgtttgtccttttaaattctagaattgacttctgtaccttcatcagggtgactatactgaggtgtttttcttaatatagactttttgtttcctgtatgttttaagtggtatccagaattttaaaacttttttgggccttagataattctggaaatatttttaagtggtatctaaatctttttcctggattgtgaatagcttatcctaatatttctaagtgtattaacacctgattcctgtagacagtttttgttttttttttttttttttgagacagagtctcactgtctcccaggctggagtgcagtggtgtaatctcggctcactgcatcctctgccttctggcttcacacaattctgcctcagcctcccaagtagctgggactgcaggtgcccgccaccacacccggctaatgttttgtatttttagtagagacggggtttcactgtgttagccaggatggtctcgatctcctgacctcgtgatccgcccacctcggcctccccaagtgctgggattacaggcgtgagccaccgcgcccgacatctgtagacatatttattacccagcatttaccatgcagttgtgactttttaaatcacttatattagcacttagttgtttcctgccacttatcctaagtttgtgccttcttacacagaagaaatcagtgttacctgaaaatttgctcaagcctgctctggcctttttcatttttaaaggtagttttgaaatatacagtcctcatacacatggttctgcatctgcagattcaaaaccacagatcataaatatttgggggcaagaaaacagtaaaaaataatagtaaagactaatacagattttaaaataagagtataacaactatttacatagcatttatattgcagcaggtattacaagcaatctagagattatttaaagtatactggaggatgtacatagtattatatgcaaatactatgcctttggggcagttgagtgacttgagcatctacagacgttatcttcagagggttctggaacccatcccctttggatacctgtaaatctttattttttgacctcttcagtgaagaccaaggtcaagaagaggttgctaaagacttgtttcagattatatcttagatttaacataccacttggtattactggagttttactacattgaagcttaatcttcgtatctgtaatttagtgttgctcccacgtactgtgctgtaggtctctcatttccttgcctgaataaaaaccccaagttagccatgtaaaatttttgtctttctagactatcttatatttctcttttgttttctacaatattccagttactagctaaacaaagaatagtctttgagaaagagtgcttttgctctcaattcagacatttgtttaaaaaaaaaaaaagatggggtgggggatccttgctattttgccccaggctagccttgaacttctaggctcaagtgattctcctgtcccagcctccccaggagtggggattacaggcacatgccagcacacccagctgtgacttctttttagcgtagcataggtcatatagaaaagagcagaggagtactgtaagatgagagattttacttaagtttcttaatctaagaaatgattagcacgacatgcttggaaaacagtaatgtaactgaacaaatgtggaccatccttttaattcatttcgtaaacactttgagttcctactatgcttttattaatatttgaaatcttatacataggtataagaacagcactcctggaatcagatgagcacacatgtccgacgtgtcatcaaaatgatgtttctcctgatgctttaattgccaataaatttttacgacaggtaactgtctgtatccattttatgaaaaaattctttttaactgatttaactgtacttcagtgaatactgcataacatttttctgcattattatgcttggtatctgtaggctgtaaataacttcaaaaatgaaactggctatacaaaaagactacgaaaacagttacctcctccaccacccccaataccacctccgagaccactgattcagaggaacctacaacctctgatgagatctccgatatcaagacaacaagatcctcttatgattccagtgacatcttcatcaactcacccagctccgtctatatcttcattaacttctaatcagtcttccttggcccctcctgtgtctggaaatccgtcttctgctccagctcctgtacctgatataactgcaacagtatccatatcagttcattcagaaaaatcagatggaccttttcggtaagcctgtgtgtttttcactgttagaaaccaaatgaggtcaatgatgtagtgttttgttgttggttatcacttttaacagctttcttagtggaccactgtgctcagtaatgtgggatgacttgtaagaagtgacttagtcttattgggggaagaggaaaacaaacgtgattgatttggcaaatgaggattaagcatcctgaggtcaaatactacacaggttgccaaccagcccctattaaacgttgaatgttccatataccataacagctctgaacttaacagaggtgggagaattcacttgtgatcataatgatagttttggataggagtagttttgagtagaactaagaacagtttagataggtagagaagagggggtaaaaacacaggtaagtagagaagtcaggaatagtgattgttttggagcataattattatgtaggagaatagtgaaaactcacagcctaccacttcagaaatgagacttttgtccatgtagtttaatgtctcataaattctttaaaaaaaaaaaaaaaaggtgtaagaggcccatttcagacacactgaagcaaaatctttaggatgagacctttacatttacatttaagaaattccactgatctggtggaatttatttggttgatagtggaaataggcccagagagttctatggctgacccaagattatcctttcagtttagtggtagaactagagctaaaacttaactcttaatcctagggggatttttgtcttcataggccagactttgattttaagttttactattcttgcaactgatttctgtcataactgtagtatcttcttaaggaggtccttcattttacttttccacttactacatatagagaactcttcaaagtttcagccttctctcactttcctcagaagtattcatcatctttgacttaactcatcttaactgcaggtgatgggtaaacagcagcaaacttttttactcttaattgtccatttctgataatttttaatgtattataatttatgttttttaaagggattctgataataaaatattgccagctgcagctcttgcatcagagcactcaaagggaacctcctcaattgcaattaccgctcttatggaagagaaggtaaattttactggtgctttaatttgggattttttttacagcagggttttgtttttctggctttgttcttacctcttttttttttttttttttaactatttctgtttatttgtggttgtttctaaagggttaccaggtgcctgttcttggaaccccatctttgcttggacagtcattattgcatggacagttgatccccacaactggtgagtaagatcactttggtttagacctttttccctttaaaaaataattttagcttgatttaatgtgcaattttgtatttacctactgcttttattttttgtttctaggtccagtaagaataaatactgctcgtccaggtggtggtcgaccaggctgggaacagtgagtagatgtttacaataatcttcagatgattgcctgcaaactagataatggaaggtccaaactaggcaaactagataatggaaggtccaaactaggcagcgggtcgctgctctttattgtaaactttcatgtgccagattaacattttttatgtaaaatgtcaaaattcaagcttatatgagggttttttttaaatgagcaaatcttttctaaaatacaaaattttaaaagtttttttctactttcatatccaacaaatggggatcttgacaggacttcagtttaatgaatagataagaattacttgaaaagttattttaaatatggtggcagttattttcctagtaggtttaactttttctacccttaatttggatgatcaaagtttgatttgagtacataaatacataataagattaacgtctaccaaacaaaaattttttgtctgaaatcgagttgttcttgccaccctaaaatacaaagaactttgattttctctgtgggatattttatggcattaaaaatcagcagacttacttaatgtatttttagttatataattatttctgtttatataatccgattgaaaattgatatattcttaaaagtatgagttactagcaggatgtatcagtagaaggaacataggatttagaaacaggtagacttgggtttgaatcccatctccttcatttcctagctgcatgacagtggtcttgtggttttactccctaacatccatttcctcgtttggatttggaatgacactacctaccttaacatgtaaaatgacttcattgtgcccagcagacaaaagggctcttttccttgtatataacaataagttcacagagtaatttatagagtgctaattaaaatataatattacataaagtaatctattttgaggtctagttattgttatgatacagttaattggtgggggaaagttagttttaagtaaatataatatttactcagctctgtatccgaaacaaatttaagaactggggagtaggaaaaagttttcagagtagttaaaattggtgtcttaacagctatgcatggaaaggtcatgtattatacccatggagaaatacttgagcctatttttttttctcccacacagttccaacaaacttggctatctggtttctccaccacaacaaattagaagaggggagaggagctgctacaggtaggcatgctaaaaatcttggaaaataatcatcttattttttatatatatatctcaccaaagaaattaaagcacagcagtggcaggaaggaagggggtcatttgtttgtattgtgcttatccctcttaagtcctgggtagttgtccttaaagagggctagaaaagaataaattatatatagtatcttaaatgatggtttttaagacatttttaatattccttcccagtgattactttctccctgtcagcaaacagcagagtattggcttgcatttaccctcttggaagtagaagaaagtcaggggtcagacaatatctaagataccagtttaatttaagattaaagttaacaagctcagctcccaactgtgaacaagaattgcaactatttctcttctagaccccactgtcccaatcatctcccaccgtctcttttccaaaagaagagacaggagattgttagaggctcctgccctagtgggcgggtacaagcaatattaatctaagaagtaagaatcttactgtctaggtcaggggtccccaaccctgggccacagaccagtatccatccttggcctgttaggaactgggcaacacagcaggaggtgaacagcagctgagcgagcattaccacctgagctccacctcttgtcagatcagcagtggcattaagattctcataggagcatgaaccctgttgtgaactgcgtgtgcaaaggatctgggttgcacgcttcttaggagaatctaatgcctgatcatctaaggtggaacagtttttacccccctgcccccgtccatggaaaaattgtcttccacaaaacagctccctggtgccaaaacggttgagaactgctagtctaggtcataatcaccaccaggataaaggagcctccaaaacttcataacaagagttttggccaggcataatggctcatgctggtaattttagagctttgggaggctgatgggggaggattgcttgaggcctgaagttcaagattagcctgggcaacatagcaagactctgtctctaccaaaaaaataaaataaccagacatggtggcatgcacctgtggtcccagctacctgggaggctgaggcaggaggatcacttgagcttaggaagtcaaggctgcagtgagctataaccacatcactgcactttagcctaggggacagagtgagaccctgtctccaaaaagaaggaaattcgggatatcttctagtgcttcattgctaaacttatgaaagtttactatgtcattactggatcacattttaaaagaaggtaatagttattcatggctcactgaaaagatgcttaaaatctaaacccctactgttgctgttgtgtaccaattatttataatttaaagcacctctagtttaacagaagtaaccagttctgtttggtgaggcacaaattagaaacttagccaacactgttatttttacttaagcttttgagagaaagcgttgatattttcattgttaattatagaagttaaaactagaatttattctgctttgtatgatctttacccacttcctccctcaaaaaagaggttacaggagttggttttccttcatttaaacttttggggccaggtgtggtggctctcacctgtaaccccagcactttgtgcagatcacctgaggtcaggagtttgagaacagcctgcccaacatggtgaaaccctgtctctcctaaaaatacaaaaattagctgggcatggtggcacacgtctctagtcccagctacttgggaagctgaggcaggagaattcgcttgaacccaggaggtggaggttgcagtgagccaagattacaccactgtagtccagcctggacgacagagtgagactctgtctcaaaaaataaaaaataaatgaataagtaagcttttggggagagctaggtcatagcagcattaacctgtcagtgccttcaaaagacagtttaggaagtaacaggtagtaattagtggagtgataatcagtctgaacttcataaaagagaacttttaaatacaatatttccgtgtagagaaggtcctataaacttgcatcatctcagtcgagacatggccttaaaaattatgttgtagagttatttttacaaataaattgtactaatgttgctacactagttgaatagttggttctattccactgtttttaagtttgaaaataattatggatagaagagataagcttacttgtctcagatgactttagtttgaagaagtaatatcttggaatttatttttccagaagtataaaccgtgggcgacaccacagcgaaagatcacagaggactcaaggcccgtcactaccagcaactccagtctttgtacctgttccaccacctcctttgtatccgcctcctccccatacacttcctctccctccgggtgttcctcctccacagttttctcctcagtttcctcctggccagccaccacccgctgggtatagtgtccctcctccagggtttcctccagctcctgccaatttatcaacaccttgggtatcatcaggagtgcagacagctcattcaaataccatcccaacaacacaagcaccacctttgtccagggaagaattctatagagagcagcgacgactaaaagaagagtatgtattctaatttgaaattattatacacttttttcattttctgataataacattaaataggtgtctggaaacgttttccagtgtttccagttagtatgagaaattcacctaaaatttaaaccaaagccatacaagcaacttctcagggattcctagtttatagttttaaagtggaaaactaatggcaatttcattcatttcattcatgatctaattacatttgtcttgttagttttcttaaatggtttttgttaactttcactctttaactttattttactagggaaaagaaaaagtccaagctagatgagtttacaaatgattttgctaaggaattgatggaatacaaaaagattcaaaaggagcgtaggcgctcattttccaggttagtgttttgcaagccttcacaacagaattacaaacgggactttgaatatccagggattagctatggatataaagaacattgcacttaggaatttttctgattcggtctaggtgtatagaagtgaagatgtagcttatttcccaatatctgttcattgaaataatgtctcagtgtaaattttattgtgtagaactaacagttgtggggattaaattgcccttgtcccttaaagttattcatagtatcaaataattgggaaatgtttttggaaggaaagaaataggggaatagccaaaaaacagttcccaggacccttttaccataaggctacagcttcttgctggaacattaacctgcgtaattatgaagtagtagtagaatacagatcgctttattgatagaaaaagtgaattataaaaattccctggaagtttgtttaaaagactttattttttagccttacacttgaaatgtggtttcttttaaaactaggctgttggccagtataggacaaaaaacagactcctacttcaatattcagataggaagtgaaatttaaaattaattgacattttgtttaatgttagttagctcatataactcacggtacattaatgcacttcactctaattgttaagacttcacttttgttttgtaacaagtgattgctccgatttgtgtactttattccattccagtagaggtcactgtgcctctttaatcatctaagatgaaatttgatataaagatagatgaaaccgtgaggaaagaatgctagaatctgagagtctgtgttttattttgtatgtatttctcaactatcaactattgttttgttttgtttttaggtctaaatctccctatagtggttcttcgtattcaagaagttcatatacttattctaaatcaagatctggttcaacacgttcacgctcttattctcgatcattcagccgctcacattctcgttcctattcacggtcacctccataccccagaagaggcagaggcaagagccgcaattaccgttcacggtctagatctcatggatatcatcgatctaggtcaaggtcacccccttacagacgctatcattcacgatcaagatctcctcaagcgtttaggggacagtctcctaataaacgtaatgtacctcaaggggaaacagaacgtgaatattttaatagatacagagaagttccaccaccatatgacatgaaagcatattatgggagaagtgttgactttagagacccatttgaaaaagaacgctaccgagaatgggagagaaaatatagagagtggtatgaaaaatattataaaggttatgctgctggagcacagcctagaccctcagcaaatagagagaacttttctccagagagatttttgccacttaacatcaggaattctcccttcacaagaggccgcagagaagactatgttggtgggcaaagtcatagaagtcgaaacataggtagcaactatccagaaaagctttcagcaagagatggtcacaatcagaaggataatacaaagtcaaaagagaaggagagtgaaaacgctccaggagatggtaaaggaaataagcataagaaacacagaaaaagaagaaaaggggaggaaagtgagggttttctgaacccagagttattagagacttctaggaaatcaagagaacctacaggtgttgaagaaaataaaacagactcattgtttgttctcccaagtagagatgatgccacacctgttagagatgaaccaatggatgcagaatcaatcacttttaaatcagtgtctgaaaaagacaagagagaaagggataaaccaaaagcaaagggtgataaaaccaaacggaagaatgatggatctgctgtgtccaaaaaagaaaatattgtaaaacctgctaaaggaccccaagaaaaagtagatggagaacgtgagagatctcctcgatctgaacctccaattaaaaaagccaaagaggagactccgaagactgacaatactaaatcatcatcttcctctcagaaggatgaaaaaatcactggaacccccagaaaagctcactctaaatcagcaaaagaacaccaagaaacaaaaccagtcaaagaggaaaaagtgaagaaggactattccaaagatgtcaaatcagaaaagctaacaactaaggaagaaaaggccaagaagcctaatgagaaaaacaaaccacttgataataagggagaaaaaagaaaaagaaaaactgaagaaaaaggcgtagataaagattttgagtcttcttcaatgaaaatctcgaaactagaagtgactgaaatagtgaaaccatcaccaaagcgcaaaatggaacctgatactgaaaaaatggataggacccctgaaaaggacaaaatttctttaagtgcgccagccaaaaaaatcaaactcaacagagaaactgggaagaaaattggaagtacagaaaatatatcaaacacaaaagaaccctctgaaaaattggagtcaacatctagcaaagttaaacaagaaaaagtcaaaggaaaggtcagacgaaaagtgactggaactgaaggatccagctcaactctggtggattacaccaggtagctgagtgtagggggtgggtgtggaactttgttgggagaaggattttcttcagttttatccatgcttgtgctttttatattaattatgaatgctgatctagggaagtaggctggttttatgtagtcttttgttgtctttgaagaagggaattgccaaagacaaggttgtaaatagattttgggggtgagccacatttgtgttgatacaatcataatcttaaattgtgtgtcttccttagggcagaataagttttttgttttttttaatgttaaaaggacatttgtgtttaagttagcatttttatatttatcagtgttttataattaatagtaaattcttcattaattaaaaatattttgttattctttttagtacgagctcaactggaggcagtcctgtgcggaaatctgaagaaaaaacagatacaaagcgaactgtgattaaaacgatggaagaatataataatgacaataccgcgccagctgaagatgttatcattatgattcaggttcctcaatccaaatgggataaagatgactttgaatctgaagaagaagatgttaaatccacacagcctatatcaagtgtaggaaaacctgctagtgttataaaaaatgttagtacaaagccatcaaatatagtcaagtatcctgagaaagaaagtgagccatccgagaaaattcagaaattcaccaaggacgtgagccatgaaatcatacaacatgaggttaaaagttcaaaaaactctgcatctagtgaaaaagggaaaaccaaagatcgagattattcagtgttggaaaaggagaaccctgaaaagaggaagaacagcactcagccagagaaagagagtaatttggaccgtctgaatgaacaaggaaattttaaaagtctgtctcaatcttccaaagaggctagaacgtcagataaacatgattccactcgtgcttcctcaaataaagacttcactcccaatagagacaaaaaaactgactatgacaccagagagtattcaagttccaaacgtagagatgaaaagaatgaattaacaagacgaaaagactctccttctcggaataaagattctgcatctggacagaaaaataaaccaagggaagagagagatttgcctaaaaaaggaacaggagattccaaaaaaagtaattctagtccctcaagagacagaaaacctcatgatcacaaagccacttatgatactaaacggccaaatgaagagacaaaatctgtagataaaaatccttgtaaggatcgtgagaagcatgtattagaagcaaggaacaataaagagtcaagtggcaataaactactttatatacttaacccaccagagacacaggttgaaaaagagcaaattactgggcaaattgacaagagtactgtcaagcctaaaccccagttaagtcattcctctagactttcctctgacttaactagagaaactgatgaagctgcttttgaaccagactataatgaaagtgacagtgaaagtaatgtttctgtaaaagaagaggaatcttcaggaaacatttctaaggacctgaaagataaaatagtggagaaagcaaaagagagcctggacacagcagcagttgtccaggtgggc

SEQ ID NO: 13629 - DNA, 93894 bp, Human
  misc_feature (1)...(93894): n = A,T,C or G
ttgagaaacatccccaacatatgtttggttgtttttttatttccttgaaaaacatatgtatgccgggcgcggtggctcacgcctgtaatcccagcactttgggaggctgaggtgggcagatcacgaggtcaggagtttgagaccagcctggccaatatggtgaaaccccatctctactataaatacaaaaattagccgggcatggtggcgcgtgcctgtagtcccagctactcaggaggctgaggcaggagaatcacttgaacccgggaggtggaggttgcagtgagctgaaattgtgccactgtactctagccggggcaacagagtgagacgctgtttcaaaaaaaaaaaaacagaaaaacatatgtatatttatatgtgtgtatatacacacacacacatatgcacacacaaatatataaattaaatttttaaatgagatagagtaaaatgcatttttgaaattattgatttattaacaaaactaaaagccttccttctcactaaaaagtgttgaaaaatccatgaattatgcaagattgttataacatttggctatcataatcttattcttgatatcaatcagtttttaaagtaatgagaagctgctgcatttttatattttttaacaaatggatttaaaatccactgaactgctcaattaaaagattgaaacaaaatagcaaattgtttccgagtttttaaaagcattttctgtgatgacaatcataaaatcttcagtaagaaaaacacacaataatgggaacacttcgaaatatttgttttcaaatcgtctcttcataacaacgtatcacttggtgtgaaaattaccttgaagaaacaacaaataaacctctggggttttttgttcttcaaaaagatctattagataacatgtactgagagccatatatcaatacagaaaagatcagcaaatttaggatatttggggtttttttgtaaaaataaagaaaataactcactttaagacaacttttaaaatctttgttacaaatgatttctacaattatgtatcatctcattacaaagtaatattaagattctagattctacgatttaaaagattttagtaaaattattcatgtagataaattactaaagcatgtaaactacagtatgtcacaatcccataaagacaatctactgtacattgttgattccaagatgtacatttttcatatttaacatctcaaacattgagagcggttttaaggtaatgcccagaagcgtggtatgcagttgtccacttctgcgggctcagcaaacctgtactgggctcagtggactagaagaaaactccagagacaacggggtgggggagggggggggacttaaaaaaaaattcgatagataatatacatatgtttaaaatctaaattttatttagagatatctaaataaaatctctaaactaaataaaattttagtttaaaagattctaaatgttgagaaagcattgttattgtttacctggcagttctttttatttcttactagcgcataaataatggtatatcttataattaaggaagtcttagatttaaagaaatctaagctgacgggtgcagaggctcaggcctgtattccctgcactttgggaagccaaggcgggaggattgcttgaggccagaagtttgagaccagcctgggtaacagagtgagagtctgtctttacaggtttaaatacagtttttttctaagtaatattgtcataaatattatgtcatgaatattatgcagagctgccgacccctctgtactctgggcagttttccctcttgcctgagaacaccacttataacacgggacctatacgggagtggtgacacgccatctgttcaagtttaacttttttctcattttttagacagcaaatacaaatggaagttccagtatgttctgcccgcactccagtgggcggtcttgtgcacagcccacttgggaggcctcggcgctcaggtgtggtaagagctgggcggtgcagagcacagagaaaggacatctgcgaggaaagttccctgatggctgtcaacaaagtgccacgtctctatggctgtgaacgctgagcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctctttatatatatatatgtatatatatatttttaaagtcttccaatacgatccgaaatggcttctcttcatcacagtcctaacgccctgggcacagatgttcacttggaggtactgggtggtggtttggctggatggaggggagggagcgcgcggactgagcctccaaggtactctctgggccggggcacagagtggtgggctcaaacggaagggaggggacggcgactggaaaagggcagagggcacccctgagggtccagccttggttcaggcccacagacgtggctcccgttgcttgaaaatgtatcaaatgtgagtaagatattggggggggccttccgtagtcccggatgagggtgaactaaccttgtctcagcagtctttcctgtggcctctggactgaccccgagtccctgcctggccagttactagcaagatgctctggtgcaagcaaattggccagcctcagttttctcttctgtgaaatgccccttcctttgtgaactatgaggccctcctcatctccctaggacacactaaatatcagtgtcagcattgtacgggattatgtatctgtaccattagatccaggtcttacaaatagtaacctaaaagcatacaaatagaccttgtctaagaacagggtcccggcacggtggctcacgcctgtaatcccagcattttgggaggccaaggtgggcagatcacttgaggtcaggagttcaagaccagcctggccaacatggtgaaaccctgtctctattaaaaatacgaaaattagctgggcatgatgacgcacacctgtaatcccagctactcgggagactgaggcaggagaattgcttgaacccgggagacagaggttacagtgagccaagatggggccactgcactccaacctgggcaacagagcgagactctgtcttaaaaataaatacatacatacatatacatatatatatatatacacacacacacatacacatatatatataaagaataaagctaaattagtccttttttccccatttttaaaactctagataattgttataatctgctatgtgtgtgctctgtgtagatgaacatctttgttgagcacctactatgtatttggtttttggatatatattatctaattccttaaaaacatggtgaaattgttattagtattcccattttacagatgtggaaacttacatgtttcacacagttagagagttacaggtttctggctcaaaactgtgttccttctgtttccacctctctggctcagaaccttataaccacctccacttgaacaaacaaacgttggattctcattttccattaataggaatggtacagtgccctatttctctgtccaacacataactaaaaggaccttagtggctaagagctaacactttccttccctattttaatgtgaaatcctcaatacattacactatctgttaggcacaacagcctccagaaaagtttgcaatatgctcttttccatatgtcatgcctcttgaatgtcatgttcattacataggctgataaattcccaaactttgacaaacggaatcttttctgtattagaatgagttttagtgtgaaaaaaaattcgaaagcacacatgtaatttttaaggtagaagaatccgccaagtacagtaggtattgggcatcatttctcagttgtggacttatttttgtattgctgcacctgctttgttctctaccaaattatttgtcatctttgtaattacgctcacagcactgctgtcaactcctacaaataaatttgtgcagaatggcgggacacggtgtctcatacctgtaatcccagcactttgggaggccgaggtggggggatcacctgaggtcaggagtttgagactagcctgaccaacatggcgaaaccctgtctctactgaaaacacaaaaattagcggggcatggtggcacacaccatgtggcatggtaatcccagctactcgggaggttgagacaggagaatcgattgaacccgggaggcagaggttgcagtgagcagagatcacgccactgcactccagcctgggcgacaagaatgaaacttcatctcaaaaaaaaaaaaaaaaaaaaaaaaagccaaatcccaaaggaagtcttatacaatttcctttgcccttggaagtttctagtgttcttcgctagtgtaacagtggtttgtttttgtttttgttttccaaataagtattgaacatgtacattatggtcagtgcatttgctggacttagacttagtgaatataaagaaatgtaaggcccagttcatgacctacgaagtcaaaattgtttgggaaaattttgagaatacttaatatgtcttaaatgataggtggcatgaagttaggaggtatggaatctagttttaatcaaatcagtctttcagtgttaaatcagatgaatgggcaaagagaggagtcaaaagcaaggccatctaacttaattctcgtagtgtcactgaaaagaagtaatactgccttttttcttataataatagcaggtaacattgattgagctcttgctatataccaggtactctgctaacagcttgtcatttaaccctcccaacaatcctgtgagataggtgctggttttttgtttgtttgttttttgtttttgagacggagtcttgctgtcgccaggctggagtgcagtggtgcgatcttggctcactgcaacctctgcctcccgggttcaggtgattctcctgcctcagcctcccaaatagctgggattacaggcgcacaccagtatgcccagctaatttttgtatttttagtacagacggagtttcaccatgttggttaggatggtctcgatctcttgacctcgtgatctgcccgcctcagcctcccaaagtgctaggattacaggtgtgagtcaccacgtccgtccagtaggtgctgtttgtattccctttttacagatgaaggaacttaggctgagtggtcaagtgatttgtcacaggccatatagctggaattatccgagccaagacttaggtgtcctgggcggatccactgctcttttcattactactacagttgctcaggaggctcttctgggagcttggactgaggtgatgagcgtaaacatggttcaatgcctcttggaggtagtagctttgtgggtttaacatgggagccctgaggcatgctgagaataaatgagaggggtaagcctgttcctgcagaatttaaaccgatagaagagggaaagcagttagactaacagagcatcaagcttggatttttatttctcaggtgctcatggagaagggaagcatagaatgtaattcgaatccaattctggatttatgtgtggtttttctgggttatcttggtcaacttacagatttttctatctgtagaataggatactaatcattactttatgtatttgaccaaatattaacaactaaattatatgctttgcacagtgataaactactaagtaaatgcctacaaaagattgttaaaattagaatcttaattaacctctattttgcaatgatatgcaggaaaagcaacacattaagtaaaatatcaggagatactgagatggagggttgttagtgtagagacttcagctgaattcttaatttatatgagaaacctggggaaacattgtggcatggtgatcactacccttagttttttaattcccctcccaagtgtgcctccaattatcttaagataattgtgaaattcttagaaaattctcaaaacaatgcaattatcttaatatgttaatgccttgtagtactttatgaaaatactcagtggttgcttacaaggtgaagcaaaacttggccaggactttgcaatacccaagatccaaagataaacctcctgccattgtccacaaacagagacttccagattgaggatgtcaaagaaaaaacctttccaatacactaaggaagaaaagttagtgaaagaggtttagttttctcaataaaggtcaattgctatttttaaaataaggaaaggaggctttgaagtatgaagttacctgccatggtgacagaggcagaaatggaggaaccaaggatggtgcccggggcctctttccagcacatcatccttcccaatagaagacagcttattttatcgataggcctagcaggatacagagagtgaatcagagaaggctggagtttccgaagctttattgaacacttgccatgaaagttttaggcttatgggagctattcaaagaaagaaaagaggtcatgtagtttatttgaaagtgtcttgtttctccaagactccattcgtatcttgtttctttctttctttttactgttatattggagaaatgcttgttcaatctataggataaaatagttctcagtacagatgattgaggggttggggtgggataaattcatttcaactctgatttgtttacgcacaacatttcaggagtctattatgtcaaatgggatgtatctaaaatggaaataaagacaaacagaattgacagaaacaacattccagaaaaaataggaaaagaagagagaaaagaataaaggaagttaagaaaaaaaaaaagccataaagagggaaaggagaaaacacattgaatttaaaaaaaaaaaaaaaggaacaaaaattcggaagtctcctgaatttgagcaagaaaagaaagttcctgtacttgggtgaaattaaagaggaaccataggacagcaaatgcttaccaatgaaattagagaaaattccaggcagcctcgtcagctgcacaaaaaggaaaacaagtgtgtgtgttaaatttggctcatgtaaacagtgcttggactattgaatagaaagaagaaaaagtagaaaaggttatgcattttactttccttccccttcaagccatttaccatgacattatgaatggggccggtttgatgatggggcctgatagacgggcttttgcccatgtaatggcttgttacattctttcaccaaatggtagacttggaatgaaaaacagttcattttcatgaccataactcaggaaatttcatgaagaagagaaggttagctaattggtaacttgatttgattatccttttccatcaccatagtggaatagcatcagatacggttacatattgtatgtgcgctgagttttgttgtttcatcctcttttgagggaggtgggcctcagaagtaatgagtcaaccttctgaagagtaaagcattaggcattataaatgctttactagatagatatcataaagattgtatgtaaggtgcctagcatcatgcctgaaacatagtaagagatcaaaaaattgcagcattagtattagtatagtgttaagattagcattatttttagtattatgctgctactgttgctattgattacaagcagcctcacatctagaagtgatgttggattagaaatcaggagactggccgggcacggtggctcatgcctgtaatctcagcactgtgggaggccgaggcaggcagatcacctgaggtcagttcaagaccagcctggccaacatggtaaaaccccatctctactaaaaatacaaaaattagctagccaggtgtggtggcgcatgcttatagtcccagctgctcaggaggttgaggcaagagaatcgcttgaacccaggaggtggaggttgcagtgatccaagatggtgccattgcactccagcctgggtgacagaacgagactgcatcagagagaaagagagagagagagagactgaggttctgatctggattttgctattaatgtgaacttgagcaagtcccctctttttttctaggtcacggtgatccatttgtaaagtcgggaataaatgacctctgaagtgttgtctgtatattgatctgctaccagtaaaacatatctctgtaagtagctttgcaggcagaagggaagaattttgttctttgcctcatttagtcacctgatcattaacgacattcatttatatgacaaccagccttgaggcacacttgaaacaatcatttggttgtctgtggtagcccagactgaaatgtcagctgttggaggggaagggagcagcagggcacagtagttactagtaactcgtgtagctccttcctcccctgactttttaagttctttgatggtcttaggaattaagattttttttacctggcctaacaaaacatacaactctagtacactgaaaatcatatgtgatttagcaaagaaatacaaacgagggaatcagcaggggaaataggaaccagcctcagtggggttcttactttgtgctaagtattctcatgaatccatgacaccatggactgttcacaataactttgccttaatcgtcaccgtaactttgtcgagctaggtattactatacctactgtaaggcatgaggaaatggtgctctcacagtcaatagcatatagcagaactgagattcattcacctttttcttttccttaataccactatttcccttgaccttaatacagtgctacagaagaaaaataatttggaagtagaaagtttttctgccaacatgagattatcacctgcgaaaggaaacttaagagtttcttttttcctagcctagcacaatacaattttgaagtagcttcatgctttgtgcttctctctagagcaatggggaaagaggctggtcagggagtaattgttgtctctgtcttcctaccggtcggtgtatttctggcttgttcccgcccaccccacccccatccccgatctgagacgttgttttcaccatctggaaactgtcacaacttgagtgatgagtcaatgacatagcacactctttgattttctgattcaagacagagttgttgttttaatatttaccctctaggcagggtatgtgaaggatgtttacagttacagtaggtttcattttattggaagatacctcatttacttgaaggtctttggggattctgaacttctcataaaaggagaagctatttttacctggtagtcagagaaaatgagcaagtttgtgtttggatcaatgtaccattatataaactcaaatttatcttccattttacctatttcatataaatatgtatgtttatataatatacacatatattttaacctatttaataataggacataatatatatgaaaacatatttcatatatatccatttttttaaatccttataattatcatatgagtattttactatttggagaatgttatagcttcataaattttgatccatgttgaaaatttctacaaaggggcgccatagatatcttttgcagttaggaagcagaaacctacttaatccctatgtagccattcattcagttatcttccagttcaatccataattttatctatgccagaatattccaaattttaatgcagcagctaacatagctactataggggtagaaaaactccgctccatcctcctagggtcttggttgagtctgaggattaaattgacattagattaacaggaaaaaaataatacaaatttactcaacaaatattatgggacatgggagacatgaaaaaatgaagacccaaagaagtagagtcagttacttaaatattggattgagcaaagaatagtaacctataaaaatgtgactaaattatgtggggatgccaaagtctgtacaaaattctcttggtctcaatttctcatccttgaagataaagatgttgttgactttctagtacagggagtgtctttcatatgggagtttcaccttctgattttaagaaacagcagggaagtcaaagtgatcttcttgcccctgctgtttttcaagtgcctttaactcaaatagtcaatatgtcagaagagtatattttaacacctttactaatataacaaaaaatccaaccacaatgtagtagaataagatttaatgtaagtagttttaatgtagttgcattaaactaaactagaagtaaaatagatgaacatacacacacaatttaagttttatccaggacagcacatgcctactatgtgccacaaattgtggcctctgcccctgaggagcttgcaaggtaatggaggagatagacaggtatctaaataaattagttctctttaattatggtacgtgctaagataggaagatgccagggtgctctgaggatactggcaggagggttcactctgacctgaagacataagtaaggcttcctgaaatctgaacacttctttccattgccactacaacacctgaggaccacgtcatcatcattttacctgtgcctctgcagtcatttcctaactggtctgcctgcatccaccctagtccccagagtagtgtgtgtgtgtgtgtgtgtgtgtgtgtgtgttaatgtcactcgtagctcgttacaccctcaattaaaactcaattaaaataagtaaaattcctaattaaacaccagtggtttcccatacatttgagagtaaaatctaggctcccttttttcgcaaacaagtccatagtaaatctggctcctgatgtcttctctaatttcatcacataccattctccctgcagtcactttctccaacagccctgaccttatttctgtacctctcccttggcaagctcgttcctctgcctccaggctgtgcattcaccattcctctgtgaggaaaagtgttcccacaacttcagttggccagcaccaattttagcccaagcttcgcctcctgcaaacgcctttgttgacaagtttctatcctccccagggtccctcctcttttatgtccttcttttattattacctgaactcaccagtttgttgcttatatttttgttttttgcctgtctactccaggatgttgtttccatgagagctaaaatcccttctgtcttgttctttaccgtatcccaaggacttggcacttagcagctgcttaatacatatttattgaatgaataactgaatgaaaggtgtctgaactgagtttagatggatgaataagactcacccagtctaaaaatagtgggaaagtaaagagaatagcatgaagggaagacacagaggcatgaataggcatgggacgggcaggagtataagcagctcagtgtcattagatggtagtgtcagcagagagtggtggatgtggctggtgataaagacagaaattagctcacagaggccattgtattccatgaccttggactttttggtttagagacagggagacctgcagattttggcttaaatctgtgcttctcaaacattttaacagtgactcacaagaaacacattttatgtatctgaactgagatccatccccagcttttagaagctgtcacattcattggctcgtggctccttccaccacttcagagccagcagcagcagagcgagtccttggtacctcatatctctctgacccactctcctgcctttcttgtacacttttaagggctcctgtgactatattgggcccacttggttaatccagaataatcttcccatctcaaggtccttaactttaatcacgtctccaaagtgtctttgccatgtagggtaacctgttcacagattctgggaattagggcatggacatctttggtgggccattttcctgtctaccacagggatgtttatagggagttttctaaagatcatattcctttccctccttcgcatctttctttcaatagacatttgttgagtacttactgtttcccagtgttaagtgctggtattcaacagtgagcaaggtagtcaatgttcctgctcttatggggcttatattctagtatagaagacagatgacaaacaagtaattaagtaaaggaataaggcagttacagattgtgccatgaagacagtaataaggtgatgagtaaaaaatcaactggggaagaccacattggtcagggagggcgtcggagggatagagacagtggtcagggaggggctgtctggggaagtaacacatgaactgaaatctaaagggtgtaaatatgtcagccacacgaagacgcaagggaagaggattctagcagaggacatggaaaatgcaaagtcctctaggcagcaaagggcattgttcaaggaacagtctgaaggccagtgtgaatggagcagagtgaaccaggcaaaaatgtaagcgatgatggcaagatgggaagaagtgaggccatgcagtggctgagagattgtgtgtggtatgggctgtggatatttttctaacagcagtagggacccgttgaagggtttccaatagtggtggtgtgcagggggtaacatgatctgatttatgtttttcaaagatagttggctctgtgaaaatggcttagaaagggcaaggatggtttggaaagacatgttgacggctagaatagactaggggagagatgacagtggtttggactagggtgaggggacagttggaatggagagaagtgcattgatctgtaacatattttggaggtaaagttgatgggactagagatggtttagctgtaggagatgagaaaaaggttagaatcaaagatgacttctaggtgtttttagccacctggggtaagaatatcattcgctgagatagaaaaggctgaaggaagaatgaatttggagaaagggtgccaagaatttaaactgaacaccttaatattgagaatctgttagacatctaagaggtaatgccaaggagacagatggatgagactggagctcagggggatgtgtgagttgatctactctgaaatctttagctagcagatgacatctagagctaggggaccaggtgaaatcccctacagagaaagtagaaatggaaaaaaaaaaaataccttgagtgagctaaggtcctccaagagttaaaaatcaagaggaaaacaaagagtagccagcaaagacttatgctaacattatttagggttttcctgaatgatggctaggctagaggtagaggaaacaaagggcgctttcctagaaccccacagggacaggagtgctttgtctctagcacttagtgtgcctagcacatgaaaggcagccatccatattgaatgaataagtgaaattttctgaagctcttcaatattttctggcatatgtctaggtatggggttaagaggtaaacttttgctttgcactgactactttttagtggcctgacatcacagaacttcccagcctactttatgaatttttggcctatctttaatagaatttaaagaatttgttactgaccagtagagccattccttgggtttgaatttgaaacagatcagaaattgccagcttatgttttctgacctattcaagataaaatcattctgtaaaataagtaattaaaaaacaaataagtaaacaagcttctctacaaaacccaaacaacccttggaattccttttttactgccaaagagatcaatcttttactaagttccagatgggttatgagccatttttcgatctactgattccagaatcacttgactggatcagaaactctcactggtcaaactactctgtatggtatgatgatgaagccttgtttagaaggaaaagaaaaagaaaagtgttgtgtgggactaagtctcagacaggttaagcaacttgcacatggtctcaagtatttaaacccagttctaaaggaccccaaagcctattgctgtggtctgaatgtttatgtccccctcaaatttatatgttaaaatcctaactctcaaggtgatgatattaggagatggggtctttgggaggtgattgggtcatgaaggtagaatttttacgaatggaactagtgaccttataaaagagatcccagagagctccgttgtcccttccaccatgtgaggtcgcagcaagaaggccccatctatgaaccgtctatgaagtggaccctcaccagaccctgaatctgctgacctcttgatcttgaacttgccagtccccagaactgtgagaaacaaatttctgatgtttattacctacccaggtcatggtattttgttacagcagcccaaatgaactaagacatccaaattccttctctaatcctttgctgaccccaagaagtctcactgagatgggatttggaaggtggctaagatattcgatttactagttttaaaggtacatgtcattttttaaaataacaagatctcaacaaggtggagaaaaataaagcggcacttgaagctcttctgagctattttggctctggtattttctgaacatatttaacatgaatgaatttgtcttcttttgcaaggaagaatacggagttctataccagagttgattgttgatggcacatacttttagaggatgctcattggcatttatgtttataatcacgtggctgttgattaaagcaaaaataggtaagatatttctgtaagttactctgtggaagaatttgtggtttaaattctcagttacagatgaagtatgtatttgtggtaaatgttctggtagttggtcttttgtagtcaatctctgtcatttaagtggataagtctggttctgtctataactaatagttattttatttaatttgcactaatgattaatataagggtccaattattttatttcttcctaagaaagtggcttggtaacccagctaggcatcacaaatacatgttttacatttcagcacatttttcttttttttcttttcttttttttattatactttaagttctgggatacatgtgcagaatgtgcaggttcgttacataggtatacattgtgccatggtggtttgctgcacccatcaacccgtcaactacattaggtatttctcctaatgctatccctcccccagcccccaccccatgacaggccctggttcgtgatgcccacccccacccccgtgtccatgtgttctcattgttcaactcccacttaagagtgagaacatccgctgtttggttttctgttcttgtgttggtttgttcagcacgtttttcttcctgcctcccgccgtccacaagtttggtttgttttttttttctgagacagggtctggctctgttgcccaggctggagtgtagtagcacaatgtttgcaatacttttttaatactcttttaaaactgtcttttttttcttggtacaagtatttaagtaaaaattataaatcataaatggtgatggaaacaaatgtgtttttttctgggaaggctttagtagtctggtaaataatttgcatataagagaggctggtttttcccggaactgtgttcctgaatgttcttccaatcctgctttctaaccactttcctggttatagttctgattatagtattactgttatgagacggatgcatattttcattcaaatacagttagacttcaatatgtttaccttctgttttcattgtacatcaccattataaccagagacatgtaggttaattatatttgcatgatctgatggagttaattttaccctgttttggggaattacataaactcttcattttgaaatgggtttattatcaccaactaaatattgcatctgtatcttattgcagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtggtgagcattccattttgaatttttaaaacttggtgatcttttggtatttttgatcttttggtatttggtgttaaacagaaacccaaatacaggttaatgttctttcttttcccaccacattgaagtattttatcttgataccgacctgagagcttcaatgtgagttcagaaactggaatcttatttggcaagtctctctctctctctctctcgccattaaaaccatttatctgttgtccttaactccagtggcagaaaaaatggatctctgcaggtgggtctttatgcttttttgacttaggagaatatgtttaaagctacagcctcctaaaaagaaagaagagatgtctttttagacttatgcagcccaggatgactacacagagttgaacagcacctctcgtcctatctaacttaatgcctcccaaaatagttcttccatccatgctcacccggaccactggttctcatacttaacagaaggtaaaagaaaacattgatcatacttactatcttttcctcagttctctaggaaactgactccagcaaaaaaaaaaaaaaaaaaaaaaaatctgctaacaattcatgggaagggggcatggggcagaggagttacacagccccagggaggcaagagggaaggagtgagccaggaaagggacaaaagcaaatgccaggtggtaacatcactggactggccacagcttcaacagaaaatgcagctggttgtttatacacttagggacattcccagaaagagcatatagaaatctcatgacaagagaaagaagaacttaactatctcccactggccaaagtccacctgacgggggctcagtttcccacactgctggcttgcattgctggtcccttcaggcagctgctgggggattagaactaaagtgtcagagttgacatctgcagcatgagccacagtgcacaggatgaaccagcagccagcagcacacctacctgcagttcgcaacctgtggcccatagccttgcaggtccaaccaggcaatcctataagcaagcatgggccctgagggattccatggcaccctgtgcctcagtggttccaaggaagctttggcgtggcagacaagagtcatgaagagactaggaagaattgctctagcaggctggctgaccaagcctcatagacatcatctctgtcataaaggcagtgatatagagctcaatgagactctgtccaggaaagatggaaacctcctctctgtgacctataaggatatatatatatagttggtgccaggtgattttcctggagggccaccagaagcacggagcagaagaccaagcaaatggccaagcagatcattggtaggaaggaggtataaactaggccaagtactcaccttccagctcagggcctcctgttcacaccactgtgagtcatatactctcagcattgacagcctgcggtatagtagaagtagcatgggctttgaatctcaactctgccagtggcagtgtactttagacaacttaaattatctgagcctcagtttctccatctgtattacgaagataataacatctacctcatgaaatggtcatagtaattagaagacctcttatatgcaaagtgcttaatcccatacaaggcacatgggaggcattcaggtgacggctttaggcttctcaacagcaacctggaatgtgggaggcaacaagagtcctgactacaaactcttttcaacttagaattctatactcaaagtatcagtcaaacgtgagggtagaataaagacattttaaactatgctcaaaatatttcctcgcatgcaccctttcccagggaactactggaggctatgctccaccaacccaagtaattagacaagaaggaataaaacattaaatctaagaaacaagacagccaaaggaaaaacagaaggaacttaggagacattgaggatgagcagtcccagaatgacagctgggtaccaggcatggagacaacctgtcttatattggaaaattcacaaggctccaagagagatcctcaagcagatgaaatggatagaagtcccaatacattgcagtatattgaacagtgattcagataattggcttgcaagtttgaaattttattaacaagaaaactaaacaaatggaaaaacaagataattactaattctaagagtaaaagttgtacagaaaatgaaaagttaatatagtattctatatggctcagtcacgagtagtgtgtgtatatgcaaaagtatacactgtgtaaatatatatataaacatatctaaatgtatatatgtacatgggtacgtatatatacacaaggaagagactttcgtttgtttgtttgttttgagatggaatctcaggctgttgcccaagctggagtgcggtggcgcaatctcgtctcacttcaacctctgcctcctgggctcaagcaattcttctgcctcagcctcccaagtagctgggattacaggcatgcaccaccatgcccggctaatttttgtattttattagagagggggtttcaccatattggccagactggtctctaattcctaatctcagtgatccgcccccatcagcctcccaagtagctgggattatagacacgcaccaccatgtctggctaatttttgtatttttagtagagacagggtttcaccatgttacccaggctcaaactcctgggctcaagctgtctgcctgcctcggcctcccaaagtgttggaattacaggcatgagccactgtgcctggcccaggactctaacttttaagtatgaacttgtaagttaaaacgactctcagaccacctgtgtggagtctctgagaaaagagtaaactattttaatagtccagggagaagtgatcaagtccttatctaggacagtggcaatgggaaccaaacatgggaacagacagcttaaacctggtggaagtaggatccactgaatttgatgactaactggatgtagaaaatgaagaagaaatgttgagaaagactctgatgtttccagtctatatgtcttagaggaagctgatgccccaggcagcttcataaaatggaacaagaatagatgttgaatcagagagaactagctcaaactcagctctaccacttactagctctgtgaccttcaacatgttacctaacatctctgagcctcagcttcttcatccattatatgaggttaatctgaatgcatccctcttgagtcatttatacagatcaaatggggtcatgcacctagtgtgcttagcacagagtgtggcacatagtaagagctcaaaggtttgttgttggaatttattggcaacattcctttattctacttccagcaagagcctccagtggttttgtgttgttgttgtttttttctttcttttttgaggcaaagtctcactctgtcacccaggctggagtgcactggcacaatctcagctcgtcgcaacctctaccttttgagttcaagtgattctcacgcctcagcctcctcagtagctggaattacagcatgtgccaccatacccagctaatttttgtattttaagtaaagaagaggtttcaccatgttggccaagctagtctcaaactcctaacttcaagtgatctgcccacctcagcctcccaaattgttgggattacaggcgtgagccaccgcatccagcgaaaagagacttttttaaaggaaaagtttattattctattaaaactatatgagctagatatcattatacccattttatagattcaactgaagctctgacttgtccaaggtcacacagtgggcattcctgtgcctatgtctatggtggatgctaaggacaaaaaagatatttatttaatcaataacagattttttcagtgtagacaatagctaggacttctgtagtatactcattttatctaacctaaaggaaatatgtatctacacgtgggtctgggtattagggtaaaatgggatgactgaatagctgagtatttctcttacctccattttgtccaaaaaattcctagtttgggtcctttcaccataaaatagctttatttaaaaatacacaccttacaatagaagggaccatgcttgctttgtacatctttgtatttccacatctagcactgtgcttggctcgtgggaggtactcaatgcctatgtacacaaaagaattaatttataaatgtccataaagtgctccaagagacaatgcagaaattagatttagatggtatagcccgggaggacatgactgaggcaactgggtgtaagtgtcttgacagcaaatatcaggtgaagaaagcaaataagtctctcatttttaaaggtttctaatatttgaatgggcatcactctaaaagaaattaatttattattaccaggggtaatggagctagcactggatgttcacctgtcagggaaaatggtagaatatggagtaaaaggcttggacttgagttacagctgagctggagccttgaatctgccacttcataattttatgatcttgggccagatatttcacctctctcagtttcctctctgaaaaaaaatataataatagtatctacctcatggggtgctacgctgtctaattcagaaaaactgcacatagcactgggctaggcatatagtatttgatccatattcactactattattactgtttctaggagaaatttacaccttaatggcaaactgggacttgaatggaatctaaaatagcttctagtttacctgggtttacggcatgtgggggacgtattgtcatgttgatggcagataataacaattcggttgaaatatcacctgtgtgatatataaggttttgtcttttctttttaaagttgctccagaacagcctcaaaatttatcctgcatacagaagggagaacaggggactgtggcctgcacctgggaaagaggacgagacacccacttatacactgagtatactctacagtgagtgagaggctgtatttttgcagctgttttgtagatcttctcttaaatgacatttagaaatatctgttttctttatttatttttattttattttatttatttatttatttatttatttatttattttgagacggaatctcactctgtcaccaggctagagtgcagtggcgcaatctcggctcactgcaacctctgcttcctgggttcaagtgattctcctgcctcagcctcctgagtggctgggattacaggcacccaccaccacgcccagctaatttttgtatttttagcagagacggggtttcaccatgttggccaggatggtctcgatctcttgacctcgtgatccacccgcctcagcctcccaaagtgctgggattacaggtgtgagccacggtgcccggcctatctgttttatttttaccagaaaggagaagcaatagatacttctagacaattagatactttttaaagagtttctatgtttatagttaaaactggttcattcatctacagtatgagagaccgaatgtcttgggtctgagttctaactcagagttctcttcagtgcatccaagatccaagttatagctgttctttcccactctagtagggttaaactggctgcataagatcgcttctcttttctgcagctgtaggctcttggggtcatgatacataaataaactcttccttgtggtagtttcccattcgcttggataagtttctttttaaagcaccattggctgacctaagagtccatgagaagagagagtctgggagattctgttccttgaagtagatttcatgatcccattaaagatccagctgatttgtgctattcctgagtgaggaggagatggaggaaaggaggggttctgtagtacatttactttttctaacctaaaggaaacatctattgacacgcgggtctcagtattagggtaaaatagcccaggattctactctggccactgctgtactaggaactgacaattctgtgccacagatgtcaaggtggccacagtgcttaggataatgtttggaactgccctggggagccaagatgacaagcagggtttggggaatttcagcagcgtaggcttggttacctatctacatgaatgtggaagaacatctcagttctaccaaaaaagggagttgggtgaagtatagtcttacatgaccatatagtacaaatattcccggggtgtatcccctagtcataagattgacctttaaaaattgtctagaattctaaatatttaaacattttgttcttttctactgtaagtagaaagtagcacataaaacatgttgctacacgtggttgtgttttgtttacaggctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacataggtacattttatttcactgtttcattggtactttataattatttttaaaatcactcaaatcttttttatatggttgtttcaagaaagacagagattgatggaaattggccaacaggcataagcaaaagatagaagttactttgatgcaagtaaaagggtgcattattctgagctatctaaagatggctatacaaagtgggatgttcaacattattctctctattgaagaaattagcccctggattcaaatcccatgaaagaaccagctactaatgataccacctgactgaggagagggtcctgtgaggtcattcaagatgctcagtgcaagcccttcttggaggaggtgtcctttcacccccatggctactcccattgttgtgagataggctacatgtgggcctgctaggctagagcagcgaggtacaaactataaataaaatttctcaagtcacagatgcatcttgctctgagaatactcacctccatccctggagtgagccagtacatttctgagcaaatgtaatcggtccagttgaatcagaggccaatctcaagcattccaagttctgaccatccaggcagaactgggctgcctgaagttccaacctcacactatgtgcttctcgcctctctttccatggcacttctctgcatacatattgctaacgatgagtctgatcattggcatttactatacacttttccaccatatttcttctcaggcttcctcccatttctttcatagaccgttcatctctaggctaccttctcgcccccttgttcttttcctctgtccctttgctatgaattttcctacgaacatttcttctcctcctgaggcagtcatcactagccgtctctggcttctcagtcattggaactcttgggtttggcacattggtttttgaaaaaccactggactaagtgtagttgaaacttaccactaatgttggtagtagttatttggtgaaaatgagatttgattaagggggattattttaaagattcagaagtgaatccagcttttaaaaaagttctttcttaaagcctggaacttttctcttgtatattttaccaaatttgatggttgtgcatctcagaactgagttttgtcaaactctttatagctcatgccagtacataagacaattgctgatcacagatcctgaaccacacttttttgtttgtcctggttactagtgaggcctcttcctccgtgggacattagaatcaaatttcaaaaggcttctgtgagcagatgtaccctttattggagagatgagggactggtactgcttaatcgactcagatatcggcccagtaacagcaggctctggaatatggtaattatctttagagtgaaggaaaaaacactgaagcattcttaatattgctgcgcagacctctgtcttttcatacagcaaaaaatagagtttaagaatatttatcccaaaagtacacacgagagaattatcagaaagtcatgtatgcctctgttgattaagaaatatcttgaattttgatctctgattctgaaatttttaaagcttttgtaaaccaatattaattttctatagtttatttctaacagaggattcatttctccttattatttaccctgtcctgttattattttttagcatttaaaaaagatattgaaaagagaaatattaagaaatgtccacagagagttatatagaatttaatattccaaagaaaaggtctacaatttaatataatattaggcattgcatgttttaaaataaaaggtataggattatgattctttccgggattgttgtaaaattcaatggcttataataacaaaggatcagtcccacagatagctgatattcaagagagtataactaattaaagggtttttttttttaaaaaaaaagccagtgctatgtttgtgttaaaacattcatcacatcctaattgtaatcaaataaaaaataatctctagtgtagaaactttgtagttttcaatcttatttttcagctggtttcaggattcccctcgagaacctacatagatgggttcttagtacccagagattttgttttatttttaatgagatgctatcatttcagattaatatcatatctattcggtaagacagtcactgatatttcttctcatttaatggtaggtctgaaaaacaaataagatcaaatagcctgggttttttttttttcattttatgttaaaattccttaaattagcaatctagtattaataggcactttaaaaaaatgtctgtttcaaggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaaggtatatgtccaaaatatacatacctatcggggagcaataaaggggagagaggggggaagatgtaatgatttccttggaatagaatctttaaactactggtgctgaatcaaaaagcatgactgcattagttaacaagttaatttttatattaacttaagtgctgaaactgttcaaggaaatatgtttgtgttgcaaggaaatttttaacattgggtaagttctactcctgtttgctatcagtcatgttggttataatgcttggttataacttatctctcttactatctcagtaacttatttcacagagctataaccagtaattaatctcatttcttgttaaagcttcatatgttttatatttttgattctatgaaaagtaatgtggctcaataagccatatggaaagcttgaaagaaagtaggctctggagacacatatttcaaaataaaatttagcatccagcaatcctctcttgtccaaatattataacactgtacttcaagcctttgatatttactgcacaaatgagaaccacctggccacccataactatgaaaaggatatcaaatgtgtttttcagtctgatgaatttttcttttttagtaattattgggaagggaatgttattgaagtataagaaaatattttattgaagcaaaaatgcctatgtaaactttatgccaatattaaatctttggagacacaagaaatagccatctgaatattagtttttaaaagcactcatttaggccggcatggtcgctcaggcctgtaatcccagcacattgggaggctgaggtgggcagatcacgaggtcaggagttcgagaccagcctggccagcatggtgaaatcccatctctaccaaaaagacaagaaattagccaagcatcgtggtgcgtgcctgtaatcccagccattcgggaggctaaggcaggagaatcacttgaacccaggaggcaaaggttgcaatgagccaagattgtgccactgcaatccagcctgggcaacagatcgagactgcatctcataaataaataaataaataaataaatgcactcatttagtgatatagtagagagtctttcataatttatataaatttgactcagagaaaaactttttggcatataatccattgttcattatctggagcttttgtaacattaacgtgcaaaatctaaattcttatttgtgaaatttatggatatgtgtgcatgtaaactagcctcataattaagttgcatttattttctgtgagctactaatggcttttgataactgatgatccttagcaatcatacatcaatgacattcaaggaacggaagggcctttagcagaatataatacctaatatatgattcatagaataatcttatattcttccttacttcttgtattaattgcatttttttttttttttgagacagagtcttgctctgtcacccaggctggagtgcagtggcacaatctcagctcagtgcaacctctgcctcctgtgttccagtgattctcctgcctcagcctcccaagtagcagggattacatgcatgcgccaccatgcccggctaatttttgttattttcagtagagacaggtttcaccatgttggccaggctggtctcgaactcttgacctcaggtgatccacctgcctcggcctcccaaagtgctgggattacagaatatattttaaaaattgtctaaaagtgaatttatccaacaaatgataatttattaccactcattttataataaaatctcttaatgttgaaccacttgccctctggttgttacttttataatccagagcttactcataatatcgttttattatatatagtcaaagtaatttttttaaagactatctcatgaattagattttgtttatatatgtggtacagataaaacttctgaaaatgggctatattttatatccaagttcaaggtagtaagtagtctgaaaaatatttaagttatatcacattaagctaaactataaactagggaaactctgggcttgtgaattcttgtcattcttactcacatatgataatgacctagttagagatgtgtgaaaaggtttttcttttcttttttaaaaagtgtttgtcttttgaattaaaattccttcaaggcagcacagtaactttcttatttcctataaaataaaccaccatcataacaatgagtatagcaactcattatggttatgaactcatggatgattatgaattgaacctaggaagctggcttattcagtcactgaaggtattcataaagagagaaacccatactctgagatacaccacctttaccaagctctgttggcttcctttctgtctctgaatctcccttttctatgtttgatttttctgtgggttgttgtaggtcttttttctcttactctaggctgcttggttttcaccccttacccgctgtttctgtcatcagtttctttatgaaacaccaactgatgtaaacgtaaaaggtgtgaattttttttaacacgtcttccttttaaccctttcaatgtgtactcatatgtaacttggcatttaaaaaaaattaatagtaagcttttttttttttttttttaggtactctctaaaactgtgaatgactctacaacagagtcagcctttttgcagcctttgcttctcaaaattgagagaaatgtaacatctccgggtggattggtgtagttgtttatatcatttgaacagtgggttagggcttcctttactccatagggccctttactatgtcattaaattcagctcctatcactgaaaaacactttttaaatgaccgaaaagtaagggataggaggaaagaaactactttgctgtgtttaagagaacagtcttgaaatcagcatccatcaaaggcaggcctgatagtgacactgggaagagagcagccacattttccttgtagtgggaaaacattcttgaatttgagctcaaggtgtccagacatgcctgagaacatgcacaggtattgagggaaggtgatctctcaccacttagaacacccaggaagagatgccaaaatactgattaatcagctattccttagagctatgttaccaatatgtctctgtctgttaatccgccattttaaaaagtcttatttgcagtttgtgatcttgctcaactctattacagctaacaaaggaatcgttgcatgttcattcgtactttggaggggcagagtggtaaaggagaaaccttcccccatcatggtgacagcaagggtgaggggtgaataatccctaaagggggagaaaatgaagagttaccagctgcagccacctcttcccacattgagaagctaggaaattcatgcactcatttgtaatttaaaaatattgccaagataagataggtgtgaacaattaaatactagagattattttggatagcaaacatttgataacagtcaagcttggtggattggcaaacattttctctacaggtccagatagtaatattttcagctttgcggatcatacgatctgtcgcaactgctaaatgtgctattgtcacatgcaagctgccattgacaatacctaaacaaacaggcatggctgtgttccaacaaaactttatttatgtatgctgaaattggaattttatgtaatcttcacatgtcactaaaaaggattcttcttttgtttgttttgagacggagtctggctctgtcacccatgctggagtgcagtggtgcgatctcggctcactgcaagctccgcctcccgggttcacgccattctcctacctcagcctcccgagtagctgggactacaggcaccccgccaccacgcccggctaattttttgtatttttagtagagacagggtttcaccgtgttagccaggatggtctcgatctcctgaccttgggatctgtctgcctcagcctcccaaagttctgggattacaggcatgagccaccgcgcccggccggattcttcttttgatttcttttcaaccattatcaaaaccattttcttacaggatgtattaaaacaggcagagggccagatttggcccatgggccgtagtttgctgacccctaagctagctatactcgaaagcatcatatttgtgtctttttgcttgaggcttgagaatgattcttttctcttctaaagagatttatatcagacactttcactaacaggaaagtgttatgtttaagattcagtaacagtccctaaacccttctctccttcacttgttctcctctaagctcagcacctatcttggaaggaaggaatgataattcagaactcttttcaagaagttatatgaagaagagcagagatatcaatcttttgttgtttttgtttttaggatctgagataatacagtgtatctgcaaggggatgaaaagagtccagcagagaaggagaaattaatgacacagggaaggtggggataatgactggagagatgtctttgataaagcaagagggagcggggtccagaactctagctaaagagttggaccgtgatggaagtagggatgattcatccactgggacatcattaacagtgctgtgttagggaattggttgggggagtttgaacgttttcatggtggaaaaagaagggaatttccatctgatttcttccttttgctcggtgaagtctgaggcaaggtcatctctttttcatattggtggcttcttccactttaaccctacagttttttcctttacagacaaagtagtttcatctgacttccatttctcatatttgtatgcttagtcatttgtacccatttcttttgaaatcacttgaacatactggcctttggctttttttttctcatgtgcctataatagttttatctgtatttggctagataactttgaggttagaacttttagtgactctgtgacagttgaatgtcaaagattctcctccctattagcccttgtgttgctttaagcagcagtgattttacacccctggtcatgaaatgttacactttttagagactcatgcagattcaactaatgatttctctcccatgaaggtatacattgcaggtaggcaccattaacatttcagtttacttgcaatttaccttgtgaaaagaatataattctagaatttgattcttagctctgtaataatctgttaggttgtggatttttaatgagtcagtgagtgtcccctttagatttcttaccaatatgtaattaactgaagacatgtactgctgtggtacaagtcaactggctttgacactgagcacacccgggtttccaaaccctgattttacaaatgtctggattatctagtttgtggagtagtcaggtcttggtcaatgtagtgaactgtaatgggaaaagcagggtcttcggggaaagcaagacctgggtccagtcctcagctttgccatttaccagacccaggtcttttgtaaatcatttaacttttgccagcctccttatcctcagctgtaaagcagatgtaatcatatgcacccttgcgttgtgtgagggttaaacgagatgatgtatatagtgtccggacaacacctgacagtaggtggttagtgaacgtcatatcccctttcctttgttgcctgtgctttttttctttttgcatctaagctagcagatagaagtcccaggtttgattcctgggccactcttcatattcctggagaattaagagcattttcaaaatgttttacataagtgttgcttacctctaagtcctcactgcaaaggtaaatactactgcaaaggagagaaaagaaaagaagtgaatgtttagaaaaaaacaaaaaagaaagtagagcaagaaaggcaggaaaaggaagtaatgaaggagaggatagaacaaaaagaaggcccaactgatgggggatggaagtatcgcagagaaaccattagctttctcagagccaggcacctgcacggtgcagagccaaggctatgggctctgggataaaacggatttgtgttcaaagcctggcatctctgatgattagttctgggaccttaagcaagttccttaacctttcagcacttcagttttcaaatgcgggaaacagcaagagctacacttgctgagcactcaccatgtgtcagcacgctccactgaaattcccactccaccctgtgtgatatgtggaattatcaccctcatctgacagatgagggagctagccgaaggatgtggttagcatttgttcaaagtcacagagctgggcttaccccgcagacctggctctgaagctcacactgactactgcaggaggaggggagatggagctgtggatgggcccacacagcacctgccctctacatgtgggtacttacgctccctttctttctcttttgctcttctcttatctcctgttatccaggtggtgggacttaattttctagaaatttccatctggttagatggaactttctaacctaggaaaaaaccccagcgcagcctcccctcaaatacactctaagtttcactgttgaggaaattagcttggtgcagctgaagcctgttttcaggagttgtttctgctggttccactcctggctgtaaatcaaaacaaatctaagtgacttgatggtagaggaaacaaaatgacttcactcactcacgtgagcatgaactcatgcacacacacactcacacttacacatacaggagttgattatttagtctctttgcaagtatgtttggttgaaattaagttgggccatatttgaccattgtcttacagattggtggttatttatttaatcagttcagcctgtgttttggcattaaatagataatatcacatgatttgttcattcattacttaacaattattaggagcctattatattctaagtgctgcgctgggtatgtggcatattaaatgagataggacttccctttaagtacatcattgtctaatgatcacacaccaaataattgtactataccatgataagtctaggaatggagatgaacacaaggtttgtcatttatattagtgtatttttacaagaccaaaaagtgtttttctatatgagttgtatcttctctgttgagaattctttctgcattctagtaaaaaaaaaaaaaaaagaaaagaaaagaaaagaaaagaaccacatatactttatttttatttttttgctctgtcttatggtgctaaagccacatgtactttccttgggttattttaataacacatgttttaagagtaagttaaggccgggtgcagtggctcatgcctatgtaatcccggcactttgggaggccaaggtgggtggatctcttgagctcaggagttcaagaccagccggggcaacatgatgaaagcctgtctgtataaaaaatacagaaattagccaggcgtggtggtacgcacctgtagtcccagctatgtgggaggctgaggcaggaggattgcttgagcctgggaggtggaggttgcagtgagctgagatcgtgccactgcatcactgcattccagccgaggcaacagagcaagatcctgtctcaaaaaaaaaaaaaaaaaaaaaaaaaaaaaaaaaaaaagtaagttaagaaacaaattcctcatcatttttttttaaatttgtttttaaggtaaccttgtttttctgactttttggccaaagatatatatgttcattgttaaacaagaaaaagaaaaaatactgggacacacacaaataattgaagttatcctctaattctactcttccagaattgtttactgaatgaccagttaactttcaaagtagtaaatatatgaaaatatgtctttttttctcctttgaaacagagcctactgggatgttagatgtctggtacatgaaacggcacattgactacagtagacaacagatttctcttttctggaaggtgagttttaagcgtcaacttaaaactcaagggaataaaactgaaggcagaaaaagacctatttgcatagtggcttttatatgaagcttcaatgattttgctagagctcattttctcacattcatgacacaccacagtgtcatgtgcctttggtggataggggtgagagctgagttccttcttccacacagtcacatcgtttcaatcccacttcctataagatcaaggtctttttccatccctggcatttccaccctctgaccccaactacttcatctcttctgactgttgtcccctttctgcccacccccacctctcctacataaatatgcccagcagtaaccatgtcacttcacttattcactctttgggaaacaaaagatgaaaaagctgtggatgtggatatttaataatgtttgttaagtcattgaagagggagaaggaggaaagaaagctgctctactttaggaatagtaatagtggtagaaaataatacaaacaggccaggtgcagtggctcacgcctgtaatcccagcactttgggaggccaaggcaggcggatcacttgaggtcaggggttagagaccagcctggccagcatggtgaaaccccgtctctactgaaaatacaaaaattagccgggcatggtggcatgcgcctgtaatcccagctactggggaggctgaggcacgagaatcacttgaacccgggaggcaggggttgcagtgagccaagatcatgccactgcactcgagcttgggtgacagagtgagactacgtttcaaaaaaaaaaaaaaaagaaaatcatacaaacaggaatagaaagcagcccttcctcaggaatggtaataaaacagtagtaaattagacaactttccagaaaacagtgaagcctgacattatcatagaatgcgaaagtttcacaaagcactgaaagctggcattaccattttatttaatcctcacaaaaatcccctgaggtaagtactggtacgcccacttaccagtgaatgagaaaacgaatgaatgagtgaatgaaaaaacgagtatcagagagaggaaagagaggaagttcttgcccaaagtcacccagctactgagcacagacctgagactgaaaccttatccagaactgctgcatcgtgactcatctttgttgaaggaaaatgctgtgcgattcgaattgagctactgattggcatgctcataagaggtttcctggtgaactgcactctttatttctcaggactcacatcctcttcactacacctcttccagttgaggatagaaagttttggaattatgaatctgaatgagcacaaaaccagaagagtaagaataacaattataaagtcctctgatggggttcacatgatgggttttgatcattgcacacttcttcagttttaagaaatgagtgatttcttcttctttctcctccctgtctctctcacacacacataaaacgtctggtataagaagagactactataaatagcctggtgaatcatgatcaggctcttcactttgaaactaacactgcagctcaaaatttattttaaaatgaatctactttcaatagcaagacaattctcaaagcaggacatttagaacagccataatttgtgaatattatagaagaacccagcctaattatttccttttcacgagcaagtgactggttaaaaccaaaattcctcctctcatgtaaaggtttctcctccaaaaatgtcctcaacagtgatctggaaagatatgctacgtgttaatctattccacgcctctcaactcaagggtttctctcagtagaatgagggtaatgatacaggtatctgcaaagctgacaagaccattgtggggatcagcaaatgagaggacacaaatgtaaaaatcacaagggccaccagtgtaaaattcagcagtgctgcatgatgcgtgtttatcctgacagtgaaagctccatgcctgcgtgcttttcactgtaacaaacagagtttatagtggacatcatcttggttctctgaaaccagcaccagagtgaagtcaaaataagtatgtgttggccatgagtgatgcttggtaaatgtgagtatgtgatttcttctctgctgccctgattttatttctatcttcacaaggcttaggttctataatgaggtcttggaatttggagggacttcaaagctcttctagttcagccttcctttcattataaacatggctcctactcctgccaggacagacagatgtctcagtggggatattctgggacagggagaatctcactttgtagtctgcccatgccatggttgaacatctcttattgtttagaaaatgtttccttttgtgtagccagaattgtgggcccaagaaggatgcttggggttggaactggcttagaagaaaccaaaaagggcaaggcacagtggcttacgccagtaataatcccataatccctaatcccagcacctggggaggtcgaggtgggcagatcactgaagtccaggagtttgagaccatcctggcagacatggtgaaaccctgtctctaccaaaatacaaaaaaatcagctgggtgtggtgatgcccacctgtaatctcagctacttgggagactgaagcaggagaatcccttgaacccgggaggcagaggttgcagtgagctgagatcgtgccatagtactccagcctgggtgacagagcaagacaaagaaggaagggaaggaaggaaggaaggaaggatggaagagagggagggaaggagggaaggaaggagaaagagaaaatagagaaagagaaagaagaaagaaggaaagaaaaaagaaagagaaagaaagaaagaaagaaagaaagaaagaaagaaagaaagaaagaaagaaagaaaagaaaggaaggaaagaaagagaaagcaaaaaggtaagcactagaagcttctataacttgatgtcagatggtagtcatcaaaagccaacctcaaaaccttcagtgactctctagtctaagaggctccccaaggaaagttggatgcagtcctatattgtcacaggattaagtccttttctgtcaaacctgggcttctttaatggccccaaacaggccactcaactgagggtgggaatggaaacactgaccagagttactgagcagtcctgctttggaccacagaaccacagagttatagacctctagagccaaagggatttaactgtcatgtagtctcaccccacagtttaaaacatggaaactgaggtttcaagaggtgattttccagtgaggggatttcaggtgatttgagtccactcttatcccagcctctaatagggattcctcatgccactctcaggcaggcttgggaattcaagggaatgctgtggtacaagggagttatctaagtgtcaggctagaaggaaaactctgcagccagatcgctttgtgacagggcccaagtcatacctcactggggaaagggagcaagggcgtgtgtggtggggttttttgttttttgggttttttttgtttttttttgtttttgtttttttcctttgagcaactctgggaaaccaaatgcaagaaacgcccaccactgcaaagaaggaaatctcatgccttggcatcaaaggaagcaccaagtaaaaccccatttgcctgtgaataaagtgagagcacttttctcttgcatatggggaaatgtgagatgacctttcacttttgtaggatgtttacaatagaggagaacaactccgtgctgattgggtgcagcccctgggggttggggtgggagtatgtgtgtgagtgtgggtgtgaatgtatgtgagtgtaaggatgtgagtgtgtggaaggcgtgggagtgtggggatgtgagtagggtgtgaatatgtaggtatgtgagtgtgtgtgtatgtatgaatgggtgcatgtgtcagtgtgtgaggatgtgaggatgttggtgaaggagacctttgctttgttatggcttgtcactccttttcccatgacttagtttctcttgaaagtaccatttcctcaaaaatatcttgtactactttttaaaatcacaccttttttttttttttttgagacagggtgtcattctgtcccccaggctgaagtgtggtggcacaatctcagctcactgcagccttcacctcctatgctcaagtgatcctcccacctcagcctcccaagtagctgagactacaggcatccatcaccacgcccagctaatttttgtttgtcacagagacagggtctcattctgtcccccaggctgaagtgtggtggcacaatctcagctcactgcagccttcacctcctgtgctcaagtgatcctcccacctcagcctcccaagtagctgagactacaggcatccatcaccacgcccagctaatttttgtttgtcacagagacagggtctcattctgtcccccaggctgaagtgtggtggcacaatctcagctcactgcagccttcacctcctgtgctcaagtgatcctcccacctcagcctcccaagtagctgagactacaggcatccatcaccacgcccagctaatttttgtcacagagacagggtttcaccatgttgcccaggctggtcacagactcctgggttcaagtgatctgcccacctcaacctcccaaaatgctgggactacaggtgtgagctaccacacctggcccatagctatttttaagaggaaaaatactttcaatgttgaagccaaaaagtacagcctaatctatgaaatgaaagaaaaacacctgggtattgttaaaaccacaaatgcaataaaagtaaaaaatgttgcttgattacgaatagccccagggttggattaggcccctttacaaaagggggcttttagcaatcctctccctcaaacttcctttctcttctccttctgtactgttttatattgtattctttcctttattaagtatctcaatccatgattccaatatacttcttttctagttaaaacagcatgtatcttttaagaagaaaaccacctttcatatatatatgaaaaagatatgagaaccaggtaaagccacatcaaccgttctagtttcctctcttaatttctttagcatcctctcattatcttgatcatagcaaatcacaaacttttgaaatttgtttgaggccatgagtctggaagagaaatattcatgttaagctcattcatttgctcaaacaaacatatgaaagctcctctttagtattagacactgtactgcatagctgggatatgaaagtgaacaagacaaatccagtcctcatgtcctggagctcacagtccagcaagaggacaggagtaggagcaggatgctgaggacatttgggtgttagggagcagttccaggttcaggtggaaggatgatggttgagctcgcctagtggagcaggggagtggtgggcaagcagagagggacacctctatggatttggcatggaaaggattactttagtgaagcactgttccacggaaatataagcaagccacaaatgggagccacatgcatgattaaaaattgttatgtagccaaattttaaaatgtaaaaagaaacaggtgaaattaattttaataattttttttcttttttgagatagagtctccctctgtggcccaggctggagtgcagtggcgtgatcttggctcactgcaacctccgcctcctaagttcaagtgattctcatgcctcagcctcccaggtaggtcagattacaggtgtgtgccaccatgcctggctaatttttgtatttttagtagagacaagattttgccatgttggccagactggtctcaaactcctgatctcaagtgatcctcctgcctcagcctcccaaagtgctgggattacaggcatgagcaacggctctcggcctaataatacattttatctaacccagtagatccagaacattgtcattttaccatgtaatcaatttttaaaattatttggatattttataacctttttatcctaccaagttttcaaaaactggtgagtctactaagtgccagtatgggcacattggttaagacttcaccctccagacagtagcacatcttggctcggactagccatgtttcaagggctccatgacttcctacagctaggggctccctcccatattcaacagcacagcttctgtgttttcagagcaatacagagagagttaagaaaattcggactgggcatggtggctcatgcctgtaatctaagcactttgggaggccgaggtgggaggatcacctgaggtcaggagttcaagagcagccaaaccctgtctctactaaaaatacaaaaatgttagccaggcatggtggcatacggctgtaattccagctactcaagaggctgaggcaggagaatcacttgaacccaggaagcagagttgcagtgagccgagatcacgccactgcactccagcctggacgacagtgtgagactccatttcaaaaagaaaaaaagaaagaaaactcttagttccaaaagtggggaaaagatttagtgttttttatttgttatacgaagtaattcattttgacaaacagctaccctcaaaccacagaagatggaaagaacgagaagatagcaagccccgtataccaatttacggcacagcctgagagagactgttgtgaaaggaacagcttattcagtacattcactttgtctctttctccttgtatctctctctcatatgcagaatattccaacctatatcacactgcactgaagtgatgaattctttggcctcctcatatgaaaaagcttgttaaaagtagaaagtattatttgggacctgatttatattgatgtaggacaaaggtctattgtaaatccctagtgaggattggctgccaggaccttggggcatttatataattataggagctatccgatctcagaatcaatatttaaatacaaaagcagcagatggcacaatttagattgttttgttgcaatattcaactctatctcccccttcccaatcctggcccatcacaggcaggcacagcatttccaaagatatttttggaaagaaagggctgcttttccttgcttactagtcacacatgttatgccagctgaaagtagggaattttgattggatagcagaatgtggccagtgcaaaaaaataagagagtaggtagccaagaattaacagaagatagaaagaggagatggaaagggcattttaaagttttgctttcatgaaagtttctcttatttttctgtttttctagctgccaaacaagatagaaatcattatgccacggtcaccaccaagaggtttgactatcagttaagtcagttcagtatagcagaacactggggagtatctaggaagtgctagcatggtccagcagttaagagttcacctcttggtagagctgtgccacctgggtttgagttccagcttcactacttattggctggatgttcttgggcaaagtgcttaaactctctgttccttattttattcatgagtaaagtgcagatcacatgaagttgtgaagattaatgaaatcgttgtgaaaagtgttaagttattgttatgaggcaaacattgtgcatgacattgaaggtgctagtgggaaaatagatccttagatagtttcaatggagtgttttctaaaatgtccaggtgagggttgtctatttttttttttttttttttgcgacaggttctcactctgtcacccaggttggagtgcagtggtgcgatattagctcactgcaacctctgcctcctgggttcaagcaattctcccacctcagcctctcaagtagctgtgattacaggcatgcaccattatgcccagctaatttttgtatttttagtagaaagtggtttcaccatgttggctgagctggtctcaaactcttgacttcaagtgatttgcccacctcagcctcccaaagtgctgggattacaggtgtgagccaccgcgcacggccaagggttgtcttttgaatcacttcatttggactggggttgcaaaaggcagtcatgagttttaaaatcaagatgctcacaaaaacttacaaattacatgtattttgtaaccaactgaatggcattggtgagacttccatatagaacagaagagtaagccaagagtcaagatgacctagctcttcatagactggtagaagagtcatgtaagtgtattagcaaaactgacaatcatgatatttttatattactttagagtaactgagagaagggaagtcaccaagagtcttaacatgtgccaagcactctttaaaacagtttacctcccttaactcattgaatgctccaataagcctacactgtacatgacagtatccttattttataaataagggcactgaggctcaaaaagggaaaataatttgcccaaggtcatacagctgctatgtggtagagcaaggaagcaaaggatctgctctaataagaaaaaaatcaaagtcagcagtattccaaagccaaaatcaaaagaaataaaagctgtgattaatagtgttcagattcctccagctttctaaggtctagattatagaccctcttctttgatacaggctaagcgctaacagattttttctttattatttgcatcaggggaagttcagaagtagagcattactttatgagaagttcagtaagttttttaaatcttaagaagacatgatttatcaattcatggagacacccctcctccaatagatctttaattaaaaataaaaacagatgcattgcattctgaaatgtgtcagattttgtcctgtcatggattacatttaccacatttttaatgctgaaagctttttcaggcagcagaactcttacagtaggtttactgagagagctgttcactcttcagttctcagacaaagccaagtcagaaaggctttccataataaatttaaatcatttcccacaggtcagagcagaaagaaaatggaaggagagaggcaatgggactgtggttcctttatagcatattcttaccaataggagaaggtgacaatgacagtaggaacactggcctgagacccattcttagcactgtcagagaaggaaaaagaggtggcaggtcttggagacactcccagggatgcaagacacattctggatactgcgcaccgctctcacatccaccagagggcactcaaaaatctcacattacttttctgtggggactatttgaaaccgttccttaatgtccccaagcttcaacatcctcaaaatcagaatggagagttacaagggctaaatgggacattagacataaaactcctggctcatggtatagcccaataaatgttggtctttcctttatcattcacccaaaccagcagcaccagcatacaaataggttgatctgggaagagtcggcgggctcctccggtttgcagtccttctgagctcacagcttgtctcctgtgactcagaacctgctaactctggaaaaaaagggattctcggtctccaccctccccaaactgatgaactcatgctgcctgttcgtgctgcatgtgagaatgtaccaaacctcacaattagagaagttgctttgcaattttgggctagaagggtgactgaggatttcaactatgaaacacggctgcccacacctaccagttcattgtctcaggcttgtctatatagggagcagcacgtcataacagagggaacattggcctagaagtcgagagctctgggctctgcgcctaccttcttcatctgtccattgaatggccttaagcaagtcacgtcatgtccctgggcccctgttttcccacttataaaatgaatcattgaattaactgttaatctgtagattcacttccagtttggtggttccttgatgatattcccttccatcaggacaaggcataatccaggagtaatggactacatacaccatttgcaaactttatgttgccttaaaaaattaaaaaaaaaaaaaccctgaactgattatactgttttcagttgcttcaggagactaagtggctaaatatctgttttcctattagctcattgaagtttttgttccatcgaccctgtcagacgagttaggcttgtttttcaatttgattaaggagaccaattacctaagaaaggataatcgttattccaaaaattgagtttgacatcttatatcagcctaacccatgggataccatatttacttgtccacctacttccatcccactcccaccttttcattgatattttcaactctaaaatatgggatgcgaaggggaaaatgtaagagtctgggtccatgccctctggaaatctttatgatccgtcagagccacacccctatttactagactgctgtgatcagctagattttcacagcagtcactatgcacagccattggatccaagataacatttcaccccttcctttagcactttactattatatcaaatgagatttctgggatgtctatgaaggacagtgggagggagataataagactggtttgcaatgttagcgttggactgaagcctcttgggtccctggccagaaataagagttttgtgagctcagttaactcttgggaagtaccttagggttggaaaacttggggtgtgagtggaggtaacagtcctatctctggacttgcagaagagacacatagggaacaacggagtgagagatagctgaggggatggtcttcccttgccagtgtctgctttattgtttttctcctctgacaaagggcatatttaataataacagtttagaacatcctactctaaaaagcacttgcttattctaatccatacaacaggcctatgagatcggctgcgacagacatttgaaatgctgactttagggaaaggcagaatgtccacacaaaagggcccacagcaacatgacatccacctcgtgcactgactatggtttaagatctagttttgggccttttggatccagaagggtcaccagaatggacctgcattaatcaagcttccagaaatggagatataaaaactagatgctcatggattaatttcagcaagaaatgcagctgtggggccaaccagaaggcttgagtcagcagataggaacattctctcccagtatgctaattgtttcagaagccaaattataatcagaaggccaatttattcacttaaagtgaaaaataaaaattataagtgaaccagatgttcatgttagcccagcctttcctgacagataatcgacagaggaaaccaaattattagaagagtgcttggtgagcagggaacccaggcaaggggcatttgctgactacagtgtgtctttcagcaaacacagccggaggccccccacccatggaagggacagccttgccaagaaaactgtagcacttgaatctggtgagcaagccttcctcaccttgcatgaggcatggatgggcaccgccaatgctagacttgacaactctccatattctatgcttctgtttcccatggtccttgtcaaaacagggttataatacaaataattagttctctgcttactttctgggattgctcccaaatgatctcaattggaatttttgcagttccaaaagttgttagttacacgtttatgaacagtgtcttagtttcctagcacagatggctaattcaattcactaaatgaagattttactagtttagctcttgaaaatcttctgtttgatgtcttgagcagcagtgcaccttctgtagaaaaggttatatgtgtgtgtgtgatttacaaatttagaaatggagactcagaggggctgagtgccttgcccttgggctgtgtaaacagtagagctggaactcaaatccagatcttctgagttgagattctatacttgttctattggatgtgaccaagttgtctactattagtaagtttcattttaaagcaaaaaagaaaatcaatgcgttcttaagaattatcttttaaaaacgttaactgattttttatttcctaaatggcagggaggggaaggtgggtattgcataaaagtgtgtagcagggaacatgagatgatatgaacaaaaaggtcactcagctgtagctgcctagtacatctgtacccatgaggtccaggcacagagcatcagtgatcttgtctgggagtaaatagtgaataaatgtgtcttgttgcagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcaggtaagttctaatttttctttaacattgcctgtggaaaactgtgtcttactcatctcttatctcctgcaggcccaacccaggacctaaaatgagtagctaggagttcaggctttggagtcaacagctttcagaggctttttttttcttttccaatcagcctatgagtagccttggacaagtaaatgaacacctctgagcttcaatgtcctcctctctaaaataggaattatattgcctgtctcataggtcattttgaaactaaatattaatacatagcaggtatttaatacattgtagttaaggaaatactagttacattaaattgaacaccaatatctgactagcttttatagaagcaggagaaatacgtgttacgtttcagaaaacattttacacctaaagtcaaaacgtctttttaaaaccaaagtcggggatggtggtgtgtacctatggtcccagctacttaggaatatgagatgggaggattgcttaagcccaggagttccacgccagtctgggcctcacagtgagacccctttcatcaaaaacaaataaataaataaatacaaccaataatattgaaattctgactaatgaaactatagtaaaattttgttttaccatagccctttattgcacaagtttagacacgtatccaattacctttatcagaaaattcccaactagatgtagagtctcacattttatagtcatatcctctgaaaattaacttctcaggataaaagctcacaattaggcaaggaaattgatattaatcctatttctcaagatctgtattataaaagaattccatgtcaagttcattggcctaacttcaaaaaatgcctaatagagtaaaactctgtaatgagatcctttcttaaaattcagtataataattttatctaccagtgggtttagcaatcttcattttgaaaaagtctaccaaaatactattatttaatatacactgttaaatcttggttatatatcttttcagtcatatatctgtacaaagaaataaagtattagataaaatacttagaagaaaatacaggtaagtattaatgtatatatacaagtaaacagtatatgtatagtatatgcatataaccttgggttggtgtatgagttaggaatttctcttagggttagggttgttcttaccaaaagcctgactataggaacttatttatcctctcaaaaaaagagaagtccagaggtagacagcctagggctggtgtgacagcctcatgatgccatcagggctctagggtcctcctttctgttccctctgccaagtttggctttcatccttatgatggaaatggtccaaaatggctgccaaggctctagctatttccttctagacagcagaaaaggaaaagaagggctcagcccttacttttaaggagctttaccccaggtctcacaacaacacttgcattcatcagcccactggtcacctggtcacacccagatgcaaaggaggctcaaaaatatattaaggcagcaatgttcccttgctaaaaaaagatgaggagaaggtgtttgtaggcaactggtaatctctctctatatttatcaatataactttttcaaatatatgaaactttggaatatgaacaaacaactcaaaaagaagtataaaaggagcaacaaagatatgaaaatgtttagcctaactagcaattaatgagatacaaattttgagaaaacctgagaaaccaaatcagactgagaaagagtaagtagaatgaacatacccatgttggtgagggtgtggggaagatactcttgtacatgctagtgagtgtgtaaattggtacaacttactagggagcaacttggcaatatgtaacaaactttaaattaaacttgtatcttttgaccaggtaattttagccttagaaatgtatactcagcatatcataggataagtgcttaaaaatgtaagtacgaagatgtttgttgaaaaattgtttgaaacagtgaaacaccataaacaacctaagtgtataatagtaaagaatggactggttaaactcaccatgaccctcaactgctttaatcctacaccaacattaaagggatgttgtagctatgtttttcattgacatggacagatacacattataagtgaaaaggtaagattttaaaagtgtatatgaggtgatgccatcttaaatacatatttacaactagcgcgtgtctcacacctctaatcccagcactttgggagtgcaaggtgggaggattgcttgagcccagaagtttgagaccagccaggccaacataaggaaaaagatacaaaaaaaaataaaaataagattagtcagctgtggtggctcacgcctgtggttccactacttgggaggatgaggtggaaggatttcttgaggctaggaggttgagattgcagtgaactgtgatcgcaccactgcactccagactgggtgaaaaagtgagactctgtctcaaaagtaaataaaaaataaataaacatttacatgagcacgtattttttgaagggtaaaatttaaaaaatatctagctgaatatagatcaaaatgttaacagagatcatttgtacatctggaattacaagttatttttcttcccttttgctttttatatttaaaaatttgttcttcagtggctaagtactgtgtatgtaatttttaaagtgaattctgtggttctattctgctgtttttaaaatgaaataaatcagaataacttacttcttcaaacctcactgcagatgggtcttgaggttttaaacctcatgaattctatggtcccattccaggttccttagttagatttggtgacaacttctcaaatgtcacattcattatgttagagttcatttctactttattcattcaacagtcatttttgagcatacactatataaggcagttggaatccagcataggtaaaagatacagtcgaggtcctcaacttatatttagccaagggggagggtcagacatatgagcaagtaaagtgcagtacagtagaataagcatgaggtaagaggtatgcatgggggctctaggaacagagaaaagccaaagcatgagcttggagaggaggccaggagagctggtggcatgcgtaccaagtatagagagacaaagtggtgctagccaggtgagggagagcaggtgtgcaggcgtgagggtttgttttaaagtgagagctgagcaggcataggacttgaaaggaagaaccagagataaggaagaagttgaagacaaaggagagggaggaataatagaataaagtccctggggagatgggagatgatgaggagccagtgaccaaaagagggaagaggaacacttcatcctctgagagtggacagaggaccattgatcatagaatgctaagaatgaggttgatgcagagatcacgtcaggagggaaagaaggacatgaggcaattcttcagagccgagctgtcgttaagagggtcttagaagtgctggaatctcaagggcctcttgcctctcctaagatcacacctgagccattcaacacaagtagttgtgtgtcccagaaggacctggagaacaaattggcgaactgcatggtcctgtctttgaggactttgtctcacacataccttgaatgatctgtaggggtagaacatgactttgtgccttctcctttttcagtatacagtcatactatttacatatgtatcttttcttcaagaaaaggatacaataatgccccaacattatttaggctgatttatgctgattttgagagaccagagacaaatttattgtaaaaagcacctgccatagcattgtatatcaagaggcacaagaatgattttgttagcttatgataaaagttacatgctagccaggcatggtggcacatgactgttttctgagctacttgggaggctgaggcagggggattgcttgagcccaggagttggaggctgccgtgagccatgatcgtgccactgtacttcaccctgggcaacagaacaagacattatctaaaaaaaagaaggccagggccaggcgccgtggctcacgcctgtaatcccaggactttgggaggccgaggcaggtagatcacttgaggccaggagttcaaaaccagcctggccaatacagtgaaaccctgtctctaccaaaaaatacaaaattagccaggtgtggtagtgtgcgcctgtagtcccagctactcgggaggctgaggcaggagaatcgcttgaacccgggaggtgaagattgcagtgagccaagatcatgccacttgtactccagcctgggcaacagagtgagagaccctgtctcaaaaagaaaaaaaaaaaaaaaaaaaaggaatgtgtgctaaacctaccagtcaactagtaaaatgtattaaatatttcaaagatccagcccttctactcaagacctcttgaaactacaggaagagtcagaagccagtatggtcataaacacaggctcacagagatggcagagactggggcccaaggaggtgaagtaactgagccaagatcatacatccaatagtggcagagctacatggaaaaccagaccacccttgggtgagcactttttccaaatgccttctgaacgttataacttcatacagaagctctcagtgaaaatggagatgggaagttgaatgattgaggctaaaggaataattttgaaaggtgacagggagaaggtgagttgttagcagacttttgaaggaaagaacatgccccagcaaacatcatgagagaggaaattctaggttggttcctggcaagtgtggtgactcagagacagaagaaccctaggcaatgccaagttgatttacttagctaattccagagaaagtagtggttagaaaggctctttggcttttttacctcaatacttggcaaaggatctcgcaaaccatagtgttcaataaatacttgctgaatgagtaaattttattctcaaaaaacaaaacaaaataaaaagcccacagtataactgggacatcaaataccaaggcaagtgaagacaaggaaccattgctgggaattccagttcctgacaagatgtccagtacactgtctacaggctctaccactaaacctggccctgaagctgctgcagagagataagatatggatggctgagttccccctctggggaatagtgatgaagcggggaggaccaagggagctttctacttgttctctttgttttttcctcttgttatcctgttgtgatcgctgcccaggaatctctatgatggggtaggaaattctggggagcagtgcagagtcactgtcaaggaagccctggaacctcactggggaggagagctgggagcaaagagtgcctgtgagctggctgacccttcagcatttttttcctgccacccatcccatgggcctggcagtttcaaacaagaataatagctcaattccctcacgaaaagcagtgcctaccacagaggtactagtttgattctggaggtacaagtatgcctaaggggtgcctggggacaaagagctcagcttgtatcactgcagggtctctggcctggagctttccaagctgaaaagccctcctctctaccctaagcatacatggaggaccatgagctatagctgtactttgactcctctccctataaaaaaagaaaagccaaggttgttgaccaatcaaagaaaataaaacatgatcccaaaagaaaacatcaagacaaatgtgaagaccacaagccctgggaatgacaggcaacaaatcagtatcataggaaacagaactaatgcaacagatagtacaaaagattagaataaatgtaaaaagcatccttagaaagataagagagaataccaaaacatgaatcagaaacaggtagttatgaagaaaacccaaacagagtcagcatggaatgtttaggggatttttatgtgatgttaaacagattgcttattcactcttaaatatagcatgttttaggccaagcatggtagctcatgcctgttattctggcactttgggaggctgagacaggtggatcacttgaagccaggaatttaagaccagcctggccaacatggcaaaaccctgtctctactaaaaaaataaataaataaaaataaaaaagaaaaattagctgggtgtgatggcgcacacctgtaatcccagctactcaggaggctgaggcacaggaattacttgaaactgggaagtggaggttgcagtgagccaagatcatgccacttcactccagcttgggtgacagagtgagattctgtctcaaaaagaaaagaaaagaaaagcatgttttattagaataacctcaaagggccattaaagaaaatgatttcagtattgtatagcaacaaataatagaagctagcaaaagtgttttttttaacctttgaagtttctaatatactttgtctatttagaaaacaaacacatttagttgtttccatctcttaaacttcagttgcattgcattcttcaaacatcttttcatattagggcttcatgtggtttgaacattttgctagaatactattctacttttgtctgagagtggtcaattacatctatcttttccagcatacaaactccaatatatttaagagaatgcaaggaaagtttagttattgaaacagctaactcagccgatgggatgaatagcagagaggactgatctgaagattaaattagtgagaggaagactaggggtgaaattcttccataaggtgtaaaaaaatgggtaagaaattgaaagattagaaaaattaaaacactgaaagagcagaaatagaagttatatcaaccatctaaaaggagttagagtagaggaaaaaaatggaggggagcaaatatttgaagactagtgatcaagaatgttacagaatgaaagaaaaacataagatttcaagtggaaaggcctcagagtgctaaactcaacataattttttttttcattttattgtaaagtgtaaggaccttaaagccaaagaaaaaagtataacaatatttagggagaaaaaagcaaatcacctactaaagaaaaagaatcaaaaggacactagatatgtcaataacaaaacatataaaaatacaataacataatatcttcaaatggaagaaaggaaagaactttaaatctggaaatgtttctccagctaaactatcatttaaaaatgagagagaactggctgggcatggtggctcacgcctgtaatcccagcactttgggaggtcaaggcaggcagatcacctgaggtcaggagtttgagaccagcttggccaacctggtgaaaccctgtctctactaaaaatacaaaaattagctggggatggtgttgtgggcctgtaatcccagctactttggaggctgaggcaggagaatcgcttgaagccaggagacacatgttgcagtgagccaagattgtgccactgcactccagcctgggcaacaagagtgaaactccatctcaaaaaaaaattaattaaaattaaaattaaaaaaattaaaatgagagagaacttaggtaatagagtaaattcagaggaacaagatgtaaggataaaagagagagagagagaagatgcaaataaaacaccaagcaaaacaagagggaaagaatatttcccctagtaaaagtaaactttcaaacctagctgaaataaacttatggttaaatactgtaaaagctaaaaaattggcacaaaaatatttttaaattttaaataaataagtgttaagaataaaaaacttagcccaggtgcagtggctcatgcctataatctcagcactttgggaggccaaggcaggcagatcacttgaagccaggagttcgagaccagcctggccaacattgtgaaaccccgtctctacaaaaatacaaaaattagccaggcatagtggtgcacgcctgtagttccagctactcaagaggctgaggcacgaaaatggcttgagcccaggaggcagagattgcagtgagccaagattgtgccactgaactccagcctaggtgacagagcaggactctgtctgaaaaaataaaataaaataaaaataaaaaacttatttatatacaacatgcactccaaaaaagccccagccccacattgttttacaactgaactctgaattcaatgttagttcaagttgctatggaaaatataaaataaagaaagctgtccaatctattttctaagacgaatttaactttggtattaaaatcagataaagatagcacaagaaaagttattgcctaaatcacttatgaaccttgacacataacctgatgaatgagagatgtaaattcaacacatgtattaaaaattagtggaggctgggcacagtggcttacacctgtaatcccagcactttgcggggctgagtcgggtggatcacttgtggttaggagttcaagaccagcctggccgacatggtgaaaccctgtctctactaaatatacaaaaattagctgggagtcgtggcatatgcccttaatctcagctactccagaggctgggacaggagaatcacttgaacctgggaggtggcagttgcagtgagccaagatcatgccattgcactccagcctgggcaacagagcatctcaaaaaaaaaacaaaaaaacacacagtggtgatactttcagtttccagtctagcatctaaggcactttggaagtcatcattctgtcataataacaagtaaaaactcaacaaactggaaaatcaacacttcttctttgacctatgagaagtgaggttatatggcaagccactgccccgaaaattgaagagatagacaggtaaatacagagaatcacaaattaccatagcaaaaatccccaagcagaaaacttcatgggaaccagtgctgaggtaagaaaacctaactgtaactcacaaattgctggaggctcagaacggacaaatctgagagttaaaatctccactggggatcagtcataggaggtcctcacagttttgtgagttttatcttatggagcttgaccaggggctgggcgcggtggctcacacctgtaatcccaacactttgggaggctgaggcaggtggatcactagaggtcaggagtttgaagccagcctggccaacatggtgaaaccccatctctactaaaaatgcaaattagccagcgtggtagtgcgtgcctgtgatcccagctgcttgggaagctgaggcaggataatcacttgaacccaggaggcagaggttgcagtgagccaagatggcgccactgcactccagcccgggtgacagagcaagactgtctcagaaagaaaaaaaaaaaaaggagattgaccaggttatcacagtgaatatcagaaaaatcccccatgtttctctcagtgggagggaaaaaggaaccgttataaaatacatcagagttggccaggtgcagtggttcacgccttgtaattccagcactttgggaggccaaggcaggcagatcacttgaggtcaggagtttgagaccagcctggccaacatggcaaaaccctgtctctactaaaaatacaaaaattagctaggcgtagtggcacgtgcctgtaatcccagctacttgggaggctaaggcaggagaatcacttgaatccaggaggcagaggttgcagtgaaccaagatcactctactgcactccagcctgggtgacagaggaaaactccgtctcaaaaaaaaaaaaaaatacaccagagcattctgttcttaacaaggcctgccctccaaggaaactgttttaatagggctgaactattggagttttatcagaacctaaccagcctggtgggaggaacatatctaattccatcctagtctggccttctatgtggagggaaaggaaatacccaactccaatcccctctattcttctaggtgggagaaggaaaatacccaactcgagcccactgtagccatcctatcccacttaagaggggaaaactgataagcactggcaagttcccagtacaggagcacagcctcacaaaaagactgggatgtaatcatagggttatagaatgctttctttcccccgacacctttctaccacattactaaaagcccatttactgcatatgcttttacttagtaaatcatatccacctttcaacaaaaaattataaggcattctaaaaggcaaaaaacaaacaaacaacaacaaaacaacagttagttgagatacagcaagcatcagaaccatacttggatatggcagggatgttggaattatcagaccaggaatttaaaacaactatgtttaatatgctaaaggctctaacagataaagtagaaaacctgcaaaaaccgatggacagggtaatcagagaaattagaattctaagaaagggtcaaaaaagaaatgctagagatcaaaaacagtgtaacaaatgaagaatgtctttgatgggtgattcgtaaaatagacatatctgggggaggagtttttgagcttgaagatatgtcaatagaaaccgctaaaactgaaaagcaaagagaacaaagactgaaaaaacataacaacatatacaaaatctgtggaacaactacaaaagatgtaacctacacataatggaaatatgagaaggtaaaaaaaagaaaggaataaaagaaatatttgaaacaataatgaatgagaatttatcaaattaatgtcagacaccaaaccacagacccaggaaccttaaagaacaccaaacagggtaaatggcaccctccacccacaaaaaaaactgtacctacatacatcattcaaatggcagaaaatcaaagataaagaaaaaactcttgaaagaagccacaggaaaaagaaaactttataagaccaaatataagaattacatctaacttcttcaaagaaaccatgcaggcctggcgcggtggctcacgcgtgtaatcccagcactttgggaggccgaggtgggtggatcacctgaggtcaggagttcaagaccagcctggccaacatggtgaaaccttgtctctactaaaaatacaaaaattagctggccatggtggcatgtgcctataatcccagctactcgggaggctgctgcaggagaactgctcaaacctgggaggcagaggttgcagtgagccaaaatcacgccactgtactccagcctgggtaacaaagttagactctgtctcaaaaaagaaaaagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaagaaaaagaaaaaaaaagaaaccatgcaagcaaggaaagagtagagtaaaatatttaaagtattgagagaaaaaaagcccatcaacctagcagtctatacgctgtgaaattatactttaaaagtgaaggagaaataaggacttcccacataaagattgaagaaatttgttgccagcagacctgcctagcaaaaaatgtgaaatgaagtttttcagagagaaggaaaatgagataggtcagaaacttggaactatatagaaaaaggaagaacatcaaggaaaaaataagtgaaggcaaaatacaaactttaattactcgttttttttttttgtgacggagtcttgctctgtcaccatgctggagtgcagtggcatgatctcggctcactgcaacttccaactccctggttcaagcgattctcctgcctcagcctcccaagtagctgggattacaggcacacgccaccacacccggttaatttttgtatttttagtagagacggggtttcactatgttggccaggatggttttgatctcctgatctcgtgatctgcctgcctcggactcccaaagtgctgggattacaggcatgagccactgtgcctggccaattattcttattttttttttttttttttttttgagacagagctttgctcttgttgcccaggctgaagtgcaatggcgtgatcttggctcaccacaacctccgcctcccaggttcaagcgattctcctgcctcagcctccctagtagctgggattacaggcatgtgccaccatgcccagctaattttgtatttttagtagagacggggtttctccatgttggtcaggctggtctcgaactcccaacctcaggtgattcgcccacctcagcctcccaaagtgctgggattacaggcatgagccactgtgcccggccaattattcttattcttaattgacctaatagatagcagtttattcaaaacaataatagtaacaatgtatttgattacatatgtttgtgtattataaatgcttatgcatgcttatatataagtgaaatgaaagatagcaatgaatcctagcaagggataagaaggaggactttggattattttgctatttaaggtatttctgctacccatgaagcagtatattgttatttgaaaggggacttgaattagttgtaaatgtatattgcaaatagtagagcaagagcaagcactaaaaaccattttaaaagaaatataactgatatgctaaaaagggcagaaaatgaaatcatataaactgatcaattaaaaccacaaatggcagaaaaagaatgacaaacaaaatgagggatagatgacaaaggcaacaaatagaaaatagtaacacatgtagtacatattactccaactccatcaagttattttgaacatcactggactaaaaacagcaattacaaaacaaatagtcaaagtggataaaaaacaagacccaactatagttgtctataagaaatcaaatttaaatatatagacatataggccagcacagtggctcacgcctgtaatcccagcactttggaaggctgaggcaggcggatcacttgaggtcaggagttcaagactagcctggctaacgtagtgaaactctgtctctcctaaaaatacaaaaattagccaggtgtggtggtgcatgcctgtcatctcagctacttgggaggatgaggcaggagaatcacttgaacccagggggtggaggctgcagtaagccaagattgcaccactgcactccagcctgtgagacagagggagactctatctcaaaataaataaataaattttaaaattgacacatatagagcaaatgtaaagagatagagaaagatatgccatgttaacattaatgaaaaagaagctggagtagctgtattaatttcagacagaacagacttcaaagcagagaaagttatcagtggtaactgggagcattacttaatgataaaggaatctattctcaaagaaaacataacaatctttaatgtgtatggacttaacaacaatcaaaatgcatgagccaaaaaccaatagaactgcaaagagaaatagatgaatccactatcatagtcagacttcaagaccactgtgtcagaaatggacagatcctgcagacaggacaaagactgcagacagaaaatcattaaagacatagttgaactcaacagcatcctcaatcaactaaacataattgacatctgtagccaacatcatctaacaacagcataatacacattcttctcatgctcatatggaacattcaccaagatacaccatattctgggtcataaaatacaccttaacaaatttaaaagaatagatatcatgcaatgtccgctcccagaccacaggggaaataaactagaaatcagtaacagaaagatagctggaaaatcccaaaatagagattaaacaacacacttctaaataacacattggtcaaagtctcaagagaaattttaaaatattttgaactaattgaaaataaaaataaaacatcaaaatttatggaatgcagcaaaatcagtgcttagaggaaaatttataacattgaatgaatacattagaaaagaagagaggtctaaaatcaataatctaaacttttgccttaggaaactaaaggaaaaatggatcaaataaccccaaagtaagcaaatagtaataataagagaggaaatcaatgaaattcaaaactggaataaagagataaattaatgaaaccaaaagctgattctttaaaaagatcaataaaatttataaaatttctagccaggttaactaaaaaaaagagagaaagaggatgaaaattaccaatatcataaataaaaaggggctatcatcactgatcccatggacatgaaaaggataataatcaaatactatgaacaactctgtgcccacgaatttgataatctagatgaaatggaccaatagtcagacattacaaagcctggtaacatgaacagtgttttctggtaaagtggccaacccagacacagacccatgatgatatgaaacttggtatattacagggatgagatgccaaatgtgatgacattgggaaaaattgactcaccatgtggaaaaatagtaaaatgtattctccccctgaaaaaaaaaccttttgttggatttgaatttaaaaacccattaaatgtgaaaggtaaaactaaaaaccaataggagaaaatgtagttgagtatcttcatgaccctaggatagaagggtcatcttaaggggccataggatagaagggtcataaataagatgtaaagtacacaagccatggataaatttaccaacatcaaagtagctatatatgtgtcattaagttatcagagagttgacaggctaggtaagatactgttgaaaactgttatgttaagactaaaatctacaatataaaaagttgtctgcaaatcagaaagaatgcaggaaacccaatggaaatgagtgaagtacatgaattggcagttcatggaaggggaaagtcaaataactagtaatatatgaaaagaagcttagcttcataagaaatcagaaaaatggccgggtgcaatggcccacacctgtaatcccagcactttgggagcccgaggcgggtggatcacctgaggtcaggagttcgagaccagcctggccaacatggtgaaacctcgtctctactaaaaatacaaaattagttgggtgtggtggcagacgcctgtagtcccagctactcgggaggctgagacaggagaactgcttgaacctgggaggcagaggccgcagtgagccgagatggtgccactgcactccagcctgggcaagatagagcaagactccatctcaaaaaaaaaaaaaaaaaaaaaagaagagaaatcagaaaaatgaaaataaaaccacaattaaataccactttatatataccagattgataaaaattagaaaatcagaaaatactaaatattggtggagaaatgagagccttcatgcttttcttgctggagtgtcaagtggctattttagagataaatctggcagtattttgtaaaataatatgtgaatttgctctataatcaagcaattctatgcatatatatccagaaacacagaaacattcttgcacaggcacacaagagaacatgcaagagaatattcattgcatccttgtttgtgtttgcaaacactccaaaagaacttcctgcttgtcactcaaacattggacaagtaaagggtttaggtagcaatctgaaaaaatgagtcggatttacataatagcagctggatgtatatgtcccagaaacatgttgagtgaaaaaaagaaaaagcattagatttatctcccaatacatttcatgaaaattcaacacatacgcacaaaataacactaaatttcaaggataggaatttgtctaaacaaatatatgaaaggtggattagaaagatgtctaatatattcacaaagattaggcacctttgaggctatagaaatggaaaaaggaatggggctgggcatgttggctcatgcctgtaatccaagccctttgagaggccgaggcaggagggtcacttgagcccaggagtttgagatcagcctgggcaacgtagcaagaccttgtctctgtctaataaaaaaaaaaattagctatgtgtggtgacatgcacccgtggtctcagctactcaggaggctaaggtgggaggatcacttgaatctgggaggttgaggctgcagtgatctgtgcttatgccactgcactccagcctgggtgacaaagtaagatcctgtctcaaggaaaaaaaaagaaagagagagagaagaaaaagaaaaagaaagaaggaaggaaggaaaggaacgagggaaggaaggaaggaaggaaggaagcaaagaaggaaggaaagaaggaaggaagggggagggagggaggaagggagggaaggaaggaagggaaggaaggaaaagtaaagaaagagaaaggaaaagaaggggaaaataattgtacacatgacattttacgtaatgtttgaacaagctgatgttgttagttctccatgaactgagaaatgaaatgaacttaaatctgtgactccaaagtctttaaaagtaaacagattcttcctaaaactttttcgttgggataagctgtttggctttttttgttgtttaaatctttatccctcctctttttttattttgtttctcctctttctgtccgataaagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcaggtacctaattgttcaccttccttctagagggttactaagttcacatttgtttggggaaactgcaggcaagagccagaaccctgccttcaattacaggtggctacatgatgagagagactgatgacctagagtccacccagcagcactttagactactccactgcagacataaatgaccaactggttgactaaaagctctcttatttatggaaaatccatatccctagcacaatgccaaagaagatgaatgaataattgaaccaaacaagtatggctgagagctaagttaactgcccagtgtaatagacacctttatttatcatagcacactgcatgataatacatgaggccatccttaaccctgtggggagttcatttatttaataactcttaaagcaatcatgttcagtaagagtcggtatggccattatataaatgaggaaaccaggaaatccttcattcacaattctgttacttattaattgtgtaatactaaatccagaattatctataagacaattggtatttctaatcctcagtttcctaatctgtcagtggtgagaatcaagtgagagaacgcatctgaaaatatattaaaatgattgggcagaacttagttaatgtcattgttaagcataaattcagcactgaattgaatcagtggtttaaagttctggctctgcagccatactacctgggttcgagtcttggctctgtctgtgtgatctagggcaagttacttaaccgctttgtgcctcagtttcctcatctgaaaaatgaggataataatattacctacctcgttgggttattgtgaagactagctgaattacttcgtggaaaatgttttgaacaatgcctaatatattttaagggctcagtaatttagctctcatcattattattgttacgtgagacagagctaatattttaaggttttcaagctctaaatcctataatgtttctataacaatcattacacctgtctaggaggaaatacacaccctgcttaaggtgacaagatttatacaaatgaaataaatagcacactgcataatcatacatgagtccatccttaactgtgtacctcttttgtagtctgactgctcagagttctagcaggttaatttttcatcactacccttaaatagaatgctgcctacataacctagtcagcatccagaggaagatgaccaagttattaggagcctggaacttctaatctggaaaccatttagcctagaaagagaattctagatgggcatgggaatgggacggcttgacggctgttgctggttttgacattacacataaaagagtatgttttcttttgttgctctggagaggaaaactaaaaccctgtgtggaaattataaaagaagtagctatcagctcaattttgaaaaagaagtttcctgcctttgatgttctctaatgggacaatcgattacctctcaaggcagtgtgttccctgtccctagagtttttgcagtagaaccagttttctttcagggctgttatgcccatcaaatcaggtgaaagtgaatagaaaaagcatttaccaaactttaagctgctaagaaattgtaaacattattataagctgtattaggacttacccctgtgggatagtttgaactacatggcaagagagatgttttccatacttagtgaaataagtgtctttatgcactttagaagtaatattcatttgaataaaatcaatatactaggctgggcgcggtggctcacgcctgtaatcccaacactttgggaggcggaggtcaggagttcaagaccagcctggccaacgtggtgaaaccccatccctactaaaaatacaaaaattagctgggcgtggtggtgggcgcctataatcccagctacttgggaggctaaggcaagataattgcttgaacccgggaagcggagattgcagtgagccgagatcatgccattgcactccagcctgggtgacagagtgagactccatctgaaaaaaaaaaaaaaacaatatactaatgaataaaataactttattaaattaaagttgttctcctgcttggaaacacttggttagctattagcttatgttgatgttacagtctgaaaataaacacttaaaaattaagcaattcatggttattattaattcaaaatggccccctctagtcagtaagatcactcattgttattgattttcaccagccttttcccagcatctggctggggcagatttggacattttggagtgggccagaatacagcccggctcctgatttataggttggtggaggctaggctagagaccagtcctgtcctgtcctgtctgggtgaaaatgcttctgaccgtatagagccactccttttacaaatacataacatcatggtgtctagaaaaccttccctgcacctagagttgttgggggccctcttatgccttcttcttcctcgttactggtcatttaatgtttgccttctcccacacttaacaggtgaaattagctttctgcagaaaaaccacctaagtgatggtttataaacatgggggcagggactttgctgaagggtactaggtatgtatgtatgtatgggagtggtgggaaatgagtcggaaattgcggccagactctagaaaggaaataaaagtctgaggagtatgggcttcatacactgaaggttttgagatggggagcagatattgttagagagtgttcatacaagaatcagccagtaaaacaggagttcttgaggccagaactggggaagaagcttgctaggagggctctactcttggtggaaagggaaatgtcaactgaattacagaaccacattgtcttctctcctccgctaaaggtaagccattcacaaaaataaaccacaacttctaatgcagcagttcccaaggcctctgccctgaactcacattttgaatggcaaaatacaatggaactgtctgcctaacgagctcatctggaactcccatgcctccataaggcggtggttggttggcccctttcacgactaggggcagaacagccaggcactgggggctgaaagctactcactggcccctcccacattaaatatgatttcatattccatgttgccctttgggcttcttggtgtcaatgccacccatgaggaatctttggattaccatactaagctgactgtgtccttttctccacttcgcttagttcatgaactcaaattggaatttacccatggcatgtgttttgatcttgtcatggtctcttctgacagcactggttgcacaactgagttttatgtgctgtctatttgctggaatatttaatgagcaatggattttcatataaaacacaaataatttaataaatttttctatgatataaaattattcttcctgaaaaaaaaaaaagttaaaccctaatcaactgtcagtgtaggggaccctggctacctatcggcagggcattaatcaatactgggtagggttcttactttgactccctgatactatagttacctagtaggacttatctctttttcctttaaatgttcatttgaaatgtaaaagtatttcaggagaggtatctatgaaaggggccttttattcacaagtagtagaaatctgagattcatggaaataaggaattttggtggggaagaaagacttgccaataagcttcatgactgacagaaaattgaaagtgcggcgctttaaaagccaggaaggagcattaacattcccaagtaccttttaaatcttccaggctgggaagcaactgaaatctaactggaacatacagggagaggagatggggtaacaaggggtcggattgcacccagagcaccctggttagttatgcctgagtgtgtcatctgccctgtcagatcttgataagcatcgcagaattagaaaagctattcaggttctatgcctgcaaaattccagcctcactttcctgtaaacagcaaatgctttatttgtaggaatcaaaaggttttttttcttgaaggcaagttgttttgtttgtttcaaaagcagtctgggtgcgtgtgtgtgtgtgtctgtgtgtgtgtgtgtgtgtgtggttatatttaaatccgtgttggaactcaaatagcttttgtctccttcttaatcatggtgatcctgtttgtttatatggaaagaaactcaggttggttggttggttgatctcatcctttgaagttgggagcagtaacttccagaagccaacgtcatggcaaatcagatgctgagaatttgtaacataggtcatcagtccagactgtgcttgaaccatctttaaactaggaaaaggcaagaaacaccttgaaagcatttgtatcagataataaaatggctccctttagtgactcaccagtaatggcacggctgttatgggaattcccttttccttgcagagaacataaaatcctacatctgttatgaaatccgtgtgtatgcactctcaggggatcaaggaggatgcagctccatcctgggtaactctaagcacaaaggtgagtcttgggatcttttgccaaattttgctttagtttaatgatttggatttggagggtgacagaagcctcctgtgccctactttacagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtggtatgtgtgagaaccaaatgcagtgagtggggccttcttgtttggatgtcaggaaaacacaaggaggtgtgtgtgcacatctacacacatgtgctagcgcaatgcctggcatatagtaagtactccataaatacttgtaaagttaactgaatgaagaattagaaaagacatctaaacacacaaacagaaggttattgaatatgtgttatgtgccaagcaaattgctaaggatacagaaatgaagtaaatggactagttctcaaggtgcttactcatatgaagagacagaatttcaacaaacaataaagtcacttcagtactgtatagacttctttgtttttttaagacagtgcctcactctgttgcccaggctgagtgcagtggtgcaatcacagctcactgcagccttgacctccctgggctcaagcagtcctcctgcctcagcctcccaagtagtgggaactacaggtgcatgccaccatgtccagctaattttttaatttttttgtaaagacagagtctccctgtgttgtccaggctagtctccaactcctgggctcaagtgatttgcctacctcggcctcccaaagtgctgggattacaggcatgggccacagcgccccgccaatcctgtataggccttgaggttcacaagaaatgcctctggagaacttttaaatccccacatttgcaattactattatggcatattattttcttcttaaaatggataaaatatgatacagtttaagtaaccctttatggcccaaaattattctataagtataaaactaaagcaattaaaataaactctagctagagtgttgtctcaaatgatgtcatggatcactcattcatgtacagctccaagtcacttgccacacttgatgttccaatctttgatttattcagagtttttgtttttcttgacttgaccttctctttattttgtaagcagctagctttcaggaacatttgtcataaagaaggaacatttgtatttcttaatgagagttagtaggcccaagaacaatgcaacaaagccaccctaagatgcagctgccagagagctgcctccaggggtgattttcacctgggaagctttatgagttggtcttctctcttgactttaagaggtccgcagtgtgactttaaaagctggttaatttttattatataaataatactaaaacatgaagatagttcagaaagatatagaaagaaaattcgtcttcccttcacacttaggctgttaacagtcccttgtgtagtcttccagaaaaaaacaattgatgcatgtacaagaatatagttgagatctttttcaacattctgatctacaccttgcttttacctctcaataatacgtggtagagacctttctacatccatccatgtgaacttatgtcattcttttttatcatctctgtagtatggcatcataagggcttatggtcatttgttgaacaaatacaccattgataaacagaacatatcactgatcagaactgcttccccctggacttgacccagagtcagtcagttctgaaatgcaccccaagaggtaaggaatcaattgatctcttcttcagccatctggaattcctcatgtgaaatttgccccccaaataactttcattttggcagagtttaaattgagatacctgtttgcaaccacatggtctgtttattctttttttttttttttttcatacggagtcttgctctgttgcctaggctggagtgcaatggcacgatctcagcttactgcaacctctacctcccgggttcaagtgattctcctgcctcagcctcctgagtagctgggattacagacatgtaccaccatgccctgctaatttttgtatttttagtagaggaggggtttcaccatgttggccaggctggtcttgaacgcctaacctcaggtgatccgtctgccttggcctctcacagtgctgagattacaggcgtgagccacccagcccagcctctttttttttttttttttttttttttttttaacagtaagccatctactttaatagtcaaagcctcttgagtctgttgattcttaaagctgctcttatggatgttgaagaaaatgccttccttattttgtcacaaatctgatgactctaaagcctgcataagggtatttaaaaataagctaaaaggggagggagagtgcagattcacagtcctattttatactagtttaggttaaatttccatttaattcagtaagtatctgttgatggataagacctattccctatcttcaacaagctcacagtctatgagggagatagaaaagtacacaaaaggaggctgggcatggtggctcatgcctgtaatcacagcactttgggaggccgaggtgggcagatcgtttgagcccaataggtcaagaccagcctgggcaacatggtgaaaccctgtctctaccaaaattacaaaaaattagccaggcatagtggtgtgtgcctgcaatcccagctactcaggaggctgaggtgtgaggatcactgagcccaagaggcagagattgcagtaagctgaaatcgcaccactgcactccagcctgggcgacagagatggactctgtctcaaagagtgaaaaataaaaaggaaaagtacacaaaagggatgtaactgtcataatcaaggactgacaactacttattgcatttggcaaccagaaatcattggtgaattcacaagggcactttctagagagtggtaggaggtggtaggttgaggaggagggagaaaggcaaagcaggaaggtgttctgccttgatggccccctcttactggtgtttcagcaccattaaccaggcagcagtattaagggcatatgtggagcacagtaagggcaaaaaatgaaggacctgccttggcagaggagggtaaggtgtagagccagggaggaacccaggtatctggattgtaatgagttatatgggtggttctgtgcacagccactcctctggaagcttgtccatattgccatgttgccatgtgtaccagtagagccacggccagcacatttttctttttctttttttttttttttttgagacagagtctcactctgttgcccaggctggagtgcaatggcgcgatctcggctcactgcaagctctgcctcccgggttcacgccattctcctgcctcagcctcccgagtaactgggactacaagcacccgccaccaagcctggctaattttttgtatttttagtagacacggggtttcaccatgttagccaggatggtctcaatctcctgacctcgtgatctgcccatctcggcctcccaaagtgctgggattacagacgtgagccaccgcgcctggctggccagcacatttttctactggagaacacattatactttgctactgcctagtagtgtttgccaacagtctctaagcatcttaagggaagaagccatggcaatttgctcaccattgtctcctcatacctagaatacagccagacacatggtaggtgcttcataaaaataaacagctgaataccactctacgctttgtgaaatccaatgtagatcgttaaaaacttgtttccagtagcagtgcagctgttttgtctagtaccacttgaccttcctatctacagcttttccaacgactggcaactatcacatcttcctacactggtgcctttatcattgaatcaccctgagtgtaagttttcagaccgccaaggattgaatggcctcttttatctctgccagagatcacagcccagagggagcaggaccagtatttcctgcttgacttcttgacttctttcttctattcagcctattttgccaaccaaactgctgacaccatcatcttcctcactgcctcttcccatagagcttctatttttgttctcctaatatgtgtgcgtgtgtgtgtgtgtgtgtatgtgtgtttggataaactttattggcccagcaacccacacaaatcccttcccttctgttccaatatctcatttcactcccagagttaaggatgccctcacagagttggacagttgattccctgacacttgctgatgttctgctgcagcaggaggaacagaaggtctctctaaaattaattttttaatcccctgtgttaggaatagagaaagggctttttgagctcaatcatatagcttaagtctatgcaagcaatctcaccaggctagagtagacttgagaattttccacaaggacttttctcaacaggatgtaaactatagaaattctgtgatagtcatggtgaataaattatctgcatgggcctcaacccctttgggtggagtagaggtaatattataggacttcatcttgctgattacccatagtaagcagggatgggataatggaaggggtctcttttccccattagatagtggactctttgaggcagattctttgcttttgtattgtcagtgccttgtccagtgtaggcactcatatttatgactgttgaaataaattcagcatgcaagacatctctgacttgccctggagtttgtgagccagtatatgttgagtatatgacgctgagttctagttttccctgtgatcaccagcatagatgaagtcatctcaatgagctagcaggtgtgaaaggaaaataaaatctcaagaccccaaactcactatgccaaaagaaaagataagcttgggagctgagtcatgcaaaaactgcctttcttttgttaccaaacagatagctgtaacttcacatgcttactttattttatgtcaaacatagatttactgagttccagaaaaatgcataattgaccctttacccctcctttcacatgtaaaatgtagattcactgaatgctaatcaaagcctcacaagaccactttgcctcattgcctatcttccccaccccccacccatttttttccttcccagtttcccctctctttcctttttaaatattgaggtcctcagcacaggtcacagatcctattgtaatttgtgtttctttttcaacctcaacctcaaagttggcaaaatgaacctcaaaacccactgaaactcggcggggtgcggtggctcacgcctgtaatcccagcactttcggaggctgaggcaggcggatcacctgaggtcaggagttcaagaccagcctggccaacatggtgaaactcccatctctacaaaaatacaaaaatcaaccaggcatgatggcagatgcctgtaatcccaactactcgggaggtcacggtgggagaattgcttgaactcaggttgcagtgaactgagattgtgccattgcactccagcctgggtgacagagtgagactccatcttaaaaaacaaaacaaacaacaacaacaacaaaaaacctattgaaatttgtctattttgtttttagttgacacaggctacttctgctagagtgctggccttgactctgccatcctccccagcttttgaaaggtcactccaaaatccaaacccaacaggccactggagaagattgtctattcattaaaggctacctacactcatgtttcttagattaaaaaacagcatcagtgtattactcaaaacacaaaatcttccctacagagaaaactgcaggggtgttgagaacataaggaactggtaatctaggtttacagctgccaaatctaatctaagtatcggtgctctagtttttaatgattttatgtcagactgaataagatcctcattaagctaagggcctagagcctacaaatggaaaagtgcaaaatcaaagtttaaaaatgttaagtgaggccaggtgatgtggctcatgcctgtaattccagcactttgggaggctgaggcgggcagatcaccaggtcaggagttcgagaccagcctgaccaacatggtgaaaccccatctctattaaaaatacaaaacttagccaagcatggtggcgtgtgcctataatcccagttactcaggaggctgaggctgaagaattgcttgaattcgggaggcggaggttgcagtgagccaagatcgtattactgtactctagcctgggtgacagagcaagactcttctcaaaaaaaaaaaaaaaaaaatgttaagtgaatgtctgtttcattaattgttaaacttacataggctgggtgtgggggctcacgcctataatcccagcactttgggaggctgaggtgggcagatcacttgaggccaggatttcaagattagcctggccaacatggtgaaaccccgttctactaaaaatacaaaaattagccaggcatggtggcacacacctgtagtcccagctacttgggaggctgaggcaggagaattgattgaacctaggaggcggaggttacagtgagccaagatcgtgccactgcactctagcctgggcgacagagcaagactccatctcaaaaaaaatacaaaatacaaaatttcataactggccggacgcagtgactcacacttgtaatccagcattttgggaggctaaggcaggcagattacttgaggtcaggagttcgagaccagcctggccaacatggtgaaaccccatcactactaaaaatacaaaaattagctgggcatggtggcacatacctgtagtcccagctacttgggaagctgaggcaggagaattgcttgaacccaggaggcggaggttgcagtgagccgagatcgcatcactgctctccagcctgggcgacagagcaagaacctgtctcaaaaaaaaaaaaaaaaaaaaaaaaaaaagttccatagccttgaaaacaatttgtaaatttaacatttctcctccagaactcccaaataagcctgataaatactagaaatgttatcatcattggaaataaagggagttaactttagctaaatattttcaaaagcaaaataacaaaaatttattcaaaagattttaccacaaaacacaaaaaagagaaaagaaaattagaaaataaagtaaaaataaaagattttactacaaaaaaataatttgtttaatatgctgtggagtgagatgtccataaatgacgatgtctagggcctattaaggtattaagtactgaggaatttggactattttaaaatagcaaaatgctttttccttccaaattaaatgaagcattaaagagtaagaatgagtagaagcctacattaaaagccatatcctttaatacatgcctttcttcctttatcttcctttcagaaattccctacagagtctcccaaaattcacatccaataaacagcctgcagccccgagtgacatatgtcctgtggatgacagctctgacagctgctggtgaaagttcccacggaaatgagagggaattttgtctgcaaggtgagaggcagtgttaaggatgatgagtccaccctggattcttgcacaggcatgcactcctattacatttggtatagagataatcagattttctttaattcactaaaaactttcttgctgtcactttacacttgctgtttctcctaaatagaatgctttaccactctactatcttcctggagacaatgtctactcatgtttcaaaatttatcggaaatccttcctccttcaggaagccttcccaaatgctccttacataatgcacttacatttaactcctactcaaaactctgaatcctgtaggctaggattgatatctgtttacctctgtcttcaaggcctagcatggtggccagcacacagtactcgcttactaagtatctgtacacaaatgatgagaatcacatcaacaataataatagcagctattgcatatgcaacagtcattctgttaagcgctttgtatactacattaatttgctggggctgctgtaacgaagcaccacaaactgagtggcctaatcaacagaaatctattgtctcacagttctagaggctagaagtccaaaatcaaggtgtcagcagggttggttctttcggagggctatgagagagaatctattccaggcctctctcctcttttccagtaatttgcaggcagtcattgatattacttggcttgtaggtctctgctttcatctggcattctccatgtgtccaaattgtctccttcttataaggacaccagtcatattggattaggggcccactctactccagtataacttcatcttaattatatatgcaatgatcctaatttcaaatgaggtcacattctgaggctgggggtttaggacttcaacatacaaatttgaggatcacccagttcaacctacaacacatacttttgctaatatttccttaccaaaattacacggttatacctaccccatcctaccagacactcaatatgaaatgaatttaaaaatgaaggattatcatgccttttttaaagtgaggggactaaggtacagaaagattacccaaggtcatggaagtggtaagtggcagaactacaaatcaaactcagatttgagttgcttaaattaaatttgagtctgatgaataagtgacccagctagcatgggcttccctccaccagctaagttacactgttctctctagcaatgctcatttgcatctgctctaagcataaaacaagctgttcttgctttgtgacatgaagcatcaagttgatcattcaagagactttgttgttctatgccaggaaactctccactgggaaattgacaagacttcttcttatctccccagcactcccatgaaagttaacttgcagctgggcacggtagctcgtgcctgtaatcccaggactttgggaggccgaggagggcggatcatgaggtcaggagatcgagaccatcctggctaacacagtgaaaccccgtctctactaaaaaaatacaaaaaaattagccgggcatggtggcgggcgcctgtagtcctggctactcgggaggctgaggcaggagaatggcataaacccaggaggcggagcttgcagtgagccgagatggcaccactgccctccagcctgggcgacagagtgagactatgtttcaaaaaaaaaaaaaaaaagaaagaaagaaagttaacttgcttgattaatgtggattaaggactcagacaaaaattaggtgggagcggtggtacatgcctgtaatcccagctacttgggaggctgaggcaagagaatcacttgaacccaggaggcagaggttgcagggagctgagatcgcaccactgcactccagcctgggtgacagagcgagactctgtctcaaaaataaaaaaaaataaaaacaaaaaaggactcagcatcttgctactggttttactccaaacttgttccatctgcccagaaaggaaagcagatgctgaagaaacgtgagatttggccaagtgccgtggctcccacctataatctcagcactttgggaggccaaggtgggaggattgattgaacacaggagttccacacctgcctgggcaacatagcaagaccccatctcaattaaaaaagaaaggaaggccagatcctcctgattgtatggggtagaaaaaaggttacctccattaacttccctattcagccctgttgacacttctcatgggtcctaacaggtctctggcctctagctcctcctgctcactctccctcccagcctgtttttcattcaatcagaagaggagtctttctgcaagactgcagatgctggcattacttctcttgttgtaactcatcagtggttccccaggggccttcaagctagaactcaaactccatacttgccaggtacacatggtcctatttacccatctagtttgatcctttgccacacacttcagcattcattatggagcaagaccagactttctgcagtcgcctgaaagtactggctgttccctccttccatgcttttgcatagttttttttttctggtctggtcttcctttgttagcttatccatttagctggctcctattcatcctccaactctacattttttttttttttttttgagacagggtctcactctattgtccaggctggagtatagtggcatgatcatagctcactgcagcctcaaaatcctgggcccaagtgattctcatgcctcagcctcacaagtagttgagactataggctcctgccaccatgcccagctaatcaactctaaacttttgacattgtgccttttgcaaaaccttcctctgctacttgtgagccagttttccatgctgttctctgctacactgctgtggacactgcatatacccctgttttcatacatatcccatgtgaattagtctgttctcacgctgctataaggacatacctgagactggataatttatagaggaaagaggtttaattgattcacagttccacagggctggggaagcctaaggaaacttataatcgtggcagaagggaaagcaaacatgtccttcacaaggtgccaggagagagaagaatgagagccaagtgggggaaaggccccttagaaaaccattgattcttgtgagaactcactcactatcatgagaacagcatgaagataactgcccccatgattgaattacctccccgcaagtccctcacaccacatgtggggatcatgggaactacaattcaagataagatttgggtgaggacacagccaaaccatatcatcccactcctgacccctcccaaacctcatgtcctcacatttcaaaacacaatcatgcattttgaacagtcccctgaagtcttaggccattccagtaatagcccaaaagtccaagtccaaagtctcatctgagacaaagcaagtcttttccacctatgagcctataaaatcaaaaacaagctagttacttcctagatataaagggggtacaggcattgggaaaatacaccccttccaaatgggagaaattggccaaaacaaaggagctataggccccatgcaagtccaaaatccagtagggcaatcattaaatcttaaagctccaaaatgatctcctgcctagatccacttaagcctagtgttccattattggaatgctaagcatgtgggagttgtttatatcctactgctcaaggtcattgccaaggtcagatttttcactcatgcaaaaattcaaaaaattgcaacctcaggcataaataggttaactccatgtctcacattaggtcatgctgatgcaagaggtgggctcccacagccttgggcagctccacctctgtggctttgcagggtacagccccctcccaactgccttcacagctggcattgagtgtctgcagcttttccaggtgcatggtgcaagctgtcagtggatctaccattctagggtctggaggacagtggccctcttttcacagttccactaggcagtgccagtggggaccctgtgtaggggcttgcaccccacatttctcttccacactgctctagcagaggttctccataagggctccccccctgcagcaaacttctgcctgggcatccaggcacttccatacatcctgtgaaatctaggcaaagttctccaaacctgaactcttgacctctgcacacccacaggcccaacaccacatggaagctgccaaggcctggggcttgcaccctatgaagcaacggcctgagctgtatgttggtcccttttagccacagctggagtggctaggatgcagagcaccaagtcccaaggctgcatacagaagtgggggccctggacccagccctgaaaaccatttttccctcctaggcctccaggcctgtgatgggaggggctgtcatgaaggttcctaacatgctcaggagatattttccccattgtcttggtaattaacatttggctcctcattacctatgcaaatttctgcagccagcttgactttctccccagaaaatagggttttcttttctattgaatcatcaggctgcaaattttccaaacttctatgttctgcttcctcttgaatgttttgctgcttagaaatttcttctgccagatatcctaaatcatctctctcaagttcaaagttccaaagatctctggggcaggtacaaaatgccaccagtctgtttgcatagcaagagtaacctttactccagttcccaacaagttccttgtttccatctgagaccacctcattctcaacttcattgtccacatcactaccagcattttggtcaaagtcactcgacaagtctctaggaagttcctaactttcccacatcttcctgtcttctcagccctccaagtctctaggaaattccaaactttcccacattttcctgtcttcttctgagccttccaaactgttccaacctctgccttcatccatttccaaagttgcttccacattctcaggtatctttacagcagcaccccactctctatggtaccaatttacttactatattagtctgttctcatgctgctataaggacatatctgagactgggtaatttataaaggaaagaggtttaattgactcataattcagcatggctagggagggctcaggaaacttacaatcatggctgaagggaaagcaaacacatccttcttcacaaggcagcaggagagagaagaatgagagcaaagcaggggtaaagccccttatgaaaccatcagattcttgtgagaactccctcatagcatgagaagagtagcatggggtaactgcccccatgattcaattacctcccagtgggtccctcccaccacatgtggggattatgggaattacaattcaagatgagatttgggtgggcacacagccaaaccatatcaccatggcatcatggcttattgtttacatgttcacacatctgtatcctatactatattcatgacttctttagacagcagagccatgtcctatttatctttgtatcccagcacctaacagagcctgttacctggttactactcagcgagtgctggatgaattaatggccaattccaataagtagtaaaatgctgtagttcttttcataggaaagaataggcacaatttcaaacatttcaaacatttcacaatcaccctagctagataaaggcttatgccatactttgctaaaattaatagctactgtttcttgaggacctcctatattcagacacactgccatgtgctttaaatataccatctctgatcttcatgacaaccagcaaggtacatgtcaccattcacattttatagatcaagaaactgaagtccaggccgggcacggtggctcacgcctgtaatcccagcactttgggaggccgaggcaggcagatcatgaggtcaggagttcaagaccaccctggccaatatggtgaaaccctgtctctactaaaaatacaaaaattagccgggcgtggtggcacacgcctgtagtcccagctgctcgggaggctgaggcaggagaatcgcttgaacccaggaggcggagattgcagtgagctgagattgcgccattgcactccagcctgggagacacagtgagactccatctcaaaaaaaaaaaaaaaaaaaaaaaagaaggaaataaactgaagtccacagattacacatctgctagcggcacagccaggactaagacaaggctcccaattcacaactgtactttgcattccgtacctcctttctttctgaccctgtgagtcggaggagccctgtagggccagagctcctcttggaaccatagaattggtccccttagggtcccatttcccgcactgcatagacaaaagtgaatttaccttgttcttgagcacagctgcccaggaactgtgggtaaggcccagagggcgcatacaccaatcaggattttgaaatgttcattggtgataactcactcagtcacaggatttcctaacttttcaggtaaagccaattggatggcgtttgtggcaccaagcatttgcattgctatcatcatggtgggcattttctcaacacattacttccagcaaaagtgagttggttacacctaccaagtgggtaaatgaggcttttaaaaaatgataatagctgttgctgccatgggtcagggaaatggacactctcacacattcctggtgagagactaaacttatttaaccactttgggtgacagtatgtgtcaaatccttaaaaatatatcttttgatctaacaatctctaactagaaatgtattatatatatatattcttttttttccccaaaaaaatttttttgagacagagtttcactcttgtcgcccaggctgaagtgcaatggtgtgattttggctcactgcaacctccgcctcctgggttcaagcaattgtcctgcctcagcctcctgagtagctgggattacaggtgcccaccaccatgcccagataatttttgtattttttattagagacagggtttcatcatgttggccagactggtcccgaactcctgacctcaagtgatccccctgcctcagcctcccaaagtgctgggattacaggtatgagccactgcaccaagcctattctattatagatgtctgcagatatttagtggaaaatatgttcactgtaataattttcagaaaagaaaaatatttgagacaacctaaacgcccaatgataagggattggttaactaaatcctgatatatcttgtactataacatattatgtgtccatgaaagatgatgtagaaattaaatagtatggcaggccgggcgcaatggctcacacctgtaatcccagcactttgggaggctgaggcgggcggatcaccaggtcaggagatggagaccttcctggccaacatgttgaaaccccatctctactaaaaatacaaaaattagctgggtgtggtggcacgagcctgtagtcccagctgagactcaggaggctaaggcaggagaatcacttgaacctgggaggtggagattgcagtgaatcgagattgcaccactgcactccaccctggcaacacagcaagactgtctcaaaaaaaaaaaaaaaaaaaagaaagaaattaaatggtatgaacaatatttaccatgttccatttaaaaggcagcctgccaaacaatacgtactttcatttcttaaaaatagtgcatacacacagatgcaaatgtaagatatatcagttagcattaaatttggttatatataatatgaaagtcaaaataacatgactgaggctgggcgccggggctcatgcctgtaatctcagcactttgggaggctgaggcaggcagatcacctcaggtcaagagttcaagaccagnnnnnnnnnnnnnnnnnnnntaatgtgatataacttaaatatttttcagactacttactaccttgaacttggatataaaatatagcccattttcagaagttttatctgtaccacatatataaacaaaatctaattcatgagatagtctttaaaaaaattactttgactatatataataaaacgatattatgagtaagctctggattataaaagtaacaaccagagggcaagtggttcaacattaagagattttattataaaatgagtggtaataaattatcatttgttggataaattcacttttagacaatttttaaaatatattctgtaatcccagcactttgggaggctgaggcaggcagatcacctcaggtcaagagttcaagaccagcctggacagcatggtgaaatctgtctctactgaaaatacaaaaattagtcagccatggtggtgcacacctgtagtcccggtattcaggaggctgaggcatgagaatcacctgaacaggaggcagaggttgtagtaagttgagattgcgccactgcactccagcctaaaacggcaataagaacaaaaaaaacactgtggtctttcctttgaggtagagctgcaagaaaagaaaacaaaactgtggtacttcagccaagtgcattgtcgtcctagtaaatctgggtcctcttcctaagaaggaggggaaaatgaatattgggtggcaattactctgtgccccaaggatataaaccacaatatttttgttttgttttgttttgagacagagtctcactctgttgcccaggctggagtgcagtggcatgatcttggctcactgcagcctctgcttcctgggttcaatcgattctcctgcctcagcctcctgagtagctgggactacaggtgcccgccaccacgcccagctactttttgtatttttggtagagatggggtttcaccatgttggccaggctggtctcaaactcctgacctcatgatccacccacctcagtctcccaaagtgctgggattacaggcgtgagccaccgcacccagcctaaaccacaatattaatggtgtttatatctggggatataattgtaggtgattttagtttttcttgtttaattatatttttagaatttccttagtaaacatgtattatttttcaaagaaaagatttttaatgagttggttattcaatacaaagttttcttcaaatgctgtgtaaagtaagagaagaggtcttttgacctctaactcaaagtcattctaccagccattgaacttgtctaacaggctgtacatttattgaagatctaatgtgtgatagatacttcaacgtgaagctctctttgggtagactttgaaaaagtttaattcaaaaggagtcaactaggatcacatgcatcctcttcatggaaattgtgaagatcagttacagtgcaggctaaactgccttaaaaaaaaaaagaggacccaaagcacagtggcttaaataatactttatttatcttccatataacagccctgaggtaaggtatccagactggtgggcagctgtgctccatagttatttgtggactcagttttcttccatctttttggcataccatcccttaggtattgtcctcatctgcatgatctctatgagatcacagacacttctgctcatatttctttggagaaaacctagtcacatggccacatctcttacttcaaaaggttagacaaattgtaaagcatacttttaaaaaaaaaaaaaaatcaaagcttatgaaagccaagtctttaaaaatgtttcatattgttcatgaactttaaaaaaaataagtcacatgcatttataagaaatgtttttaggatttttccttctacatcataaaagacctgtatttcctcttattgccaaatacaatcactgttaatagatatttcagatatttccctataatacttttttcttggcatttttaacatggttgtgttcaagctatttataccattttgaatcccgtctttttttcaactgttcacataatttacctgtcattacaaactctttgtaaatattctaattagctaaatagtaagggtagggaacatgtcatcttcaatgcttggcaggtagcattgtgctggtcacatattaggggttcaatcaatatttgttgaatgaatgcatagctggctagtgatagattgctaaatattaggttgatcaaaagttccatggtttatttagcaaacctcaagtggctgtgttgtaattttacagaaaactaccgtagtcttggatgataaatcatctttgtctttcagtgtttatcttttatttgcatacaaaagcagcccttacactgaagttactgcactgagaacctgtgcttccatgccactgtgtgcacacctaaggaaatgtcactgttttctttatctatagggtgtttgttctcctagcagccctcagacctcagtggtgtagcagagaaattccagatccagcaaatagcacttgcgctaagaaatatcccattgcagaggtaaggtacaattcctctgtggtcagtcagtggagttctagtgatcaccacatctaagttttccattgtagttacgaggaagcctgggtgctgagatcctatggttgagcttaagttattcacgcttggctaccactgagtcatcattctcattttaattcctgaacttaagagaaaccaggcacaggaatcttctgaagtttatgatcgtaagactaaaaccccctagctttttatacctcagtatgcctcactttccccttctcaccaaactgctctcctgttctcctcacctaacttatttcaaaagaagaaagcaaactttccttttttttttttttttttttgccatttgttgagtactagcctgagcattgagtcatccaaaattcaagagaattgaagattttgattttcctgtctaagcatagaaaagataaatagaacccatactattttggtttgggcaagaagccagtacatcattccattgtgcaaagaaaaggttttaaaggagaggttgatcagctggcagatgagagaggggagagtaaaggaagtgaagggaactgctgcagcccaggaaaggaggtgagaaagctcacagtgggcaagatgggccatccctggtggagggtctggaagttgaaagtatctgaatatgaagactacatttaaggggagaaataggagagagaagtggcaagtcaatattcctcccatcacctggggctttgacaactccaggctccctttccaagaccttataacactccttgctcaagatgcttctctccaactaccgagtatgttctgtcatccacacccttcctcaggccagaagccagtggtccatagtcccaacctccactcaaaaaaaaagagtggatcccagccacagattctttaggcatttaagtctctatagtttagtgcctttgaaatcaagcccagaggccacccctgcctctgccacttactatgtgtgtgactcttgggcaacttgcccaactatctgagcccaagtttcagcctcaataaaacaggagttgacagtatcattcttacttaccactgtgaggattaaataagatgccatgtaaagcacatgggtcatataagacaaagatcattcactttcttcccaagaagacccataatttaagtctcctctgaggatttcatccctattaagttacaacagcaaaaacagtgataataacagcagtgtgtgtgtgtgtgtgtgtgtgtgtctatacacacacacacacacaaactgctgttttatatatatgtatacaaactgctgttattactattttatatatataatatacaggttatataattatatattttctatattctgtcatataatatataattatataataatattatacattcattattataatttagatatattatcttctatgtaccaggcacttttgaaaacattttcatacgttaacatttaacccataaacatctctatgaggtcgtatgatttttttttttttgagacagagtcttgttctgttgcccaggctggagtgcagtggcgcaatctcggctcactgcaagcttcaccttccaggttcacgccgttctcctgcctcagcctccctagtagctaggactacaggcgcccgccgccatgcccggctaatttttttttatttttatttttagtagagatgaggtttcactgtgttagccaggatggtctcaatctcctgacctcgtgatccacccgcctcggcctcccaaagtgctgggattataggcgtgagccaccatgcccggcatgaagttgtatgattatcttcattttccgcatgaggaaactgaggcacagaggactacgtaacttgcccaatgttagtcagcgagtacatggtggatcctggactcatatccaagcaggatatgctgcctatcattgcactacacattttaaaggatctttaaacacggggtgaggagagagtttctagcagtctacacctctgagctgaagagacttattaaaagtaagacaggaggaaggtgatagaaattggtatacatatgcccaaagttgtgtagtataagtgtattcattgcagcattatcaatagaagcaaaaactcgggcataatgtaaaggtgcaccaggatgcaaattaaactttttgggtacatccatacaatagggtattaggcaaaaactaaaaaaatgacatagatctatatgtgcctaaagatctacaagatacttaaaagtaaaaagagcaatatttatcacaattgtccaaagtgggtttatttatataaaaatgagggcgattttacacacactcatacatctgcagcatgggcacaggatatttctggaagcccactatgatacatatgaaatggatactggtggttgcctccagggagagggttgagagtatgaaggccacttaattttcattacatagtccctttgaacttttagatatcttttttttttttttttttttttttgagacggagtctcgctttgttgccaggctggagtgcagtggcactatctcggctcaccgcaagctccgcctcctgggttcacaccattctcctgcctcagtctcctgagtagctgggactgcaggggcacgctgccacgcctggctaatttttttgtatttttttagtagagatggggtttcaccatgttggccaggctggtgaccccaagtgatccacccgcctcagcctcccaaagtgttgggagtacaggcatgagccaccacacctggcctagaatatcttaagaaaactgtgtgcatataatttttttgcaaaaataaccagtgaattagaaaattttaaaaattaagcagcttaaatatggcctcgaggatgaaggccttgagacggccttagaaccccatgtggcttgacccttgaagaaggtggactgtttttagaaaggaaactgctctccaggtgctaggcagaggcagacaacagaaacacaatagtgtgtcctcccctcctagcaaatgtgctttgagctatcaggccttccctcccctactgtttcttaagatgtggctacaccaccatgtgccctaaagctctgaaggaaaaggccaaatcataaaggggattgctggagtgttatctagcttgtaaaagcttaaaatagtgtccatgaggttcctgaactgatagtggtttaagaggcctgcccccgaggacttggcagccagagggcccgctttgtaaaagccgtgagagttgctctcctgacggcagagcaaacacctcaccttgtgaaaacgacaagccatttccgcacagggtgtaatctttcccacatctgtggtagcagcactttggcggctcagcttcccagagctgccagctgtgttccgagccagacccacgtgccagggccagtttgggtagtgatcagaaaagagcagtctccccgaagtgaaacgcaaacacacatcctctagcttggcggggccctttgtggaaatctgttctgagacagtgccattgttcactttcctgacacttgccatgtccaaggcaagggaggggatgtaagaagaagatccagaccaaacccctcttgcacaacttgtcattggacaaatgagagaactgagatcccagagaggttggttggtttttcccaggctacagtgttggagttgggactagtccccagggtgtgccttgtcccacggctattttttgtcatcctactcctcctgtaagacatggtccctgtgcacacatggcttacagacatgtaaaaaaagtgacagcacaaagtatcacatgccaagaacctaacagtggtttcttcactgaacaggcatccagggaaaggaacagtcaccaggggcctcatggaaggagaaggcacgaagcaggggacagtgggaggcacacacaagcagggtgaaggccggcagtggaagcaaaagtgtgtggggcactgagagaagggcatgattagtaagaccgggacagtggttgaaagagcagcttctgaagagaaagacagagaggtggaggaagggcaggaaccaattgccaggccaatgctggaatcttgactgtgcatgtaagccaagtcagcagaggctctggaccctctgcttgggaaagatcaggcagccagtgtgtaggattgtttctaggatgcaaagagaccccaattaaagcccagttttttaaaaatgttaataaagtgccaaggacttggactcaggaattggcagcaagttcggaaaggaaagagataggacattgaagagctggtcaccggcagaatgctaagagaaaataagtgagagaattaattaagtaacaaaagtataagctaattttgtctgttacaaacaaaattagctaaaggcaaaaaaagatgaaaatttcttctaaaaatgttattccaaagtagtctttcttaaaagcagatctgacaaggaatattaccttgcctgaaacctttcggtagttctctcaaggcacaaacacccttgcatcacttaaaaggccctgtgtgatgtgaccgcctcctatttctgaagcctcgggttaccagtcataagaaataactagcaggttccaaaatacaccagtcctccttgccagcacctccctacctggaaaacaccacacatctctcaggactcagctcagctctcgtgtcccttcatcacctgtttagtgtgatcctaaaggcttcactgcctcctccccaagacagaagcagtctcagcctttcctttgcatctccagtgccctctgtcctcgaggaaaagcaggtagtatagcttggttcacattagaaacggggctgggcatggtggctcatgcctgtaatcccagcactttgggaggccaaggtgggtagatcacttgaggtcaggagttcgagaccagcctggccaacatggtgaaaccctgtctctactaaaaatataaaaattagccaggcatggtggcacatgcctataatcccagccactcgggaggctgaggcacgagaattgcttgaacctgggaggcggaggttacagggagccgagatcatgccactgcacttgagcctgggtgacagaaggcgacttcgtctcaagaaaaaaaaaaaaaagaaagaaagaaacaggttgaaggttgagcagggctgtgaatcactcactggctgggggttgagaggagtctctggctcctgcccctctgcctccccaacaatgttaactgtttctcttacctcgcaaactccagtgcccaacatgttccagccagggctgaggagacagtgcaggttgtgaggcctttgggaaccctggagaaataggttgtgaaggtcacttctacagcagtgtgagcctcttcctcctcctttctctcaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagccagaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagccttcaaaacaaatcaacctagttctatagatgaagacataaaagacactggtaaacaccaatgtaaaagggcccccaaggtggtcatgactggtctcatttgcagaagtctaagaatgtacctttttctggccgggcgtggtagctcatgcctgtaatcccagcactttgggaggctgaggcaggcggatcatgaggtcaggagatcgagaccattctggctaacatggtgaaaccccatctctactaaaaatatttttaaaaaaaattaactgggcgtgatggcgggcgcctgtagtcccagctactcgggaggctgagggaggagaatgacatgaacctgggaggtggggcttgcagtgagccactgcactccagcctgggcaacagagcaagactctgtctcaaaaaagaaaaaaaaaaaaaagaatgtacctttttcctagatttgctggtttattgttttattttggcttcatcctctttcagcaaatcaagggcagctggatggtgaagacctatattgtaaactcaccatagtaccatagtaccttgggcaacccagcctcccactctgaatctcgggtgtcttgtaaagggctggaccaaaggctccctgaccccttgtttcctctcctttttgctgcagcaggccctgccttcaggaccagggctgtctcagggtctaagaccccaacctctgaggttgtcctcagaagtggtctgtcccctgttcccaaaggcacagctttcattcccggagaagatattgagctggtcctctgccagctcaagttgagcctggaagataactctcttttccacaacatggacttggaacatgatccatgttttgctctttaaagctgtggcccctggcttgccaccctccctagcccattgctgcctctgtctcttcaccataggcacttctgccaaactagtggagaagtcttggtctaaactgctaataatgctcttccctaaagaacaggataaaagatccaaaatactttttcttaaattcctgtcaagcctggggtccaccccgtaccccttcccacatgaacgctggaactgagatggcttccccatcatcgtctggattttcatttaacaaagtacttgttgtaaatgtgtacttcttgcctaacgtgaggaactaaaaacttgtccatgcataccccagtcctgtagaaataactgttctcgggctttaggttttccagatttccctcagagctctagaaactgagcgatggacagttgctctgcttcttcaggttggaactcttgatacatccttgtttcctgaaattccaaacttaacacctatagttctctcaggctttttttgaaaagttccttcgtttctatttctattccactctatttagctattattgtgcggcacccccaatggttcctttcctctcagcatcgctgtagcttgcctgtacccaggacatgcccttgactggcacaaaccgtgacagacatgcccttgactggcacaaaccatgacagacaaggccacctcctcagaagcggaacaacctattatcttttggcaatgggagctaacttcactgttttcttacaatacctggtttttcctatctttggtttccttttgattatctctcatccatctcagccactattctcctcccctcccttgtgtctacaacaccccattttaccaagtctcccatttaacctccccatccttttctttcccttaaagtctcatatgatactgcagtcctcatttgtcttcccaaaaaaaaaaaagaatttttttttttttaaggaatccttccttgactcctaaagactcctaaggatgctgaggcctcctcagcatgatttccatatacttactttctctgttggactgcagacaacttgaaagcaggaactttggcagtgtttccccagcaccagcatcatgcctggtccatagtagctaccaataaaaaagtaagcatcatgaacccaaaagtatctgagaaaggtctcaattaatttaaaaagtttttattttgctaaggttaaggacacacatgacccaccctcagaaggtccggaggacatgtgcccaaagtggttaaggcacagcttggttttatacattttagggagatataagacatcaatcaacatatgtaagatgtaca

SEQ ID NO: 13630 - DNA, 49389 bp, Human; identical to SEQ ID NO: 12547

SEQ ID NO: 13631 - DNA, 57751 bp, Human
cacacttgtaatcccagcactttggggggcagagctgggcgaatcacctaaggtcaggagttcgggaccaggctggctaacatggtgaaaccccgtctctactaaaaatacaaaaaattagcccggcgtggtggtgtgcgcttgtaatcccagctactcgggagcctgaggcaggagaatcacttgaacccgggaggaggctgcagtgagccaagatcgcgccactgcactccagcctggacaacaagagcaaaactgtctcaaaaaaaaaaaaaagttgtaaacaaaacaaaacaaaagaaacaatatataacagagaccaaagtgatcctgcaaatcctgaactatttactgtctggacctttaacaacaacaacaaaatttaccacttctgacctaaataataagtgttacacgcagttaggtgttgaagaaagcattacatgggcaggaggcaggctctgaactgtaaaaaccttgtaagattatcaagaatcctttttgcaatttattcagaagtggtcaggtcatccagtttctgcttaaagtgctcacatgatgagcactcactatgcaacttgagctttaaacagaaacctctctactctgtctctatactcatttcagtcttaacttcgatgccccttgtttcctgtcctgcagagctgtcagtctggcgagtagtgagactcagacttatgtctgaatgctaggtctgtcacagactagaaaatgtatatattctgagcttcccaaacttcatctagaaaatgcaaatgataataatttggggaatgtgaggactaaacaaaaaggtatgaaggtgaccagagcacagcaggctctcaatgtgacttccttttgaaatcaatcactttattccaggactccagcccatcattccagcacaaaaacagctaccatgcaatgaagaactcttcactaggagttagtagacttaggctccagtcttatttctactacatatggccatgggtaaaatcactctctctgattcgtaggcagtttcttcaccgcttaagtgagctgaggtgtgaacgaccagatagataatcatccagatcggaaaacccccgagagcgcaggattatctggataacggagccggatggaggattgtctccgttcctcccacactcaagccccgaaaggtcacctgacctagtcttattctttacagcagaaatcgggcaaacccatggcgccgtccacaatctctatagccgccgacctgggtacaggggaagcaggcgaaacaacacacacttctacgcagaccagggttacattaaggccgacgcccacacacgcccacacacacccacacacacacacacacccccacacccccagacttcgttaacttgtgatgataaattagggcgcaggtgacactactgtcccgaacttcagctggaacgctagtccaagtcactgtcctaactgcagctagcactgccgaccttgtccgaggagtttccttccgctccctcaactcccactttcccagggaggggagggggccgggggcaccggcgacagttgcggggaaggaagtggaatctcgcctttgggaaagcccgggcggagagctgagggctcgccgtctcaccttggctgacgtccgcgaggactccctctcggagcaaggttcaggtccaagtaccaaggctctgcgggaccaaggggcgggtcctgcccagaaagggcccctcaccccgcgggcggtcagggccgttcttgagggctgccctccggccgcctgactggaaaaccaggcactccaccccctcctctccgggcccccgtcctcccccggagaatacgacctttcggccatgttagccaggagcgaggggcagggctaaggggccggcggccactcggcatctgggttttagtcaggcagtgctccaggcgcctggctgccaggctacgggagaaaagtcctccgctcggccgcacccgttagaggcgctctccactgctgtcctcttcagctcaagatggtggcctgccgggcgattggcatcctcagccgcttttctgccttcaggatcctccgctcccgaggtgaggcctggccgagggcatcccagacctccgggcagaactcctgccgggactggggtggccccggagccgcgtctccctttcgctgccgcctgccccagcccggagacgcagccctctgtggggatactgccctgggacccggtttcccgtgaccttctgaagagactgtcacttcccctctcacgactcctgcggcgatttcaggcttcctaactccccaactttctgagtctggtgccactcgttctgtcacctttccgcgggtctcttgcgtcgcacttctgggctcacgcccctcatattttcttgatccggagttccaggagaatcgggatccattctgtcgcatctttgtggctccacagcaccttgccccgcaacaagagctgtcttaaaaacagcaccttaccccgcaacaagcgctgtcttgtatgggattaatcagccttgcagatcactgcccctccctgctccgttccctcaaaaccatttttgtgcttactaccccaatcaagtagggagctcaactcttgcagtttcagtaatgtcagtgtgaacgtatagtattttgaatttcagcgggaagttctgcaacttactggaagacacactttaaaaatacgctaatacctctaccttaagcaataaaatgttagatcgttctgagaacgatttgtaatctgatgattcccagtcagcctgtattagctagtgtttttccttttcaaactggcagtgaaagggttaaagtgggtggttgtaggaaacgttgcattttctttccatcccaaatctgtaaagtcaaaagtggacaacgttttattgcatgttgtgcttaataagttacttaactagaaattttaacttttaatttaatttgtaatatgaattacctctcttccctcttccggaaccgctgaagtagtatgctttttttagacaagtagctgaaatcccttactgtaaggggatttttttaatgattgaatatttttctgctcccttttttcaacagctgtttttagtctccacaaaactgtagcatgtatttgccaattataacataagcacattatagaacattgaaatgctgtaaggattgaggaaagagatgaaaaaaaaacgaatcacccattgtcttactactcatatgcttacctacggttagccttcggttatgtttccttacaggtttggtggtttttttcccctattttcacaacacttttgaaaagtaacgtgtaatttttatcttacccctgcattggtttgaaggtatttcttatggatcggcagctgatgtcactcggaagtggtagccagggcacgtggttctagtcactagctgtgttactttggacaaatgccttaaactaaatgggctttattttcctcatctgcaaaatgaatgattgagatgatggatttcctttgcatgagaagtagcatgacagagcaattaataaacattgtttgggccgggtgcggtggctcacgcctgtaatcccagcactttgggaggcccaggcgggcggatcacgaggtcgggagatcgagaccatcctggctaacacggtgaaaccccgtctctactaaaaatacaagaaattagccggacgtgttggtgggcgcctgtagtcccagctactcgggaggctgaggcaggagaatggcgtgagcccgggaggcggagcttgcagtgagccgagatcgcgccacagcactccagcctggtcctccgtctcaaaaacaaacaaacaaacaaaaaaaacattgtttggagtctgacttctgggtttggacctggctctgccttttaccctctgatgaccttgggcaattaatttctgtgtttgttttctcatttgtaaaatggggaataataccaccttgtgtgatgaaaaggagttattttagatatcaagcagtttttcatggagtaagcactcagtaaatattattaactccagcctggaagaaatacgattgtatatatctgagagtttttaaaagtaatttgtacatcttatgtgtgtaataaaaagctaccaacctaatttttctgttttctgtatagaaatatatagacacataaatatatactttgcattgtgttttcaccagtaagaaagtatcattcgttgtagttactgatcccttaatagcaatttataaattttgaaaaaaagtctggaaagtgaatttaaaatgacctgcacccttatattactatttagactcaatagatccttcacagtaaaagtctgtgcaaggctttgccaaacatttaatgagattatgacctttgctggtggatgataaaattctcttgaaaggggccaggcacggtggctcatgcctataatcccagtatattgggaggccaaggcgggcagatcacttgaggtctagcctggcccacatggtgaaaccccatctctaccaaaaaataccaaaattggccaggtgtggtggcacacgtctgtaatcccaactactcgggaggctgaggtgggagaatcgcttgaacccaggaggtggaggttgcagtgagccaagatcacacctggaggacagaatgagaccatatctcaaaaaaaaaaaaattatcttgaaggagacttgtaattcttgaaattttaaagcattccttctctacaagtgctataattctgaatgtgaatatcaaatgaaaatcacttcttgaccagagtatgttgtctaattcccactcctatcctaaatctaaattcctaattaggtatttagtagtaaataggtattagtagtaaaataatttcacaggagatgaatttagaggcaaataccttaatagatggtttttttgtttgtttgttttttcggttttttttttggagacggagtctcactgtgtcacccagcctggagtgcaatggtgcgctcttggctcactgcaacctccgcctcccgggttcaagtgattctcctgtctcagcctccagagtagctgggattacaggctcctgccaccacgcccagctaactttttttttgtttttttttttttgttgttgttgttgtatttttagtagagacggggtttcgccatgtcagccaggctggtctctaactcccgacctcaggtgatccagccacctcagcctcccaaagtgctgggattacaggcgtgagccaccgcgcccggccatagattgtgtatttttaaatttgattctcacttccttaatctcgtcgcttctcccagtgttgaatcttgagaaaagctgttgattattacaaccaaagtaatgttttcaaatttgaaatttatgttagcataatccagctctcttcgctgactgtagtcttatgaggttttgtagttattcttgggttacattacaaagatgattaaaaagtggggcaaaggtttctctctactttgctggcacagtagatgtaggctaaagttcactcagctgccatagggtaagctctgcagttaggtagtgagtaaggctagactccaaaagcaaagctaccttgcagtgtgacttgatttggttgactctggtttggaattattttcgaagtatgttcatgtatatactggttttctatttgtttctatttgtcttgatcttggagaggttttgtgtatgagtgtgtgggcagcataggtaggttagtggacaggagttaaaatggtttaaactgttggctaatgaccactaacctgttatctcaaatatttgatctttaaaactgcaacccagtggggcatagtggcacatgcctgtaatcctagctactccggaagattacttgagcccaggagttcaagaccagcctgggcaacatagggagacctcgtctcaaagaaaaaaaatgtttttgaaatattgcaacccatgctcactctatttcctttttttgcttaggtgcttattttctaacatatttgtgtttcttggtttttccctctcaacctgcattcccaatcagttcattcccactctaatccactttaccctgttttgctagaattacctatccccttcttcccttcccactggaatttctactttgcaggaaaactttttctatgccaggcctattttcacttttcatttatcttcactgagtaggaactgattcttcccagatatcatatcccctgctgacctggaatgtaagctccaccaagacagggatttttgtcttttttgttcaccctgaatgtcctgctgtactccaagtgcctagaacagtgaatggcacatggaggtcacaatatatgtttttgttgaatgaataacagattatgttggaaaagattacaatgtggttggtgaaacacctgctacagatgcagcagttagaggacagaacattaaataataaaataaaaatgcaggcaaggaaaggaaggatcactgtagacagaatccgaagatgaggttttgtggaaaagactggagtcatgatgcaaatataaagaaggaagagtggtaaatacagatgacacagatttcaaatgatggaaaagcaaagcaggaaacatactattagtcaagtagaggcactggggattgaggagatggctggcttctcccatcttaaaacactgaagttcacttgtaagagacttgttcacagtcacacagctagtaaataaacctgatggttgaacacaagtcctttgcctttgcactaagtcggctggcttggattgcttaaagaagaaatgcaggcagaacctgaaatcaccccattctgcttctggtgctaaccacagttttctttctttttttttttttaatgtgtcaccttgcctttccaaccagtataaagctgctattttttgtgccttctcttccctttccataaggaactgggggataaagagaaaatacggaggcagcaagagccttggcaacctactgatgatcctcccctattccactccaccttcactgggttctccagtcagtagttcccatgtgcctcttacattgctatctctttggttctctttgcttccctcttcccttttgtgattacactgggcccacctggataatccatgataaactttctttattaaggccaactgattagcaactttaatcccccctttgccgtgtaacctaacatattcacaggttctggggatgtatatccctttgtgggggccagtcttcctcttttagtatccaaataatcatctgacctaacaactgaaatggaaaaaatatggcagtagtcatatggcctagaatacattgtacagatttggggtttttgttgttgttattaatgtaaattacagctttgttatatataaaaggtactacagaaattgtttcgcaaattaattttgaaatgtcttttcttacaggttatatatgccgcaattttacagggtcttctgctttgctgagtaagtttaatttctttttaatgtgtatgcttacattgctttttggatttatgttgcaataaatatgtttacaaataaatctttcttttctttttagccagaacccatattaactatggagtcaaaggggatgtggcagttgttcgaattaactctcccaattcaaaggtatctcatttaatttgcagtttttttctgctaaccgcattatgaatctagtcctgaatgggaaagatctatcccatatttccccaaatctaccaatctggcagtaatcttacatgaatttacagttttgacagttatgttaaactttgacagattgccaagggagccagttttctaaagcagaggttcttgcgtaagaattcctcttgttgaccttaggtgccaccagcctcctggttatagtgtagaatgaggaggtgacttattagagaagaaccagagtacaagctttgtttataagactcaaaatttgcctacccatcttaaatatgaggttgttaatccattttcttcattacttgcctgacataagtcactattcatagtaagttggctgagtgaaatgtggatacttggctcttaagcttcctgagggatctgaatgactcaatgcaattcacatattggaaatcaagttctgttcgaattgaaacttcttttgtttttggcagcttcaataaagtgtgtaacagtaatccattcttttgccaagaagagctttattgtgagagtccatgcttttcccccatctaaatttggtgtattcttactttaaaaatcttgtagccaggctgggcactgtggctcacacctataatcccaacactggatggccgaggcaggaggatcacttcagcccaggagtttgagaccaccctgggcaacatagcaagaccttgtctctataaaaaataaaaaatagttgggtatggtgatgttcacctgtagtgctagctactctgaaggctgaggtggaaagatcacttaagcctaggaattcaaggttacagtgagctatgattgcaccactgcactccagcctgggccacagagcaagaccttgtctctctaaaaaacaacaacaacaaacttatagccagaggcttagatgtaataagacctagatggaagcagttgacaactatcacaaattaaggtaaataagagccattcccctttactagagtaaattttagcactcactaaccaatgattcaagcttaagatattttttcagaattttcttaggttggacatttttcctgaacacaaaagtaatatatgtcaatggtagaaaatttttcaactataaaaaattataaagaagaaaataataaacattcataattcaaacctaaagataaccacatctttttcttggtatcttccatgggataatcacatttaattcagtttcaatgaataatatttacaaaactaagatcatactatatggttttttttgaagatagggtctcattctgttgcctaggctggagtgcagtggcacagtcacaggttagtgcagcttcagcctccccaggctcaggtgatcctcccacctaagcctcctgagtagctgggactataggcgtgtgctgtcaggcccggctaatttttgtattttctgtagaggcaaggttccattatgttgcccaggctggtctcgaactcctgaactcaagtgatccgcccaccttggcctcccaaagtgcagggattacagggatgagccaccatgcctggcctatatgtcttatttgtatttcatttttttcttaacattatgcagattttttccatgccaataaatgtttgtagacctatttgtttatagcctacatatgattcaaactctgaggatgaccctgagtttctcctttgagaaaacctatttttaaaggaaggggtgcttgtagtgggccaaagctgcctgaatagaaagctactgacttgctgggagaatgatatttcttactctcttctaacagtatatttctgccggataagtatatttcttataatcaaaatagcatttgatggtggtacgtacatccagtgcttcaaatttaaacccttacctgtatatatttccctttggcaggtaaatacactgagtaaagagctacattcagagttctcagaagttatgaatgaaatctgggctagtgatcaaatcagaagtgccgtccttatctcatcaaagccaggctgctttattgcaggtgctgatatcaagtaagttttaggaaacttgaagtcaccttttatcttggttaatagtgtgtttcttaggcctaataatttctccttttaaaagaaagtagaagtgctgggcacagtgacacaggcctgtaaaattgaaaatgtacgtatcaggctgggtgtggtggttcttgcctgtaatcccagcactttgggaggccgaggcaggtggatcacatgaggccaagagctcaagaccagcctggccaacatggtgaaaccctgtctgcactaaaaatacaaaaattaggcatggtggcacacgcttgtaatctcagctactcaggaggctgtggcacgaaaatcccttgaacctgggaggcagaggttgcagtgagccgagatcacaccactgcactccagcctgggtgacagagtgagactgtcttaaaaaaaaaaagtatatacacacacacacacacacacacacacacacacacacacacagagtatatatatatatatatacacacacacacacacacacacacacatcatgtgatctagagaaatctcaccccttgtttataagaaccagtgtacaaggatgtttggtcctgtgtagtgtgaaataatgaagaatttaaaaccaaatgtcagtcagtaggaaaatgggtaagtaaaatgtggactattcacacaatagaatactacaaaacaggtaaaaggaattaactagatccacaatatgatgttagaactcaaaaacataaggttaagttaaaagaaaagcaaattgcagaatgtttcatacagtatatagtttctataaatgttttaaaaccaaacatggaataattcttgatactatttatggacacaatcgtagttggtctggaaggagacactacaaacatgaagatggctgctttggggaaatgaagtgggtggtaggacttgattgttaaaggcagctttacagatgcagctagtattttcttttcctctgctaaatggtggaatgcatgcctacattaacttatttacaattgtttacacatacataaggaggggaaatgatattttagtgtcagtttaataggttaaaatgttaagttgtcaattccattaaaatatgggtatttgttatgttctttgtattttagacaatgatagccagcattgtaggtttagtaatttgtactgaaagtgtaattatttatgtgtagtaatcagtctcttgttaggcacaaataattcagctagaagaaaaaccacttgataagataattttgggtcttctaaaaaattaacattaaacagaacatttataaagtctaacaagacactgatgtacctggcagtagctacctatatccagaggaaaatgcatgtagcttctatgaggccagctgagcaactctcagtgtataaaattacagaatatactagttatccttggtcaaaagtacaaaatccatatcctaagtgtgttcacaaaatagcaaatgaaacaaactgaaattaaaggacattgagtggaacatcattgcacctgatcatttttatttacttatttatttttgagacggagtctccctctgctgtccaggctggagtacagtggtgcgatctcggcccactgcaacctccacctcccaggttccagtgattctctcgcctcagcctcccgagtagccaggactacaggaatgcagcaccacgcccagctaatttttgtatttttagtagagacgcggtttcaccatgttgaccagcctggtctcgaactcctgacctcaggtgatccacctgccttggcctctcaaagtgctgggattacaggcatgagccaccatgcctggcctacctggtcatttttattcattagtgggatctgttaaaatgttttagatttctctaaacaacctggaagcttttcttttgcgtcatttttattgctgttaactacctgatagtgaaatgtttaatctgatagtgaagtaatttaccaaagatgattttcccttgtaccaagctttgtaatttaatgatttattacagaagtaaaaataaattatgcaacacatttatgttttctggatccagaatttttttttttttttttgagacagagtctcactctgtcgcccaggctggagtgcagtggcgcgatctcggctcactgcaagctccacctcccggtttcacactgttctcctgcctcagcctcccaagtagctgggactacaggcgcccgccactatgcccagctaattttttgtatttttagtagagacggggtttcaccgtgttagccgggatggtctcatggatccagaagtttaacactctttatggagaaatgatgttgctgctattgtgctatttgaagcaaaatcattcttaaccttctatttgaagatttgtcatcaaatattgatgcatgataggataagtgtatagtgaataagtattgaaccaaataaattatagttttatctttttctctgttctctacttttatggataatgcagcatgttagccgcttgcaagacccttcaagaagtaacacagctatcacaagaagcacagagaatagttgagaaacttgaaaagtccacaaagcctattgtggctgccatcaatggatcctgcctgggaggaggacttgaggtatagatattctaaagttattgagacactgtccaactcattggtggcattcatcagctgtaaacccttaggctactgctttgcctggaaaaagtttctggaggagaatccgctttgttttttgttttttgctttgagacggaattttgctcttgtctcccaggctggagagcaatggcacgatcttggctcactgcaacctctgcctcctggcttcaaacaattctcctgcttcagcctccccagtagctgggattacaggtgtgcatcaccatgcccagctaatttttgtatttttagtagagatggggtttcaccatgttggccaggctggtctcaaactcctgacctcaggtgatcctcccgcctcggcctcccaaagtgctgggattacaggtgtgagccactgtgcctaaatagctttgtttttagttatcaaacttctggataggtgttaatccttaatccacatgacacagagcaagtggcacaaagcaagtaaatgaaggtgtgatgttttcatttgaactgcatctctaatgtccttttcagctgtaaaaatcttgttcaagtttgcagggcaaagattcagaagtgtgatctaggctcttaagctacttaagtctggttgagacacataaagcataatataagtgctttgtcagtagtaaagacggtaaataatagaagatttgagagaagagatgcttactagacccgaacatgtaggaaagaaaagaaggggaaaaggaaacattcattgagcacttttcacatgctgaactctgtgccagacactttcacatatgcagtcatttaccacataacgtttcaatgaccaattgcacatacagcagtggttctataagactgtaacactacatttttctataccttttctgtgtttagatacagaaatgcttatcactgtgccacagttgcctacagtattcaatagtcacatgcagtccaggtttgtagccccttaggacaggggtccccagttcccaggccatagcctgttaggaactgggccccacagcaggaggtgagcagtgggcgagtgaacattaccacctgagttccgcctcctgtcatatcaacagtggcattagattctcataagagctggaaccctgttgtgaactgcacatgagagggatccaggttgcgcactccattggcctctattgcctgatgatttgaagtggaacagtttcatcctgaaaccactccctcccaccccacccccagttcttggaaaaattgccttccacaaaacctgtccctggcgtcaaaaaggttggggactgctggactaggagcaataggctatcccatatagcctagatgtgtagcaggctctgccatctgggtttgtgtaagtacactctgcgatgttcacacaacaacaaaatttcctaatggtacatttctcagaacatatccccctcattatgtgacacatgactatattaattaagaaaacctgtgcctggtcctaaactataagcagaatttgattaaccagaatatggagggaaaaacaattccgcatatggtatggtgtgagcaaaggcaaaagcaaagccaactaggacactgtaagtagacgtgcttgattggagagtccggggctttttaacctggggtccatataaaattgtgtgtgcatttttctcttgagagcttctctagctttcagtagattttttaggagatctacggcccaaaaagaggttagtaaattagaggaaaagtatgaaaaaaaggctaaaaaggtaaattctagaaattattaaatgccagcctaaggaatttcagtttattctgtgagcacattcctgctttataaataatctttagacccttatccatctcaagttgctactaagttacattttctaacattctaattttctttcatttgttcaaaggttgccatttcatgccaatacagaatagcaacaaaagacagaaaaacagtattaggtacccctgaagttttgctgggggccttaccaggagcaggaggcacacaaaggctgcccaaaatggtgagtctaacatcccctttgtgaagctatatgccctctttagatctgttttcttgtataaaatgcataatatgggcattcattgtagaattaaaaaaccaaataaaatatgagtgtacaggatcagtgacagactttattcctggtacttattttttcaattccacagatttttttttttttttttttttgagacaaaatcttgctctgtagcccaggctagagtgcagtggtgtgatctcagctcactgcaaccttctcctcccaggttcaagcgattctcctgcctcagcctccccagtagctggaattacaggcgtgcaccactgcacccagctaattttttatattttttagtagagatggagtttcgccatgttggccaggctggtcttgaactcccgacctcaggtaatcctcccgcctcagcctcccaaagtgctaggactacaggcatgaaccaccatgcctggcctaattccacagaattattgatcaaggtcctttgttagtctctgaggaaggataaagataactaagatgcatgtcttgcatttctggagcttatggtttaattggttccttttccacataataccatcttaacagtttttcaaaaccatgagtcatattaatatttcattacaaatataagaggcagaccttttccctcattgtctgatttggatgttctcactgctgtgttgtatggaaccaaaagaggctcagcaggctttgaattccaaggagaagggaaggacagtcagacctggatgctgcagagcaatcttaatgtcaactcaagggcccactgaaccttatagcttctggcactgtagattcctcagtgaaaacaaggctcaacagaaatactctttgcagggaagttgatctcaattgagcacaaaagaaaacaaggtttatggtgttaattttctaataataataatgtgctttccttcataggaatgtcataaggatttattgaaagaatgaatatgcatatatgtgtatcaaaaatatttgctgagtttctttctttcttcttttttttttcttaaactatagctggtatttgaatgttgctagaagcctttcttctagtatgccatataagcagccctagctgagttctatttttgttaagcttaaaattctttttaaagactttgtcaaaactatcaggtttctcacagtcttctctagtttcaatatgagaattttattttattttatttttgggacagagtcacttttgttgttcaggctggagtacagtggcatgatctcggctcactgcaacctctgcctccggattcaagcaattcttgtgcctcagcctcccaagtagctggaatgacaggtgtgccccaccatgcccagctaattttttgtatttttagtaaagacagggtttcaccatgtcgggccaggctggtctcaaactcctaacctcaggtgacccgcctgccttggcctcccaaagtgctggaattacaggtgtgagccaccgtgcctggccagaattttacatattatatatatgatagaaaaaaacccctcagaataacagaaatgtacaattttaggaaacatgaaattctttaccttattagtataagaatcctatatattgaattaagagataaagacatttttgcttcagctagaggtatctaatccccaaagttacccaagtgtatatcagtatattaaatataacttatctatgctgttgacaaatagcataaacatatggcttgacttttctcattttaatatttgttcatttgatgatttgtaaactatataattatcaccctgatttttttccccctatattctcatccttgcttgcctgttaggtgggtgtgcctgctgctttggacatgatgctgactggtagaagcattcgtgcagacagggcaaagaaaatgggactggttgaccaactggtggaacccctgggtaagtgttagcacatctcagagtcagaccttataaagttacttattttcttaaagagttaacctcttaggccaggcacggtggctcacacctgtaatcccagcactttgggaggctgaggcgggaagatcacttgaggtcaggagtttgagaccagccttgccaacatggcgaaaccctgtctccactaaaaatgattagccgggtgtggtggtgcaaacctgtagttccagctacttgggaggctgaggcaggaggatcgcttgaacctggcggggctgaggttgcagtgagccaagatcatgccattgtgctccagcctgggcaacagagccagactcccatctcaaaagaaaaaacagttaacctcttgaatatcacaggaagcacagagagaagctcaaactcttaagaaatgagtcattattctaaggaaggaagttttataaaatagttaatactaaatcattttcaacatcaccctgatttttattttgctttataattagaacattaggagtacagaattcagtcaagtcattatttttggttcttaaattacctgtatcattatccatgcataaccttccttcagtttcttgtgtctgttttagtaatataataaatgaaacaaccaacctgagaatattaacaataattgatatctactgatgggctacttcctcccattcagtttctttgcctccctttatccaaagaagccactattctgacttgtgtgttcattaccctcttatatttattgaaaatcagcattattgagatattacttacataatagtaaatgtattaattttgtgtgtgtgtgtgtgtgtgtgtgtgcgcgcgcacacatgttggggtctcactctgttgctcagactggaatatggtggtgtgaatatagcttgttgcaacctcaactttttgggctcaaatgatcttcccacttgtgccccccgagtagctgagaccacaggcatacgctgctacaccagctaattttttattttttgtagaaacgagatctcactctgttttccaggctagtctcaaactccgggctcaagtaatcctcctccctcagccacccaaagtgccgagatttacaggtgtgagccactgtgtctggtgaaattgaccaacttttaatgtataatttgagttttgaaaatgtatatagctgtgtaaacactgccacaatccaaaaatagccgtgcatggtggctcacacctgtaatcatagcattttgggaggctgaggtgggagaattgcttgaggcctggaattcaagaccagcctggacaacagagcaagatcctatctcttaaaaaagaatttttttttttcaattagctgggtatcatagtgtatacctgtagtcccagctagtcaggaggctgagacaggaatattgtttgagcccagaagttcaaggctgtagtgagctatgatcacaccactgcactccagcctgagcaacagagtgagatgccatcttttaaacaaaaatttttaaacatttctggtatgtagtttgttttaatcttcgttcacttagcataatgcttttgagatgcatccatactgttgcatatatcagcagtttgtccttattgctgagtgttactccattgtagaaatgtaccatagtttgtttatccgttcaccaaatgatgagcatttgagttgtttctaatttagggctattctgaataaagctgctatgaacattcatctttaagtctttatgtgggcgtgactgggcgtggtggctcaagcctctaatcccagcactttgggaggctgaggcaggctgatcacctgaggtcaggaattcaacaccagcctgaccaacatggcgaaaccccatctctactaaaaatacaaaaattagctgggtgtagtggtgtgcacctgtggtcccagctacttgggaggctaaggtaggagaatcacttgaacccaggaggtggaggttgccgtgagccaagattgtgccactgcactccagcctgggtgacagagcgagactctgtctcaaaaaaaaaaaaagtctttatgtggacaaatgtttcatttctgttgggtaagtactgaagagtggattggctagtccatataacagatatatattagcttttgaaaaaaaaagtttggcctgagcaacatagcaagactctgtctcaacaaaataaaaagttttaactagttgggtgtggtggcacatgcctgtagtcctggctactagggaggctgaggcaggaggattgcttgaacccaggagtttgaagtcacatggagctatgatcaggccactgcactccagcctgggtgagagagggagaccttatctctgggaagaaaaaaaaaaaatttagagatgagactttgagtcttgctctgtcacccaggctggcctcagactcctgggctcaagcagtcttcctgcctcagcctcccaagaagccgggattacgaggcatatgccactagtatttgctaggtatgtgtttgcttttctgtcagactgttttcccaaagtggttatactcttttgcattcccaccagcagtgtatgagagttctaggtaccaaccactttgcatggtcaatctttttaattttagacattctaacaggaatgtagtaacagttcttttttctttttttttttttgagacaaagtctcgctctgttgcccaggctggagtgcagtggaacaattttggctcactgcaacctctgcctgccaggttcaagcgattctcctgcctcagcgtcccaagtagctgggactacaggcgcccaccaccatgtccaactaatttttgtatttttagtagagatcgggttttaccatgttgtcagggctggtctcaaactcctgacctcaagttatccccctgccttggcctcccaaagtgctgagattacaggcgtgtgccaccacacccagctggaattagtcatatttcattgtggtttttatattaccctaattaccaaagatattgaatatctgtatatcttatttgataaagaagcatctgttcaaattttttgcccattttcttggactgagtgtttttcctattatcgagttttcagagttctttatatattaggatatgagtcctttatcaaatatatgatttgcaaatatttcctcacagtctctggcttatcttttcactatataagagcagaaattcttaattttaatgaagtctggtttatcaagtttctcttttatggatcatgctattagtgtggtatctaaaaaatatttctctaactcaagatcactaagttttcctgtatactttcttctagaaattttctagttttagctcttacattttggtctgtgatccatttggagtatttatggatcatgctattagtgtgggatctaaaaagtatttttctaactcaatatcactaagatgttcctgtatactttcttctagaaattttctagttttagctcttacattttggtctgtgattcatttcaagtttgtatatggtgtgaggtaaggattgagggccttttcttccctttttgcatatgaatatccaaatgtcctggcaccatttgttgagaagactactatttcctcagtgaactactttgatcccttgatcaaaaatcaactgaccttatctgtttgggccaattggatttcctattcctagttatctatatgtctttttgttaaaccaataccacactgtcttgattattgtatttttatagggaatcctgaaattaagcagtatgagtcctccaactcaggtcccttctttcaaaattattttgctcatactagttcctttgcatttgtgtacaaattttataatcattttgtccatatctacaaaaatacctgctaggatttttattggaattgcattgagtcagtatataaatttggggagaattgacagcttaaaaatattgagtcatttcatccatgaacatggtaaagttctctgtttatttaggtctttaaatttctctcagcagtgtttggtacttttcagtgaatagatcttgaacacattttgttaaatttatgcctaggtatttcatacttgcaggttgttttacttttttaactttaatttctcactagaatatagaaatacaaagatttttggacatggaccttgtatcttgtggtttagctaaattcatttactagttctagtagccttttttattaatagattcctgaggattttctacatagataattatgttgtctgtaagtaaagacagtttgacttctttctttccaatatagatgtcatttgtttctttttcttgacttaccacaatgtctaagacctttgtacaatactggatagaagtcatgagaacaagtattgtcaacttgttcccagtcttaggaggaaagcattcagtattaagtatgatgttagttgtaggtttttcatatgtgctctttatcaggtttgctgagaatgagtattgaattttgtcatgccttttctccatctacagagataattgtggggttttcttcttttttagtctattaataatgtcagtcacattgatttttgaatattgaactagccttgcttcttggaataaactccattttgttgtcatatattataaaggatttttatgtcatcatgagggataaagtctcaaggataattttcttatgatatttttgcgtggtgttggcatcaggataatgctggcttcataaaatgaattgagaagtgttctctcctcttttttttttttttgagatggagtctcaccctgtcgccaggctggagtggtgcagtggcgagatcttgggctaatttttgtatttttagtagaaacagtgtttcatcatgttggccaggatggtctcaatcttctgacctcatgatccacctacctgcctcagcctcccaaagtgctgggattacaggtgtgagccactgtgcctggcctcctcttatattttctggaagattttatgtagagttggtattatttcttaaatacttgatagaattaaccagtaattcctgggctcctagttttctttgttgggaaaatttttacttatgaattcaattaatagatatagggctattcaggttctccattctagagtaagctacgatagtagtttgtgtctttcaaataatttgttcatctattaacaatttgccaaatttattgcaataaagctgttcataatacttgtcattttaatgtttttatactctatactgatgtctcctcattcattcctgatattgatagtttatcagctgataggactttaatcacttataaaataccttcatagtaacatctaggttaatgtttattgaataactgggctgtagcctagccaagttaacatatctgaagactatcatactccaccccttgtctgtttgacacccatacacatctcctaaagccatacatagtcttcaaataaaggcaatgacaggagtcatactttatcctgacataatgcaattctcctttatacaaccaaaaatacactaatcctttccctagaagaggatgcagagtccttgggtgaaattcactcttctctcatattctgtaacataaatgctatgatataaagttaaccattatggatacatcttatattagatgataaggagatagagaagaaacacaaatatttggttaattatatacattcataacaaaataagaaatcctcataaatagtacagtattcattactgtattcagaaatgaatatttataatatttccagatcagtattcagctgatgtggaaagagaactgagctatcaaatatcagagtaaataattaaacaacccaaaaggaaagtaacagtggagcctttattcacttactgtgatagtttacacaaaaggctaaaaaccaaagaaagtgccagctcctttttccccccagtaccgttttccccatggaatggtacactggttgaggatctggtagattagcatacaagtgggggacatctcactgttgtgaaagccctgaacaaaaggttcctgcggctttatggaccctgggtgaggagagtggagtagactgggagaagtgtctttaagatttcccattccggccaggtgcagtggctcatgcctgtaataccagcactttgggaggccaaggcgggcagatcacctgaggtcaggagttcgagaccagcctggccaatatggcaaaacctcatctccactaaaaatacgaaaattagccaggcgtggtggtacatgcctgcattcccagctactcaggaggctgaggcaggagaatcacttgaacccgggaggcagaggttgcagtgagccgagattgtaccattgcactccagcctgggcgacagagtgaaactccatctcaaaaaaataaataaataaataaaagatttccccttcctcctttgacaaggtctcagcagaggcacctgaagaaggcctcagccaaagtccccatataaaaagacctaggaatagaaggcatctaggctaggaatgcacatttgtgtaagagcttagccagccccagagacccaagtccttgactgcagctccctcagatgacaccgcagtgcactggctgtgtaccaggtttggtgtggaaagggtgatatttctactccccttttcatattccctttgccctcaggaagtacctcagtttgtcctagttctttgcctggtggggtgaccttcattcctaaaatgtcttctaggccactagcagtcccatgtgaactgggttgtgatcttctactgactaattagaggtcatgttagtactaagggacaccctaagagatctgccacatttgagacatactcttccttacctctgttgtatagtagcaacctaatatccccttggtaatcaggattaatcaccccagccagtacagtacccgccctctgctgcctgttgattccaaggcatgaggagcccaaagtggccagatggcagttttaactaacagttcagtagaatcattgttgtgtctcctggtggaagcattcctccctttggaactgagccctctagacaggcagagcccaaagttgcagggacaagaagcagaaattttgctggtagattagatcactaggggtaatagtgaactgggtaatttctgtttgctctccttgatttctggactcacgaatcctggctgtgggaaaagtagcaccctatactggaagctgacttaaaacatagcagcatcctggaggacattgactctgcaaaatactgccacttagctggcactgtgatggagtcttcagtagtccatcccaccattctgtcaaggcaactgcttcccggtgatgtagtaagatcagtgtttcgtgagcatggcccattgctgcacttcacttactgagaagtgaattccttgataagaagcagtgctttgtgggataccataatggtgtgggataccataaggcactctataagtccacaaataagtccacttaccacaaattggtaagtgaaagtccatattgcctacgcccatgcataacctccacacccaccatcatggccactgttcatgaagcagtgataagagtgactgcggaaagatgctgactgctatccatagaacgagtcatcccatccactttgatcattgaaatcctcggctgaggtcactctttgatgagcatttaatgggacacaagtgttttcacattatttgcctattcagagaggtctatccactgacctattccccaggtgtccttgtatattagtttgctagggctgccataacgaataccagactgagtggcttaaacaacagaaacttaacatgttttctcgcatttctggaaactggaagtctaagatcaggtgttagcaggtttggtttcttctgaggcatctctctttggcttgcagatggcactgctttcttactgtgtctgcacatccctggcatctcttttgtgtttccaaattttttcttctcataaggataccagtcagattagattagggtacaccctaatggcctcattttaacttaatcgcttctttaaaggccctatccccaattacagtcacattctgagatactggaggataggacttcaacatatgaatgaggtaggggggacacaattcagcccataacaccttgccaacagtttttcatctgtgttccctgtaagttccttaccacccaggcaaaccgtttgccacggcctatgaatcagagtagacccttagctcaggccatttttctttctagacaaaatgaacaaccgggtgcactgtcagaagtactgcccactgggaggctatcccttcaccactgtccttaagggatgtcccagaagggactgtagtgttacagctgtgcacttccaggtggtacctgcgtatcacacagaaatatctacaaaccaggcctgagtttttctttaccaatcaactggccatagagaactccccatgaggccataggtgcaggctggaagagacaaagaagaacagggccgtggggtattttggctacttcctcatgcagcttgtgcctttagggtctgtttaagcccagtcttacatataccacttgcatttgataatggagtgctaccgtgtacaccccactttatggcttagtaggttagacaacatctgtttcatgatcagcagctcaggtcaccagtaacttgatgccccatggttaagctttgagtctctgtgaagtcccactaacaagccaaacactgtttcccaaaaggagagtagttattcacagaggatggtagggctttttctaaaatcctaagggtctgtgttgtgattcacctaatagagatctattaaagactccagacagcacctctgtctgctgccgacacttcaggcgccatcaggtttgaatcacgtggcccaaatggcagaacagcttctcttgttctgggtcccacttaaactagcagcttttttagttactcagtaaatgggctggaatagcaacccaaatgagtaatatgttgtctccaaaatctgaagcagcccaccaggtgttctccgtgtttttttgtggtaggaggggccacgtgcaacacttaccctttgccatagaagggatgtctttgtatgccccagaccactggatccccagaaatttcactaacatgggaggccctgaattttggagggatttatttcccaccttctgacagacacatgtcttacccccagtatgtctagagtagttaatacttcttgctcaccagatccattcagcataatatcacagtgtaatgaaccagcatgatatcttgtggaaggacaaggtaatcaggctctctgtggactaaattatgatatatggttgaaaacaatacacccacccctaaggtaagacattgaaggtatattgctgaaagcaaactgcttctggtggtctttactaacagataccaagaaaaaaaagcttttgtcagatcagtcactgcataccaggtccaaggatgtatgttaatttgttcaagcaataaaacgacatctggaacaccagttagaattgcagttgccacctgattagatgtacagtaatccactgtcattctataggatccatctgttttctgcactgtccagagtaggcaagttgaatgagaatgaagtgggaatcaccacccctaccgctttcagtccttgatggtgacactaatctctgcagtccctccaggattgtggtgttgctttggtttactcttttctaggtagaggcagttttagtggcttttacttggcctttcccaccatagtagcccttactctacaagtcagagcatatagtgatattactcattgctgagtatgtctgctccaattgtacattctgaaactgggaaaataaccgcaggatgggctcagggacctgctaggcccactgagacagacctgagctaaaactccattgatcacttgacttcataagcccctactctgactgctggaccacagcgaagtttgggtcccctagaattagtgttagttcagaagccagtgtctagtaatccccaaaaaatcattgtttccccttctgcaaggcaaatagccataggtccctttggggaagggtaggagaaagataaacaggaaagtctcctcaagaggacacagcttccctttcattaaggagattctgggtctgtaaactagctcatttctgggaattgcttaaggggccatgactctcttcaggtgattcaaattatacttctgtttaccagacctagaattcttctgcttatacagatcaagtaagagttagtagactgcccatctatttcttttttagggacaccatgatcaaccacccaatgctataggtctcagcaagtcagactattctgattactgctttggctccactatttattatggtaactatgcccaccttgatttggcatggtgctgctacttgggccctgccaccccgggattcctttatccccattgcatttagggatcccagttgatggtagcagttcccactgtaatttctgacctacaaagagaagcaaccacagagcaaagatgctgggcctcacctcacaaattgatttctcacagtggtggtgaagggtgcgtcctctaacccttccagggtgacctgtcagttctttgctccttttttcttcttcctgctttcttttggattaataattttttattggccgggcacagtggctcacgcctgtaatcccagcacttcgggaggccgaggtggacaaatcacgaggtcaggagatggagaccgtcctggctaacatggtgaaaccccatctctactaaaaatacaaaaaattagcctggcctggtggcacatctgtaatcccagctacttgggaggctgaggcagaagaatcactagaacctgggaggtggaggttgcagtgagccgagatcacaccactgcactccagcctgggcaacagagcgagactccatctcaaaaaaatatatatattttttgtcttcattactggccttttactttgcttttcccttttaatggttgctctggggttttacagtatacatttttaacccatcacagtctattttctttctttctttttttttttttttttgagacggagtcttgctctgttgcccaggctggagtgcaatggtgtgatcttgactcactgcaatctctgcctcccaggttcaatcaattctcttgcctcagcctcctgagtagctgggattacaggtgcacaccaccacacccagctaatttttgtatattagtagagatggggtttcactatcttggccaggctggtctcaaactcctgtcttcaagtgatctgcctgccttggcctcccaaagtgctggattacaggtgtgagccaccacacctggccggttttcaattgataatattttcctgtggtgtcagaaccttaaaagagtatgcatttattttgtatactccccatttttgctattgttgttatacattttactgctacatacattataaattcttgtatatattggtatatttgttttagataattatctcttaaggagaataaaaaattagaaaagatcttttttatagttgcccacatagttaccatttttagtgctttttatcctttgtataggtagatccagattcccatctgatttggttttcttgcaacctgaagaacttcctttagtgttttctgtagtgtaggtctgttcttaccttttgatttgtctgacaaagtctatttcccacttcatttttaaacatatttttcctagattgctaatgtttcttttctctctcttttttttttttgagacagagtctcacccttttgcccaggctggagtgcagtggcacaatctcagctcactgaaacttccacctcccgggttcaaatgattctcctatctcagcctcctggatagctggaattacagtcacccactaccacacctggttaatttttgtacttttaatagagtttctccatgttggccaggctggtcttgaactcctgacctcaagtgatctgcccactgcggactcccaaagtgctgggattacatgagccaccacacctggccggctaatgtttttcttttggtactttataaatgtctccattgtgtttggcttgcataatttctgatgaaaagtctgttgtcacttttatcttggcacttttttgtttgtttgtttctttttgagacagggtcttgctctgttgcccaggttaaagtgcagtggtatgatcataactcactgaagccccgaacttctgggctcaagcaatctttccacgtcagcctctcgagtagctgggactacagtcatgcaccaccatgcccagctaattaaaaaaaaaattctttttgtagagacaaggtcttaccatgttgcccacactggtctcaaacccctgggctcacgtgatcctcccacctcagcctcccaaagcactggaattacaggcatgagccactgtgcccagctgtcattcttttctttatacttctatatatgatgtgcctttcccttcctctgtctgctttcagattttccttttatgactggttttagcaatttgattatgatgtgccttggtttgttgggattttttttaaagttattatgtctgggattcattgagcatcttggacatatgggcttatagttttcgtaaaaattggagacttctttggctattatttcttcaaatatttttctgtctccctcccctttttggagattccaatttcacattgttaggtcatttgatattgcccaaaaatgaagctctgggttgtttgttttaggtcttctttcattctggttatttctactgccatgtgttcaagtttcctgatgtttccctcttctgtgtatccctgctgttaatccaatcccatgtgattcactttttttttttcagacggggtcttgccgagtctggtccttgagctactgggctcaagtgatcctctcacctcagtctcctaagtagctggggttgattcacttttatatcttcagtttctcttcattatcgtcctgttttcctctaccttctgtaacatacagcatgaatttacagtagtcttgaacatcacgtctgctccttctatcatttttttcatttctgaatctgtgtctatttattgatctgtctcctggctatgggtcattctttccttgcttcatttcatgccttttatggtggttctttcctcagctgcagatagtttcccctcatgcacatgcagaacaatactcggccagagtttcaaggaccgctctttagagctctggagctctcctgttgtgcagcagctgctctccagcatttcacgtcacagattccagctgccctggcctccctcaggattatgactgtgttaggacttttctggacactgaacttttgtcactccaaagttttgggcttagttattattcctccttccccacacaggttcaaaataggccaaatggtccaggctcggtggctcacacctgtaatcctagcactttgggaggccgaggtgggcagatcatttgaggtcaggaattcaagaccagcttggccaacatggtgaaaccccatctctactaaaaatagaaaatttagctgggcacagtggcatgcacctgtaatcccaggtactcgggaggctgaggcaggagaatcgcttgaaactgggaggcagaggttgcagtgagccgagatcacactgctgcactccagcctaggttacagagtgagactccatctcaaaaaaaaaaaaaaaaaaaaaataggtcaaatgtcttaagggagagattggttgtatgtctgctatgggttccctcagttgggattttgtttcctaagtaccacagtactgcacaagattgccattttgaccccagccacctcctccaatgtggctcttacagacttttgattgagagcctggtaggtgtctgttttcacagcactataaattgtgttctttggattccttttaaatagaggtggggtctcactatgttgcccaggctggtcttgagcaatcctcctgtgtcagtcttccaaagtgctgggattataggcatgaaccactgtacttgttcttcagattttttgagcctagctctgtaacctcttgccccaagcaggttcaagatctggcagaggccttgcgtggaaaatcagttgcatattggtttcaggcccccttctccatagaagtaccttatctattaaacatcatgatactatgagagatttcactcaacctctctgagctagccccttcctccttgtgtaccatcttagactttcacaaatgttccttggggaaaactggctttgcacttggtttcttctagcttctaatctgttgtacatgaccaccaaaaactctgatggtttcactttccttctgcttgagtcaagtccagtcttcagtccatgcccaaaagcattacacatccctgaaaagaaaatgatcagcaatcatcagttcagctaagataggctcttgctctctagaattttagttcatgttgtccttgttacttccatagctccccagtgtctttacaaatgatttcatgatttcttcttttttctttccagttttgcagcaagaatgcaggttgcagtagacataatgcattccttttgtgtgtgttacatactacattctactcagaagtggaaaccaaatgaaacagttaaagaccgcgttttctacctagagcatattgtttctcctctattcattgtgatttcccttctttgacttcttggtttatgactttgccacctaccagtctccagtctgaaatggaacgctgtgctagggcctttggctttggcaagtctgggtttttcactacctgggactggtctaagcctgatttgcattccagtgttgcattcatttttataggaccaggactaaaacctccagaggaacggacaatagaatacctagaagaagttgcaattacttttgccaaaggactagctgataagaagatctctccaaagagagacaagggattggtggaaagtgagtatcattgttaaagaacaaaggcaaagcttctttcctgagaatttaattttatttgctgtagattcaaaatgaggaagtggtaaatgcattatttactcaaagcataaagtcagccttaggtaggagatgtaacaactcctcaactttacactatccagttaaagccaatttttaaaaccttttttttccttatgatgacccttgagtcatagaaaacttttcattttagaaaatgttaagcatgaacacaaaaagactagataacagtgttataaacactcatgtacccaaggcccagctttaacattcatcacttagcatgtttaaggtagtgcttaggttgaaatttatattgtgtgtatcagaataaagagcagttcttgcagatagctagaattacttcatttttatagagtttagagcataaactaacaagggaatctaggctctttatagtaaatatctaaaagcattttattttacagaattgacagcgtatgccatgactattccatttgtcaggcaacaggtttacaaaaaagtggaagaaaaagtgcgaaagcagactaaaggcctttatcctgcacctctgaaaataattgatgtgagtcttacccaatattcccacttttctcatatttccttcctttatatagatcactcctccttattgccattctggaccatgtatgttgagtactaaatttcttaattctgctattaaagtatttaccaaaaataagggaagggcatagcaagctgtaaggactcatataaagtgatatatttggggaaaatcagtgctggacttactcattgattgatgcagttaaatgtatcagtaacaaaccagaaaaccaggaaaggaacctaagtcatatcagtatcacaaagccattagagtgtcaggcactaaccaaaaagtagttgaaacaaaattgatggctctgttctattcttggtcaacatcattgtcagtacctaaaatccctcaaggacttcttcattgctgtaattataaaaaagatgtaatgatgtagagaagctctgcaaaagatcaatgagaataattaaaatgatcacaggattcaagaaatctccaacagtagactttaaaacttagaacttttcagtgtggaaagtccaagattaagagagtatataaccaaagacttcagaattggtgaatgggtcagtcagcaagtatatcttgagtagaaggcaccaaagcacataaaatatgaaacatgcccccacctgccttcgtctcacaggctggactggggaagttagatatatatatgtgttaaggtggatagcctttaagagatataaggcagcataagattaatgccagatgagtgggacagaggaggcaacaattaccatgagacaaagagatcagtaagtgcctcatgggatctgaccccaaccctgaaagctgggtggaggataggtgaaggagggaaagtattgccaaggagggtgggcatttagagcaaagttatggaagctggaaaacaagctcttcaaggaacattagtgagaccagtatttgtgggggataatgagatgttagtctgaagaaaggcagattgaagctggattttagaaggttggtaataatgaattgagaaattttacctttgtccgataaagattctagagagccattttcatggtagtgggtaaaaatggtttcgaaggagagacaaagtagagcagtgaattagcaaaactgtcctgataatccaggcttgagctttgaataaggccctgagatagaatagtaaaaataggaaagcagcaacaggcttgccaaagagaggttatgagttaggttcagatatattgagttcagatattttgggaaattcaagcaacagtagtttagacagagaagtcagagttagagatgtcaatttgcttatttctaaaaatttgtcattctcataaattatgatagtgagtaagtacagggttatttttttcatcttttatatttgccattgtacttaggatagtacttaccccaaatgttacattgaattttgtagagttcattaatgtgataaactaggtcatgcatctgagggagaaagtgtagagagtgaaaagggctgaaagtggaagttgaggatctgcctacatttgaagatcaggagagaagccggaagagtaattcaagctttgtctttccttctcatggccatgttatgctagatttagcagtagcctcaaagatggagaattaagtcagtcgagagcagccagatcctcagtcctcttctctttctcattccagtctagacttttgacttactctttgaggactaacaacactggcaattttattcagcattattgtacatctcgccaatctattccaacgctgagcaagtgctttatatgttttttaggtggtaaagactggaattgagcaagggagtgatgccggttatctctgtgaatctcaggtaaacttatttcctttcaatgttttattatcagttaaaggaaaactaaagatccaatcctctgtataaagctgaaaaaggaaaaaaatatccaaagcctagtaaaaatttttttcttccagtgcttatcatctcttatgattaatctcagtgagcaagtggatgctaagaataccctaatggggccaggcgtggtggtttacccctgtaatcccaacattctgggaggccgaggtgggcagatcgtttgagctcaggagttcaagaccagcatgtgcaacatggcaaaaccccatctttacaaaaactacaaaagttagccaggcatggtggcatgcacccacagtcccagctacttgcagggctgaggcaggagaattgtttgagtccaggaggtcagggctgcagtgagctaagtaagatcgcaccactgcattccagcctgggtgacaaagtgagaccctgtctccaaaaaaaaagaaaaaaaagaaaaaaccctatggtctgcagatgtttgaacttacttttagtaataaggttgtctctacgaagggcaggaacagagttctaatcctttcaaaacaagtcacttgggtgttttttgttccgcacttgggcaggttttattgagacaaaatgaatacaaagacagaaaaatatttttcttacatgttaaggcctagagatgatgaaattgaattttttggtaaattggaaaaggaaaggaagtatcttgtacccactaaaagacgaagacagaagagatgtatgtaccagctttacctgtgtacttttctagcaacttggtgatgttgcagatttaagtgatttgtctttgtttttaagttttaaacgatcatcgaagaatggttgctcttttataaagttgaatatctcttatccaaaatgtttgggactagaaacatttcagatttcagactttgtcagatagtggaatatttgcatatatatgatgagagatcttgggaatgggatcagagtctaaacatgaaattaatttcatatacaccttatacacatagcctgatggtaatatcatacattatttttaataatttttcacataaaacagttttgactgcagctcataacatgtgtaatatcttgcccatgacatcatgttggcactcaaaaagttggattttggagcattttggattttggattttcagattagggatgctcaacctgtaaaaggacaaaaaaaaaaatctgaagagctcaggacaagtaccagaaaaacacttctggtactagatgtctcattgggcatttctgattttttaaaaatataaccaagtgcacataaacatacgtacagaaaaattgaggaataagtttcacgaatcagtaactgtcctgtgtgcattgtgctcagtattttctgtgtattcctctttttatatatgtaatgcttattggcacccactaaatttctgaccattgatgaatcttttgcccatgtttgaaaatcactggtttattagataaaacatcctgtatcaagattagtaaagcattgattgtgttgtcattttatgttcttttgggtcatgaaagcaactttattagagggattcttttgaaatgctctttgtaaccatgcaatcttaccagtatatcctagtgatattaataatagctaaccttgagaccctggtcattttactagtgttctcatttaatcccccagaacaatactgtaaaatgggtattgtttttcccatttttaaggatgaagaaagcttcacaatggggcagtggcagagacaggatctgtcaaatcctagatattatgcctttaaccaccaagttgagactttttctccataaattaagctacttttaaaagtggtaagtcccacgtgggcagcctgctacagtggaaaaagaaccggagttcgaggcgaggcacggtggctcacgcctgtaatcccagcactttggaaggccaaggcgggcagatcacgaggtcaggagatcgagaccatcctggctaacacggtgaaaccccatctctactacagatacaaaaaattagccaggcgtggtggtgggcacctgtagcgcagctactcaggaggctgaggcaggagaatggcgtgaacctgggaggcggagcttgcagtgagccgagatcgtgccactgcactccagcctgggtgacagtgcgagactccatctcaaaaaaaaagaactggagttcagagtcatactgtcttggttcaagttccatttctgccactttgaggcagtatagccttgagcaaagtcactccatttctttggacctcctcttcccaatctgtaaaatgagagggttggtttgagatgattgtggaggctcattttggccctgagactctagttttatgaaaaaggttaccacacctctggtgtaaagaatctgagagcttagttatatccaaaactttcttcaacacagtagttggaaagtgctccagataagacaagtaaagacaagacacatcagtgagagacagacttctgcagcactgaacccccaaactcccccgcatccccagggactcaggcttcacatgcattacctctgctcttcagaggaacctgaactgaaggaatccatataacctagactgtgaagttctaccttttctcattcccctttacttttcagaaatttggagagcttgtaatgaccaaagaatcaaaggccttgatgggactctaccatggtcaggtcctgtgcaagaagaataaatttggagctccacagaaggatgttaagtaagttaaactctacgtaggaagcccttgtgaattttactgtgtgcaaagttcacagaggctttgaagatctacagagctagatctgtatcttaattcagtcttgccctcaacttctttcctgagcacatttgagcccttatgtctactaaaaactttttggctttcaaagttctgcctgttctgagttttttccaaacccctctggtcattcctatagaggctttcttgtcacatattgatgttgcctagaagtctggtttaggtcccccttcccaaaccacacactccctctgcactgttcaatgatcatctctctccctgtgatttgagatgtcatctctgggaactcacacttcttcctcattaaaaaacataaaacctcattgtaattgttaaaatcttgtccttcttttagcttacaacctaagtattggaaagtctgtttgcctctttcatgtgtattgccataagccagcctttttccatattacgctgcctaatagctcttcagagtctatgtttaatgatgcaacttgtagctctgtggttctcagcgtggacaattttgcctcccagggggacatttgacaatgcctgggaacatttttggttgtcacaactagggagggagggatgctactggcatctgtgggtggaggccagggatgctgctaaccatcctataatgcacagatagtccccaccataaagaaatatccagttcgaaatgtcagtagtcctgaggttcagctgttctagctgaactgctgtgggggatttaagagaagcagctaatgatactgccttctccatcctctcacctttaatgagattacaaatacaaaatacaaaataaaatggataagaagtccgggtgaaacaggtaagattctaaccaagagggctgatttccaattagaatctgaaatacaaccttaactgcttctctcaaacatttagtgactgctatcaatcccatctgaagagccaattgcatttgttccacctaaccttgatagtaccttgcattcgatgagcagggtaaattacttccatgttgcaggaggaaaattatggccacttaaacctgtatctctttacacattctacaaaaatcaacagattaataaggaaaacaaagccacccattccctgtgcacggcataaatagaaggcagagaagcatcctgcaaaattacaaaacctagatacaccaacttctacccctccccaccgtatccctccatgtacacaaagaatgctgtcaattaaagaaactgcactttgcaacagaagagggtactcttaaattaaaaaacctagtgtcttaatttattaactccagactcctcctgcctgagcatttattgtcgtatggaggtagtatacatctccatgtaacaataaaataccccttggaaaaggtggtattgtgtagtcagtatgcaaaaaagaaagacagcacccacaaaaagctaatataagaaaaaaagagaaaatgagaatcagaatactgaagtttatgaaaattctgtcccccaaaaaacaaccacaatgcagaagaagactataacagaacttgatttaaatattcttaaatcagcatttgcaaatcagaaaaaaaactgccttgaatcaaaaattcaaaaactcagaactaaatgggcagaaaaacaggataaatataggagttgacctaacttgggaaagacattgaagaaaaagttagcatcatcttagaaatgaagaataagctataagatacccaaggcaaaatatgttaaactgaaaattgaataatgaacattgtagatagggtgtcccccttcctgctttcccagttatcagtaattcttccactattatttctctaggccccttcccccttgccttggatgataactggaattccttatctattgtctctttacaaattaatctttcatatgaataacgcattccatcagttctaataagtgaagagcagtacttatgaaaaaaaatactgagctacaaattagtatacagacaaggtaccatgttatgcattcctcaaatcacaacatttctgtgtaatcaaccctcaaaagttcatgtcacccagcagttggcttataaagcatcgtgcaccatagatgttagcctgctgggtaattacacaagtgggtcatttcaagggtgctgaagatgtttattagaaggattccgtagattgtgaagtgtgttaatttaactctacattgttgtagacaaatattaaacaactataaagccatcatgaaaattttggtgttaatgaagcggagcataacagttaagaaatgagtaatattttagctgtggattctgttataccaaaaaagctttaaacacagttttagattttactattattgttattaacagctaaagttaacattccagcaaatgccctcccaccaaaaaaaaaaaaaaaaacctactaaataatgcattctttttctcctttcaaaaaaattatcataaataagattataagatactcttttgtgtttatgggattttttttgttaggggaaaggggtgggtttgtttttttagagacagggtctcattctgtcaccccggctggagtgcgatggcataatcacagctcaccataaccttaaactcctgggctcaagcagtcttcccacctctgtctcctgagtagctgagactacaggcacataccaccacacccggctcattttcaaatattttgtagagatgagttcttgctaagttgcccaggctgatctcaaaattctggcctcaagcagtcctcctgcctcatcctcccaaagcactacgattataggcatgtgccaccatgcctggcctatacttatggtatgttttaacataaaaggaatccttctgtatggatcctgtagcttgcactttttactcagtgatatgacttggagatgtagattagtacatatcaggtaactccttccttttaatcccctgttgacgaattactggctgttacaatttttcattacaaacattattatatagctgttcatcacagcatgtcatcttgtgtataagtccatctctgtaaagtagataatgacgagtagaattactatgttatacagtatgcagttcttggttttaacaaaaccaaagaacccccccaaaagtaggacaaagtatacttccgtgaaccatgcatgaactaattttttgtacatcctaactgatactttaaaatttttggccaggtgtggtggcttacgcctgtaatcccagcactttgggattccgaggtgcgtggatcacctgaggtcaggagttcgagaccagcctggccaacatggtgaaaccccatctctactaaaaatacaaaaattagctgggtgtggtggtgggcacctgtaatcccagctcctcgggagtctgagacaggaggatcgtttgaacctgggaggcagaggttgcaatgagctgagatcgcaccattgtactccaccctgggcggcaagagtgaaactccatcttaaaaaaaaaaaaaaaaaaattgccagtctgatgcatctcattttaatttgcattgccccagttattagggaaattgaacatctttttattattattattattttcataatagagatgaggtctcactgtgttgcccaggctggtttcaaactcctgagctcaagcgatcctccctcctaggcctcccaaagtgttaggattacaggcatgagctaccgtgcctggctgaaattgagcatctttactgacaatttgttttgttcttttatgaattgctttatatcccttgcccattttatttcgttgtctttttaaattgatatatgcatgttctgtttttccagtagtatcctttgtctgctgtatatgtcacaaattcttcccattctatggttgtcttaattttgtgggttcatttgtcaaacagaatttttttttttaaaaaaaatggagtctcactctgtcacctaggctggaatgcagtggcacaatcagctcactgcaacctccgcctcccaggttgaagcaattttcctgcctcagcctcttgagtagctgggattacaggtgcacaccaccaaacccagctaatttttttatttttgtattttggtgaggttggtcttgaactcctgaccttgtgatctgcccgccttggcctctcaaagaaagagctgggattacaggcgtaagccactgtgcccagccaaaacagaaatttttaattttgatgtagcaaatgtatcagtcttttttttcagtccctattttttgtttctctactgtattttctcattgtcctgcaattacttatcactcaccatataaatatttgtaccattacaaagctgcatttagaagatgctcctaggacttgaagttagatttccttttcaggactttagtatgatttttgaacattacaatcagaatggttaagaatgaaactttatccctcatttcaactctaatttggataacagtgctgtaaacttgggcttcttttatgaagagattctttaaaaatttttcttagttatttactatgggaatatggcaaattattccagaactatagggaactaaaatgaataagcagatatgatctctggtcctcaaaaggcttagaatttaattgaggagacaaataatggacacgaagccattccaggatactctggggtaaatcaagtcgtcctgagaagttctagaggaattcaggggcaaaaaaaggtagcaatgtgcatatgtggaagtgtttaaggaagggataaggtctggaagcaaagagaccatggaggagactttgaattcatccagacgaggagtgataaaggcacagattttgggggaaatgaaagattacacgatggctcacacctgtaatcccatctctttgggaggctgatgtgggaggatcatttgaggccaggccaggagttcgagaccagcctgggcatcatagtgagaccctatctacaaaaaaacttaaaaattagccaggagtggtgatatgcacctttagtccgagctactcaggagactgaggcagaaggatcacttgtacccaggagttcaaggctgcagtaaacctaggattgcaccactgcactccagcctgggtaagggagcaaaaccatgtctctcaaaaaaagaaagaaagatgactggcagatagtcaaaatcactaacaaataagttgttcaataagaaaagaggttggtctttttgttcgaaaaacaaaaatactcatgttgacttaaatgtaaactggttgttttgatttcagtgatttcgaagcatgattgaagattagtataattctgtcttcttgggtagaccagttcttttagacctggtgggtttttgcacttaacttttaagatcaatcatttattaaagctgtgtttttaataaataaaaattatttgaaacaccttatagttgtgcctgcattagttggtttattgaataacttaggcaatcttccactttgactgaaatgattaagatcagtttaccgaaagtcatttcatccttgccttgcaggcatctggctattcttggtgcagggctgatgggagcaggcatcgcccaagtctccgtggataaggggctaaagactatacttaaagatgccaccctcactgcgctagaccgaggacagcaacaagtgttcaaagggtaagcctgctctctctctttgcaagagttagaatgtcctttgtttcttggttagttgttttttgtggtggcttggtgggtttttttgtttgtttgttcttgccatcacggattcctttttcctgaacataatgagttctagatactccgtagtgaagccaagtttcttttgatttttagaaatgccaattccttctttgacttcgttttgttatagatatcatagacaattaacatccttggagtctgtagtctttgaatgcagaagggaaaatcttatctagtagatacttgttaatgccattttacactttcgtatcaggcctgcggattttgatatagtttgcaggtaattgctctattgttaaggattattcaaacagcatgactgtctctgttgagaagactgagtgaggttaggatgtaaggaaatgggcagtaactgcagggggaaggcagggccgggatcaggactcttcagacttttatttcctgactggcattacagagagaagccatgaactgattcctccacagtgtctggggctttacagactatctccatcttacctctgaattaataaagggggaatattattccccttcctcaccacctgcctctctcaccatcacacacatgctgcctgttttgcagaggggaaggtggagcagcagcttggccaaatggagggttggtttgatcagttttctgctcacatttaatggacaagctggctgcacttaaagcatcctgcatgtgacttttagctgagtgagcttttttgtttcttaaatggattagatagcttaagcatgttgttatcccttttctgcagagaagctcacatattgctgccataatgctaaccaggacctggcaggtttcatcgtgttggcagattattgtaagataacaagttgtagtagaagattctgaccaaaaaaatgatgtgtgctagatagcagcagtgccctgaaactagcatgcaagcatcccaaacagcattccataccatcaccaaagtaagaaattgttgctctaaaatagtttcctcccccagtctctcttgaatagtgtcctgggttccccttttcgtcttagaaacatcaggttctggcgagtgccgctcaccacactgctgacttgggacaatagttcctgtcctctcttgggaatagtttaatcaggcattagaattagagcaactgataatgttttgaatgctgacaagtatcttgtttgctgactgctgtcatgattgtcaaaaacaaaagctttgagcccatacttttaagaccttatttgatgtttttgtttcttttgagacagtctcactctattaccgaggctagagcacaatggtgcaatcttggctcactgcaacctctgcctcccgggttcaagcgattctcatgcctcagcctcacgaatagctgagactacaggcatgcgccaccatgcacagctgatttttgtttttcttatagagacgggatttcaccatgttggttaggcttgtcttgaactcctggcctcaagtgatccgcctgctgcagcctcccaaagtgctgggattacagatgtgagccaccatgcccagcccttaagaccttctttgaatactcctttgtatttatcttgtggccttaattttgcttttggttaaggaaattagtgaatggggtttagcttcattcttcatttagaggaaaactgtaggtaatttattctgaaagtgtggtcagacggaatctaagagaacctgtttcccttggcgacgaaaaataatcagttgaatgtctgaataacaggaatccttttctgctccctatgggaaaaaagaaaccttgagttaatattttatgtaatcagtgcaatgtgctactaggtaatgagtgggaagtagatggagaatataggaaataatgcttggtctctgttctttagaagattacaaccacaggctgggcgcggtggctcacgcctataatcccaacactttgggaggctgaggcggatggaacacgaggtcaggagttcaagaccagcctggccaagatggtgaaaccccatctctactaaaaaaaaaaaaaaaaaattagccaggcgtggtggtgggcgcctgtaatcccagctactcaggaggctgaggcagagaattgcttgaacccaggagacaagaggttgcagtgagctgagatcgcgccactgcactccagcctgggcaacagagcgagactccgtctcaaaaaataaataaaaaaaaaaaaagattacaactacagaataacataaaattatatatttgcgataagcaaatataaaccatgtggtctcagacacacgttggctgcttcccctgtcataggtagagaattaccagaactcctcttttgttttgccattctagtgttcatgttatttactcctcttggcaaatttaactggtttaagagtgatttagtttacgtaaattgggcatttggaggcattctatggtagaaagaatgtgtacttgggagttaacatgtctttgaatgctagcaccctcccttatcaagctatttgaccacaggtccctctaagactaaacaacttgaaagtctccctcaaaatgggagtaatagaataactacctcacagagttggtgaaaaacacaggtgtgctctggcccatggacattcaataaacgttagtttccttttcttcccatctaactaggaatgtgttttttctagattgaatgacaaagtgaagaagaaagctctaacatcatttgaaagggattccatcttcagcaacttgactgggcagcttgattaccaaggttttgaaaaggccgacatggtgattgaagctgtgtttgaggaccttagtcttaagcacagagtgctaaaggaagtagaagcggtaagcaaggggctgttgtacttgaatcctagtgtagtgaacagaaaacacagagattttttttttaaaggagctataggaaactcatgattgcttttataaaaaggactattcaaaggctgggcatggtggctcacgcctataatcccagtagtttgggaggctgaggtgggcggatcacgaggtaaggagttcgagaccagactggccgatatgatgaaaccccatctctactagaaaatacaaaaattagccgggcatggtggcacacacctgtagtcccagctatttgggaggctgaagcaggagaatcactggaacctgggaggcagaggttgcagtgagccgagatcatgccactgcactccagtctgggtgacagagcgagactccatctccaaaaaaaaaaaaagactttttgttatcaaacgttaagtttttatgtgtgctcatgcacactgcatatgttataaaggtcaaatctaaattctaaaggaagaaaatgagggtgcgttcaccttattcatgtaggagctctgtcacccaaacatacagataacctcacagagtatagccagatgctttgagattttttggttagctgaaagccaaaaacaaacctcttcaggtctaaggctgcaaaggaaatagggaagacagttcgtccagatgcttgttctgtggaaatgctgctttggcccagctcccaaatgttctccataggcacttcttgagatgggctgacatgaacaaaacaagtacttgaagtggggagtaggaagagtaagccccgagaaggagtaatagcagtaattcagggatgaggtaggaccaaggcctaagctagtctacagttggataaacagaatgtgggttactgaaaggtgaacatgaaatgattctgacttggcaacatgctggatataatgagcagtgagctcattacaaaaaataagagtaccacagagcaaaactccgtctcaaaataaataaataaacaaacaaacaaacattatcttctcttattgcccatagagctaacaaaacccattccttggacaatcttccacaggcatgatctctagaccaccccgtttcggttgtcctctctagtatcttcctcatgtctccgtgttctactgctgtgtttacaactatcttttcacaattctgcaatctgggcagggctctgcagagacagtggtgcttaagtccattgatttcaaggctggggtcactcctgggctgcattccgcaggaagctcggttggggcacctcactgcttcccccacatctctcatagtccatcctcacttagtcgtctcaccacaacttctttgtagcgtggctgcaggcttccaagagaacaaaagcagaagctactgagcttcctaagtttattgtcaggaagaaaaaaagataaataatttaaaaaataaaaaaagaggctaccgggccccacaggtctaggtaggcctggaactggcagggtaacttctgctgcattgtgttgataaaaacaagtcacaagaccagcccagattcaaggagaagggaaacagactctacttctagctgggagaaaagacatacatgtccaaggaagggaagaatgtttgccagccagctttggagacattagtttgctcttcagaaaggatttcaccaccagcattagacactatattactaagaaagtaacctgacactacgtaagctttctgacagtcatgctgtactgtcaattcattccacttttgttttgtttttttgttgttagagacagggtctcactctgtcacccaggctggagtgcagtggcatgatcacagctcactgtaaccttgaactcctgggctcaagcgagcctctcacttcagcctcctgagtaactaggactatgggtatgtaccaccatgcctggctagttttttaaagttattttttgtagggccgggcactgtggctcacacctgtaatcccagcactttgggatgctgaggcgggtggatcacgaggtcaggagttcaagaccagcctggccaagatgatgaaaccctgtctttactaaaaactacaaaaaaattagccaggcatggtggcaggtgcctgtaatcccagctactcgggaggctgaggcaggagaattgcttgaacccaggcggcaaagcttgcggtgagctgagattgcaccactgcactctagcctgggcgaaaaagcaagactttgtctccaaaaaaaaaaaaaaagttatgttttgtagatatagggtctcactatgatgccgaggttggtcttgaactcctggcctcaagtaatcctccatccttggcctcctgaagtgttgggattatagttgtttagccaccatgcccaccctccactcttgattaactaaaatcatgggatctttatcacaaatactgccaagccaggtcttgtccttcaagtacctatacagttcttttctttccttttttttttaaatcttaaggcagtactttacttttattgcattataatcttattttgtactcagcttttcagtgtgttgaatgtgtcttcctccttgattctcatctctgttaggattctgcctgttccagatttgcacacatttgacaggtgtcccttccacgtttctcatccaaccatctgaataaaaacatgaataactgggaggcggaggttgcagcgagcctagattgcaccactacactccagcctgggcaacagagcgagactctgtctttaaaaaaaaaaaacaaaaaaaaaacatgaataagttgggatcgtggccagaatgcggagacaatctgcattagagactattctccaggtggataaagctaatagttaatagtatttgtgtactgtagctgcaactatagtggtatgccgttttttagtaacacactgtataaaatgagacaagcatgcacattttggcttgttcttataaaggtgaagcggggagtgattcagggcagatccaaacaaaagaggaggtgacacccatgctgggtgttgaaatcaatgaattgcaattcaaggccgtcttttcagtgttgttctaagctgttttattgacccaactgctgagatgtagtctccaggtcaggataaggtgaccttatgatgggccataactagaggaaggcagaatgggaaaaggaacaaggtcaacatattccccgacacaaaaccccctaggtgatccgtcaatgtctgggtgagtgacatctactgtctgagcagttgtgggggacagagtgggctgggcccaggtgtcactcattagctttgatgtggcctctaatcatctcccaggcctacctgacacattgttaaatgcttttcccctgcaggtgattccagatcactgtatctttgccagtaacacatctgctctcccaatcagtgaaatcgctgctgtcagcaaaagacctgagaaggtaaactcggaacagagaaaaaccctgagatgttttattgcttcagattcactgataaaggcttacagcttgagtacagaagagacagtggattacggagtggatgcgggtggttcctaaacactggacacaataaatgctaataccatgactagtgtgagatgcaggagtaagttaagtacaacaaaaaatatccttttcaaggatcccaaatgggcattatttttcaggttcaggatataaagcccacctgtatcctagaattaggcattgaaggataggccttaagaaaggatgctccaaaataccagtttggctacagagcagagtcagtgactgtttagaacaggtttggttccacctccagatcagggaatggcaggaatggtgggatgtgtctgcccgtgggtttgcttacaccttctaccccgggacatgaaagggctgggtatagaagcactttctgtgagtatttggaatgatgcccagaaatttatttttgctctcaaccagagtaattaaggggaagtgaaatcattcaaagagaagtaaaacaactcacttctctggaggataccagttagcctctgctaaccagaaccagccgaaggtaggcaggaattataaaagaactttaagcagctgaaagtgttaatacaaattctatgtactgaaaacacaaaagcctatttattcctactcttctagcttgctaatgcaaggtaatctagtttcctagcacacagcagattagaagtgatgcggggacctgacagaggcaggctcaatgatggcaggctaaaggtcatagggagaagttgcagccgatagtctacagatggacagtctggccatgtcatatcactcaagacatctgtgtggcatctaaaatcagtacaggcgatgccgttgctgttcatttgatggtaacctctccccgccatcggagcagagcaagcatcacactttgcagttctgccctccaagtatctaggacagcttttctcacctgcttgccttttgtcattcatttaaaagtaaggccaaaaagacaaaatagggtgaccaaccatcttggtttgcccgggagcaagggatacaggaccctcagtgccacaaattgggaaatccccagccatccaggatgagttggtcatctttggcacaactttctgagtgatgtaaatatattttgcttgggttagtgattatatggatgtatatacagttgtcaaaactcattgatgtgaacacttcaagatctgtgcattttattatatagaaattctacatcaataaaggctaattccttttgctcaggagtactgagtctgaatcaggtcctaagtatttcagatgtaagtaaaagaacactttaggggttagaaacaacttttggattgataagtttacataacatttacttgatctgtgtattacataatggcattggagatagacagacctgtgatggaatcccaccccgtcatatgctgactgactctgtactactaacctcttgataccttttttcctcatctagataattaggctgaccagttcatagggttgtaatggattaaatgtaaggaataagtggtaaatgtattgaagagcaggtagataatgagcagccaaaaattacagatatcacttgttgtaccttatagctaaagtgagagggagaaagcaaaactataaattaatgaattagacttctttcaccacagttctgttgggaagactatgtaactgttagctcaatgagggggttctctgaaaccttagcacgcatcagaatcaccaggagggattattaaaacaaatctgggccccacccatggagtttctgattcagtagggctgggctaggcctgagaatgtgcaggcctaacgctcccaggtgatgacagtgcttgttgggtccgggtactacacttggagaactgctggtttaatgagtcttaagtgcatctgactgttgaggagtgttagttaaacctagtatcctggtggtgagacccatctgtgtaaaatgcaaatacttctctgacagcccaacacattaattcttctgcctgccccacccccgcccaaaaaaactggatcctcttatctaaaccatcagtatcattaatataagtggaaccttcatccgtcgttccccaataaatctagtttggcctcgagctgtggttttggcactgattgttgggaggatcagatgtctgtagtgaaaaaccttagaagcaaatggaagaggaggattccaatgtgctctccctaaacatactaaacttttatcaaagacccatggaaccaaaccactcagctatgtcaagcagtattcctatatcacagccacctttctttctagtgttttcctagcagagaaggaatgctctcaggttcctcacccgcattctccgatctgttggcttttggttccccttgccaggtgattggcatgcactacttctctcccgtggacaagatgcagctgctggagattatcacgaccgagaaaacttccaaagacaccagtgcttcagctgtagcagttggtctcaagcaggggaaggtcatcattgtggttaaggtaaggggctgtataacagagctgcagagtttttgaaaagttctaataagactccttttacctccaggcttgtttataaatattctggggcaaatgaccagactttgatatgattttcccctgggttgtctccaggatggacggtggtattgactgtcccactgagtcaaggtgggagtggggagtatctaggatgtggcagggttctcccagccatcccagaccttgaaggtgaccatgaaactatctgctgtactgtttgattcaagccaggctacccctagtacggcttcccctgcaatttcatttttaaggattctgattgagattttaagtcaccttaagttttacagtgactttcaaatgactttgaagtgaccctgggaaaggtagagtgtttcagactcagtcccagcagcagggccagtgagctcatgttctcttccttggcaggatggacctggcttctatactaccaggtgtcttgcgcccatgatgtctgaagtcatccgaatcctccaggttggtattgctctccagagtgtttgcggcatcttccactccttcagtcactctaaaactcatgatgtcaagataaggaccaagcttccttctgatacaccaactcctgctcttgtctaggaaggtccctggtgccctctctctgcacagcagtcggaagttgggcttatactgcactgaaaggggcagagctttccctctgccccacagcctcctcactgttccagcaagctaaaggcaccccaccccccagcatgtcttctatgctgtttctgcacctctctgaggcagggaccatccagaacagggcccgcttggttcaactggtgctgcatctgtttccacagcacacagacctctccagtagccatcgaggtcattctggcaggaaaggagagggatcctcctcgctgggcacttacccagacttggggatcacagggctctgagtgctcctctttgatgatgtttcttctgttggtcatgacacactcagccgtctgtcatgcaatctccttattattgagattcagaaatgcaaacaagaagaaaatgaagaatttagtcatctctaaacgtccttaaagtgctgtagattagagaaggctcagactttccacttgtggccccaaacttctttgtgcttccctgaatgaaatagcaccagtcctgggcctggtcaggtgacactcagaagtgggttttacacaaggcagtgtttggagccagtacagggagccctttggggggatttgggctgcccttcccctgaggtccctgcatcgcttcctgttcaggaaggagttgacccgaagaagctggattccctgaccacaagctttggctttcctgtgggtgccgccacactggtggatgaagttggtgtggatgtagcgaaacatgtggcggaagatctgggcaaagtctttggggagcggtttggaggtggaaacccagaactgctgacacagatggtgtccaagggcttcctaggtgagtagcctcaaggaaacataactagcaccattagttacaaagttctaagcagttcctgagaccaaagagttacagaagccctcgtggaagaaagttttctaaacacagagcccttatcactggcgatttcaaaaatgattttatgagtcaggtgcggtagcaaccacttatggtcttagctgcttaggaggctgaggtgggaggatcgcttgagcccagaagtgtgaggccagcctgggcaacatggcgaggccccttctcaaaaaaaaaaaaaaaaaaaaagatgtcatgtgaaccttctaagggctaggactatagattatggacaaaaggcagagttctacccttctggggctctagcatcacctggtccaagttatgccagatggacaagcatttttatccccccgagatgaaatctgcaatagtgcagaagcaagctctgcatccgggctttaccatgctgtctggccacctgtgaggagaatgtataagctcaccatacacagtatacagttgaggcccacagagaagtgactttctgtcttggcaaaacagcaaaatcagcattacaacctgggtgttctaggacccggtgctgcatatggggatgttaaaactcacccaggtggcctttctcatccatgtacacagatgcccaagctccgggtcacaagatcttctttccttctctgcccactcttctgacaaagactaatttgctagggttagctagacatacaaattcaggaattcagaagaggccagagctttataatagaccaacagagacaagaattctcaggtcagggtcttttttgtttgttttttgtttttttttgagacagagtctcacactgttgcccaggctggagtgcagtggcataatctcgtctccacctcccgggttcaagcgatcctcctgcttcgcccagctaatttttgtatttttagtagagatggggtttcaccatgttggccaggctggtctcaaactcctgacctcaaatgatcctccgcctcggcctcccaaagtgctgggattacaggcgtgagccaccacgcctggccaggccagggttctgagaacaaatagtaacactccctccctgagaacaaatagtaacactcccttttcttgcctgttttaggtcgtaaatctgggaagggcttttacatctatcaggagggtgtgaagaggaaggatttgaattctgacatggatagtattttagcgagtctgaagctgcctcctaagtctgaagtgtaagtccgtttgagtggctaatgcctggaaattgactttctctgacagcccaaagcttcccagcccctcttccattttttttttttttaatactttaagtcctgggatacatgtgcaggtttgttacataggtatacacgtgccatggtgctgtcttccattttctttgtgaccaccatacctgaacaggaggaccactcctgatgctggcatggtgctttccaagtggaaggccctcgcacgtgctccttggtctctgcccagcatctaggtgagaaccaggccacgtctggtgaaggccctcccctgctccagccttctctggcaagttcccagagagccgctggaaggacagattctccttggccccttcaccctcccagatctttattatcatttgtgagcagctgactgttgctgatgtcaaagagatactgattatcttctcggcaccaggccctgttctaggtgctcagtttcatgttaattagggcaagttactctccactttttccatgggaaagtttggttcacccaggcagcatcttctctgagggccagcaccaaccggcccacagagctccccatgcacccatcccgacttccattctgcatctgcggctctggctttcctccccttttcctcttcttctacctaaacatctctttctgttggcagctcatcagacgaagacatccagttccgcctggtgacaagatttgtgaatgaggcagtcatgtgcctgcaagaggggatcttggccacacctgcagagggagacatcggagccgtctttgggcttggcttcccgccttgtctgggaggttggtctcgcaggttgggaaggaagctcactttagcctggagcccgtgttgcgtctccttcaacgaagtcctctttctctattcagggcctttccgctttgtggatctgtatggcgcccagaagatagtggaccggctcaagaaatatgaagctgcctatggaaaacagttcaccccatgccagctgctagctgaccatgctaacagccctaacaagaagttctaccagtgagcaggcctcatgcctcgctcagtcagtgcactaaccccagctgccggcagtgctggttctccaacagagtggtgtctagatttatcagagtaacgagaagacaaactccggcactgggtttgctccctgattaaagtgccttcagccaagaccatctctccctcctggtgaagtgtgacttcgaattagtttgcacttcctattggaaggtagagcccactgctcattgtataagccccgaggcctagagtggcagccaagagccatctgaagccacctctctgcctgttcctcccaagaggccagggtggccaggggtggtgagggcagttctgcacccagccaaacacataacaataaaaaccaaactctgtgtcagcatctttgcccttctggtttaaacgcctccttcaaaaagcaatctggaagaaagccctgtgctttgggggagtaagaatgtgtgtgcagaattctaggcagcaccttagggagggactgggatgagagaaagtgggacctggtgggctcaaccacacacacctgtctgtgcagatgctttgcccaggcttctcaccacggtgtaccgggatattaaacctctttccccagcctggatttcctcattgtgtgatcttacccatttcttttctgggtgtgcctcattcataggtgcttcttgggatggttgtgggaacgttggtgctaagcagaggcgctgacatctcccttgatgttcggagatcctgcatagcagggctgccccagaaatgcctgtgcggtaatcaggcagcacgggagcagcatgaggagtgctgacccccacagcacctgcactcccccaaagcttcagcccctccccaccccaccccctgggatggaaagttcctacagaagcagtgcccagtctgggtaaacagcactggggctaactgggtctggcagaaggatccacgctgagtgtgtgcggaatcgtaattccagtcccatcacattctgcattctaaattgtcagatattaccagttactcctgcctctgctccagttgtacttcaaatatgtccctggtcccagctctgtagctgggactggcaggcaaggagatcaggtctggctctgcttggtcactaggaagccagactctaaaaccaagtcacctctgagttgaggttttcagatgaccagagtagggagctgatcccttgcaccaaagccattaaccggtttccaaatttggtctgagagagcctgaagccggcattctgccaatgcaggaagctaagcttgggccctggctggtggcattcagctttgagcctgggtctttcccttcagtaacaccaggtaggtgtgaattatgttgaaactagtggaagctggggtgggggttcttgaagggtagggaggggctggcgagggccctgcagaagggaatgaaggctgccaccagccgcctccacagacatgggaatggccacacacccacatcattcctccatcagtcctctcctgccagaaggcatatacactgtgcccatgggtccccatggccttgttttcaaaagaagaaagcagctggcacccagaatgccacttgtactcatcttcagcagtctagcatttatttcattagtccttgaggattcattaaatgatctgcaagaaaaccaaatgtccccacatcacaggttctgtgctctactctctgaccacttctctgagctgaggcagcctgcttggagtatgggcaccagcatggcttagctacttttaagataaaaagtggaggaaataaataggtagactaggtaaggcagaagagaaggctggcactttgggccctgacactagtgggcaccctgtggttctgggtgagatggaggacacggatggggtggggtgtgtggttggacacaatgaccagagctctgggtaccaagcagatccccatgtttgagattcaagggcacaaaggcctgctgtgaggcacgtgaacaaatgcaggactgagctccaggaacgcactctcccaactgtaccctcctgtgccagtgacagaaaaccagggaaaaacaccaagtattgtcagagacaaatgatgggggcaagagattggcggaattggaggtggttgactaccgcttgcttctagaatcaaggagaagctgacctaaatcaacctgctcttccacggaatcagtattctgagactgaacgccacctgacggatggatgactagctgcagtaaagtcagagcagaagccagggtgctagagtcatctgggcagtgtctggcttcctaactagataagtgggtcgggtcaattgcagagctgtgctcttccaaagttgtcacccatgaaccaggaccca

SEQ ID NO: 13632 - DNA, 300402 bp, Human
  misc_feature (1)...(300402): n = A,T,C or G
cttaaacatgaatagatgatgaaggaaagagacaagtaaagagaagttggtaattttggagtgagagggggagaatgattgaaaggtgtttgaaaagttttctgaggatgtgggaggtgaagaaatagagaacagagatggagagatgccaatacagtgtccttgaagtatttaattcccttatggtttaggattgtctagtccacatattgaaattaccttggtttcaatcaataaaccgaacatatcaagcgatatttacacatttattttatattatttacacatcttttctccaaagaacagaatcaatgttttacccctctcaatgccttccacatagggggtgctcaaaaagggcaaataaagaagctagaggtctcttacctgtattctgagtatcttaatatgtacaaaacatagccaagaccgtgcctacaagagataagtctcctcaagcatgaaaatattcacacacttcatatatgtaaggtaaaaggtaaaatgtccatctttatttatttattttgagacggagtctcactctcttgcccagacttggagtacagtggtgcgatctcgactcactgcaacctctgcctcctaggttcaggcgattctcctgcctcagcctcccaagtagctgggattacggcgtacaccaccacgcccggctaatttttgtatttttagtagagacagagtttcgccatgttggccaggctggtctcgaacccctgacctcaagtgatccgtctgcctcagcctcccaaagtgctgggattacaggcgtgagcctccgcggcaggccagaaaatgctcatcttttgaggaacctatttgttcccatttaacaaagttggttatcagcatttccttcaccataggagtttaaaaataaaaagaggagaggaggaggaagagggtgttctaaaggcaggcaggcaggcaggcaggcagcagcaggaggtggcacgatctgccttaccgtaaggtgccaaaaagcagtgaaaaccatactcccagcatgcaggcctggggtcgcttagctctggagcttacagccttcatcattgaccaatagcccccaaaggacgttgctgttttgagtcttaagtaacgttgagaatgaccatttgaaccattcaaaaagtccttgctatattctaatttggcaccatctcctgtatttcacagtttggaaagaattctataaaagatggataacagtaaaacacaaaaaagctggtgctgagatggtaaacctggctgccccggctcctttgcccaaactgttttcccagccctaatgtcctccctttttcctcctaggacttctttttcttccttcgaggttgaccataaatgccgcctctagccctctgcggcgtccaagcagaagtcgtctctagcttctgtgccagcatcgcaccgtggcttggctctgcacgggtcatcggacttggttgtgtacatggctgttttccccgctaagtttggggcgcctcgagcccaggcgccgtgaccgtgatcgtgcgcccacaggcacctggtgcagcgcggggcgcacgccgcggctgggctagcttgcggagttcacgggggtcactcgggcacaggcttgtgacccaggcgcggagaatgattcacggggtggctctttgcattctttgtcgggtagtcacgtcgggccgggcaccccgccgacggatacctgcggatggaaagacacccggcccgacgccagcgagcgggagaagcctggatggagccagcttcccgcctgcccggaacccgccggcgaccggtgggcggggcgcggccgcgggggcggggtggaggggggttgctcggccgctcccgccccctccccgcgcgcggaagccacgcccccggccgcgcgctcgcgctgggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggtgggggtctgcggccgccgccggggctgtggggagacgagctgggctggagcctcgcgcccgcgaggtgcgggacggcagctcgcgctgcgccgggactggggacccgggagcctgcgggtgcggcgctgcaggagtcggggagggcgcggggagccggggccgctgcaccgcgcgcggctgcgaggtgggacggcgcggctagccccggagggacaggcagaggggatgcggcggatcccgggccgggaggggtatcggggtccggaacgcgccggggcacgggcgcgagcgggggcccggcgccgggctgatgctgcccgagcccggctcgcctggaggcggctctgcgttaggtgctgaaggggcgagtgaggcaggtcctggcagagggcaggtgaggcgggcaggccctggcagagggaagggtatttatttcagatcaccccaaatcactgtttcccgaggcgcctaatagcgaacctgtccaggaggtcaccctggacaggaaagaagtgtcccgagacgaggatgccggtgacgaatacttgcccttaaattcctgtgccaggccttgggattcggaagaccttccagctaccgtaggtagagacccgtagtcagcactggggccacgaaatagtatggaacaccgtcatgttattgaggtgctgacagtgtggctgtgaagatatgcacatgaaatacaaaggagcgtcgaattttatgtcgcatgccctatttactttcggtctcttttgtcttttcccagtattgggaaattggagccataaattgcgtggttttggggataaagcagaaaggtcaaaagaagcctatgggagaaatttgggagagttttgaaggctcctacgggtaacatttaaagggggctcttagatggggaaaaaagacgtttggaaagaaaggaagtttccttccttcccatctagaaataagctccatgactattgactgctaaatcttcagaatgttgcctggctcacagcggttgagccataagtgtctattgcatgaatgaatggacaagcaaggtttggccacatttgccatggagcagtgtcagtcactctagtgttagggaaggttgctggatttctcctgttccacaagttctctctctctgcctctttttttttttttttttttttttttttttgctatgcgaggcaaccccggttctgaggtctgggcacgttaaagcaatggctaaggcggcgaggtcttggtttctgtggccatgctaccactttcccatgtgtctttcatgttggccttcaagagcttgctccttggcctgttgcttgagatcatcccattttgttccttctcccattggctttttctattacttgagaaggaagagggtagtgttgtctagagaacactttttcattttggtcctggttcttgggtcttagacctgtagtgcgaggctgttggtgcctctgcttttctgtaagggctggaattctacctgtgctctgccttggttgaatctctgaactctggagctccaggctgctgtttcagtaacctgggttgcagtgcctgttgggttactttgtctgccaaattaaaacttgaccttttatgagttctctaaggatttttatcatgcataagtggaattgcctttgaaaggggttgtgcagtcaaggtagtgctggcagagtttttggatgtccactatgcccgagagacaaatttctacctatggttagaaaattagactcagaaccaagagaatttcaacttattgtttattttatgtctttatgttactctctcagggccttagtttcttcgtgtgaaaaataagtaataatcaaaatctggcattgtataggaagccttgaagaagtaaatttatttctcctgtttcagggctgtacagccagcaggtctcttgttgagaggtgcctaggttctacaatattgggtgccttattccaggctctctcaatgatattttgtttatgtatttattttaaaaccaactttttgacgtatagttgacaaaataaaatgcacagatttcccgtgtgcggttggatgagttttggaaaaatgtgtacagtagtccccccattagcctcagggatatgttccaagagcaccagtggatgcctgaagccacagttaattccaaaccctatatagactgttttttccctatacttaagtatctatgataaagttttaacttataaattagttgccatgagagattaatgacttctcttaggcatatgtttggcttctctgtggcatatcccaattgccagcatcactactcttgcactttattattaagtaaaacagtggtcacttgaacacaagcactgtgataccatgacagtcaatctgatcattgagacagctactaagtgagtaaccagaaggtggcttatgcagtgtggatatgctggagaaagggatagttcatatcccaggtgggacagagtgggatggcacaaaatttcgtcacactattcagaatggtacacaacttaaaacttacaaattgtttatttctgaggggagactgctgtatactttgtaaccaccattccaatcaagaaatttccatcaccccagaatgttcccttatgctggtttgcagtccattctctatcttccctactcccttttattgatttcgaattacacgagcatcagagctgtggcacctagttgtgtagattgtattctgcccagctttagggagcaccattcacattggagtccttgtgcctggcagctgctggagttgtgtagtgcacactctgtgtgactgtgtgctgcaactctgcaggtggctcagaacacacactcacttgtcagatactcaaacagtacagacagaataaaggcccccttgacctactcacggaaacaagttatcagtttttgtggtctttccagactattctctatgtattttcatgtatatatagggaacacaaactcatctgatactcaaaacagtatagacagaataaaggcccccttgacctactcacagaaacagaagttatcagtttttgtggtctttccaggctattctctatgtattttcatgtatatataggtaatacagaataaaaaaagagcagagttttttctcctctgcattaatgacatcataccatacacattgttctgcagttttttcccctaacagaatgattttgagattttttcatgttggaacacaggaatcaacctgagtcttcttaactactacacaatctcttatgtagtatgtatcgtagtttatttagtattctcattaaggaccgttgctgcagtgaatgaaaaactacagttgctgggtcagaggtatgcgttttacttcataactgatggggctataaccatgttgctgcttgtggatttaatccatttattttcaactgcttagtgtattcagttgtaggcttttttttttttttgagatagggtcttcctctgtcgcccagactggagtgcagtggcactccagggctcaagtgattctcccaagtagctgggactacacttgcgtgccaccatttaaaattttttgtagagatgcagtctcgccatgttgctcaggctggcaagtgatcctcccaaagcgttgggattacaggcatgagcccctgcacctggcccggttgtggacttacatcacagcgcacgtgtccttttactcactgaggaacagttgggttcctttagatgctgattcttcagtgggtctgtgtgttgcaaatgcatcctgccagccctaggcttttctttccctttgttaacaatgtatttggttgtatataccatttaagtttaatgtcatatttatgaaaaatttcccttaaatggcttgtctttttttgggtgtgtatctggtttaagaaaattttctgtctctcatggtgttaatgatatattcttagagtttcttccaaaagtttaaaaaagttttgctttccagatggaatttatttctatgtatggtataatgaaaagatacaatttttttttcaatttggatgaccagtttttcagcactctaactttttttattatagtaaaatacacataacataaaaataacaattttaaccattgtaagtgtacagttctgtagcatgaaatacattcacattgttgcacagccatcaccactgtctccagagctttttcatcatccccaactgaaactctgtaccccttaaacaccagctccccattcttccctcagcgcctggcaaccaccattctactttctgtctctatgaattcgactactctaggtacctcatatgaatggaatcattacaatatttgcccttttgtatctggctgatttcacttagtataatgtccttaaagttcattcatattgtagcatgtgtgaaaatttcctttttaaggctgaataatattccatggtatgaatataccacattttgtttattcattcattgatggacatttgggttgtttccccgttttggccattacaaggagtgctgctatgaacattggtatctgtatgtctgtttaagtctctgtttccatttcttttgtgtatgtactcaagtgcaattgtcagtaatacagtttttaaaacaatatacataatggaataaaaatagattaacacaattttgaccaatgtggctgaatagtatggagtttccatatacccactctttcccatatggtttctcctattattaacatcttgcattagtatgctacatttattataattgataaactaatattgatacattgttgttaaagttcatgatttagagttcactctttgtattgtatagttctatgggttttgacaagtgcgtaatgtcatgtatcatttacatggcatgactgcatgctacaaccctgcaaggggctcacttgtaaaatactcaacagtacagacagaataaatgtcattacatggctatagttttaccttttccagagttggaaatgtcatagatttggaatcatgtagtatggagcctactcagattggcttcttttgcttagcagtatgcatttaagtttcctctaagtcttttttgcgacttgatagctcatttcttttttttatttttattttttgagactgagtctcactctgtggcccaggctggagtgcagtggcgcgatctcggctcactgcgagctctgcctcccggattcacaccattctcctgcctcagcctcccgagtagctgggactacaggcgtccgccaccatgcctggctaattttttgtatttttagtagagacggggtttcaccatgttaaccaggatggtctcgatctcctgacctcatgatccgcctgccttggcctcccaaagtgctgggattacatgcgtgagccaccgcgtccggccagctcatttctttttagcgccgaatgataatattcctttttatggaagcaccacagtttgtttattcgttcacctactgaaggacatcttggttgcttctagtttttggcaatttttgaataaaactgctataaacatccgtgtgcaggtttttgtgtagacattaaatttgtaactcacttgggaaaatacctaggagagtgattgctgggtcgaatggtaagaatatatcaagctttgtaggaaactattaaactatctttcaaagtgactgtatcatttgcattcccaataatttttaaaatttatgtccaagtaccctaaatgtacttatataataagtatgtcagactgttctgtaaagttaaacttcacctggaataatatttagtcattggttttgttggctgtctttcttgcagtgtatctcttcatgtgttttgaagtacagacttttttttttgagatggagtctggctctgtcgcctagggtggaatacagtggcatgatctcagctcactgcagcctctgcctctacctcccaggttcaagcgattctcctgcctcagcctcccgagtagctgggattataggcacccgccaccacgcctggctaatttttgtatttttagtagagacagggtttcaccatgttggccaggctggtctcaaactcctgacctcaagtgattcgcctgccacagcctcccaaagtgttgggattaaagacgtgagccaccacacccagccaaattacagacccattttcagagtgagtgcttttgattttgttttcttttcttttttttttttttaattttgttttcttctgtgcccactgtcctctgtgtggtgatatttcaggtgcttcagctgacctactgggcctcagtctagaatcagatatgataattgtgggtcaagggtcctgccctttgagttaattgggctattttcgatcctctcatagagtatggtcctgaggctgtttatatcttcccacttatctaagcctagagtattagataaactgtagttctaggcagagattggcagcagtattttttagcttcctttcagctccagcatcattgctggccttgagcagtgggtctggcccagatatctccgtttcttcatcctcctttgctttctgtcattactacctgcaggaagtgcacacctggtctagactccggatccagcaagcctagagcttcagtcctgcttgcaactttgtgtatctattctgtttctccaaatagaggtttatcttgtttttgagcctaattaaaaaaaattgttaaaaaatattttatccattattgtgtatttagagcagagaggatgcatcaaagaatgtacttactggccactttctagaagatttaattagccaagctcctttctcaactttatacaaagacttttttctttgttatggcattgcctaggccttccagtacaagaataagtataataatgggcattttaatctttttcctgagtggtaatgtttccagtgtttcactgttagatatgatgtttactgttggtttttggaagatgtcttttgtcaatttaaggaagttttcttctgttcttggtaaatatttttaattgggtgttgaattttatggaggcctttttttggggcatttcttgaaattattttttcccttctttaacatgtcaagaataggacagatctctctgagttgtaggtaactgagagaaacagatgtatatgatttacttgttaattcacttttaacaaaaaacctcacaacctttaaagaaaacacattttaaacttgaatttttgtatactaacattatatataagttaaaatagggctgaaatgctgtagtaatcaggtttggactaaatatcatcgtaacttcactatatttgaatagtacctaataatatcaataatagtagctaacatttattgggctcttactggatgccattgtgctaaatgctttacatgatattgatttaagagttaccacagccccgtgaggttatttagctactcagaactctttgttgtagtggagtgcagttactgaatttttttattggaacctagagaactctctcagatttgtaaaaagcaaatctttaaggttttatgaacatttattttccctggccttttttttttttttttaaatctgaaagagaagagaaaagaagtattaaaggaagaatatttgagaatttttctgaaataagcaaggaagttctctttcaataaagtttggcttgttgtaactaagtgttaatgagagtcttagtcatcactaactttttttttttttgagacggagtcttgctctgtcatccaggctggagtgcagtggcacgatctcagctcattgtaacctctacctcctgggttcaagggattctcttgcctcagcctcccaagtagctgggactataggcgcatgtcaccatatctggctatttttttctatttttattagagactgggtttcattgtgttagccaggatggtctccatctcctgacctcgtgatccacccgcctcagcctcccaaggtgctgggattacaggcatgagccaccgcgcctggcccctcactgacttcttaattaaatggacatccaaagaaaaactgacagggagatggtgggaggtggtgaacttacataagaaatttcaatacttggatgctttgacgtagctgagagctggcagggttaagaaattaacaaaaagatggaaaggaaataaaggctatttaacacaaaggcatgtacagagacatcctggagacacttccaaagccttctctccttttcctttagtctttactgtgggagttacgtaacttctgcgtgtagacgtagtccaggtgtgaaacactctattttctatgaatagaacagagtgtaagaactaacaaggatccaaactttttgctgcactctcttcagatcctacttagctccatgatttaaggtctgatccagcaccacagttttgggacctgtgttctttccttattccttgaggcctcatgttgccctggagggggcgatgtgacacaatagaaagaaaatgggctctagcgctttagcatcgtcatggtcaactccgcagattcctagctttgcaacttcaggccaagttacctgaccacttagactttagtttcctctctacttctaacacccctaatcctgaaaatctcctcaagctcagcacggtcttgtcttctcacctacttctaaaaagagcaatagtctccaaagtgggaggtatgtaaaatgatcctctaggcagggtgttacaagaaaatatgagcaatcaagttttaccagtatttgacccataggttgacactttacttcatctgtgtgtctgatgatgtctgtcacgtacggtaagctagggaaccccaccgcctggaggggctgatactgtgatcctccttatttacctgcttatattgttttagcacatgttttagttcacctctgctgggtttagtggtctttcagatcatattacctgatttgaataaaatgaactttgctaaatagacagatggctcacaaagattcctgcaaagaaaatgcagattgaagtttcagagtcagcagaagattgaagtaataatacaaatacacgtgaacagccagaaagaaacagagtggatacttctatttatattatgaacttgtcagtcaaatgcataatataaaaacaatggtgatctcatcagattgatgaagaagcagtaataaaaaatagcttagaattactaaaaatactatttaaaatatggacttatatacactgttgagtacattgtacctgaaggtatttactaatgatattatgggctaatcttataaattgagatatttaaaaactaaatattcagaatataaagacagacttattgatgtttttcagtgattgtcagtcataatccagtaccttaaaattttattaaggttaataatacatttttagaagttccttttgaggtttaggaataaaagacaaaaagtcataaactcttgttcttcttgtttggtaacagtggctgaaatgatatatagataaataatttgagtttggtgtaaaactgaaaagtatcctgtattagcaactgttgttgagatactggtagaacacgttgctgaaggttttgaaatgatggctattgtaccaaattttagagttcatgggagttcatgtatatttggataaaagtacagagcttatggtatttggtatactctgtttcaataataaaatatatggaaatatatggagaactgtgctccccacccccgctaaaacactcaggataagacttaccagagaatttactaaaagtagatgatctaaaatgttataaagaaatagtacatataaagcataaagaataatatattgttcaaccattgtggaagatggtgtggggattcctcgaggatctagaaccagaaataacgtttgacccagcaatcccattactgggtatatacccaaagggttataaatcattctcctataaagacacatgcacattgtgtttattgcagcactatttacaatagcgaagacttggaaccaacccaaatgcccattaataatagaacggataaagaaaatatggcacatacacaccatcgaatgctgtgcagccataaaaaaagaatgagttcatgtccttgcagggacatggatgaagctggaagccatcattctcagcagaccaacacaggaacagaaaacagaataccgcatgttctcactcataagtgggagttgaacagtgagaacacatggatacagggaagggaacaacacacacaggggcctgttggggggtgggggccaaggggagggagagcattaggacaaatacctaatgcatgcagggcttaaaacttagatggcgggtcaataggtgcagcagaccaccatggcacatgtatacccatgtaacaagcctgcacgttctgcacatgtatcgcagaacttaaagtaaaattaaaaaaatatgtttccacttaagtaaatggagcacaaaaaaagaagactatattgtacctagaacccagcctaagaaagaaaatatagccagtggagttggtatacctctgcggtcataattctgtttccatccccagagatactctcttttctgaatttgatgattaccatttccatatacttctttatacttttgctgtgtgtgtgtgtgtgtgtgtgtgtgtttgtgtgtgtgtgtgtgtgtgtgtgtgtgtatttgtatatttgtatgttatattcagggccagggccagggtgagatgaggaggcacctaggtccccaatgtaaggagcccctcagccatgggcttgcatgacccccagggtgatgcttccttaaattttgtgccccaggtacctcgttcacatcaccatagtcccagtcctgcttctgttaatatgcatgtttttaagctttatggaaataatattattttttatgtattctcttgtaacttttttcacttaatattgtgaaattgatccatctcgataaatgtagccctgctttattctgttgtgcgattgactatactataattttattttcccatgcttctgttgatggacatttaggttgtttctgattttgtgtttagaaacaatatcatcataagcattcttgtatgtgtctcctcaggacatagttgtaaaaagggaatttctgggtaattagatacatccatttgttttttttgtttttttttttgagacggagtctcgctctgtcacccaggctggcgtgcagtgacacaatctcagctccttgcagcctccacctcctgggttcaagcagttctcctgcctcagcctcccgagtagctgggactacaggcgcccacgaccatgcccagctaattttttgtatttttagtagagacggggtttcaccatgtagggcaggctggtctccaactcctgaccttaggtaatccacctgcctcagcctcccaaaatactgggattacaggtgggagccactgcgcctggcctatatccatttttaatattactagatactgcttttgctgttatatttatgctttcaccagcaatatatgagaattcatgtcacctcatatttttgccaatataaatggtattttcagactcatttttttcatttgatgtgtgtgatgggtaaattatatttttgtaaattttgtgttgcagaattaaacagatactaaaaaaatcatagcttagtgaattattgtagagcaaacgcttctgtcatcttcacccaggtgaagaaatagaattctgccagccctattagaagctcctccatgtacctcatcccagtcatagccccttcctttccccccaaagcaatcgctgtcctgatttgtatagtaatcccttccttggattcctttatggttttctaccccaactgtggatccttagatattatagtttagtcttgagttattatgtgcaactttttatgtatttgttttccatttttgttgtctcttctgtgaatcgcctgcttatatcttaggtcagattttcttaccggtttgtacaaattctgtgcatatcgtggataccagttgttggttataagcattgccgatctcttttcccagttagtgacttgtcttttcatctttctcatgagttttgatacttagatttaagtgtagtttaacttaggcaaacttttgcttagaaagtccttccttatgttgagattaaaagatattttgagactactgtaacaaaagcttaattgcaaaagacataaacaggcacctcacagaaaaggaaacacatatgaccagtaaacatattagagatgggtaccttcattagtgatcaaagaaataccaatcaagaccacaatgagatgatatcatatacccatgctgttggcaaaatttgaaaagcctggtggatctagtgttggagagattgtgaattcacaggatctctgatatatcactgacaggaatgtactttgttgcactttaaaaaacattttggcaattccttttttagatacacacccaagataaactcttgaccttgtgcagcaagagacaggtacaacgttttgtagcaacactgtccacgatagaaaaaaacaaaactagaaacaactcagatttccatcagtaggagagtagattaaaatgcagttttggaattatacagcgttaaaaaaaatgaacaacagggtgaatcttagcaatataatatttagtgaaaacgattaccttagggttatgcatagtaagatatcttttttctgtttaacttatttgagatataatccacataccatataattcaacctacagttcagtggtttttagtatatttctagagttgtgcaaccatcactattaatttcagaacatttgcatcatccctaaaaagaaccctgtactcattagcagttactccctattcaccttcccccgtcaaccctccacaaacccctggaaaccaatgattaattttctgttgctatggatttacctattctggacatttcatagaactggaatcatataatacatggtcttctatgactggcttctttcatttagcatagtgttttcaaggttcatccatgttgtagcatgcttcagtacttcattcctttttatggctgaacaatattccattgtatgtatatgccacaattagtatgaatatactgcagtttcattccagcaccacttgttgaaaagactgtcctttctctcttgaattgtcttggtacctgtgttgaaaatcagatgaccataagtgtaaggatatatttctggactcccagtctgttccattgattcctattgctatccttgtgccagtactacactgttttttttattactgtggttttgtagtaagttttcatacgttcatggacttcatttgctaatatttcgttgaagacttttgcagtgaaaatgaacaatgttcatgaacattggttggtagttttcctttttttctgcctttgttgggttttgttatctaggtaatgctggctacaaaatgagtaggtaagtgtttccttgtcttttgttttctggaagggttcttgtagaattgggcttgcagattcctttcacagaaggtttttttttaaactacaaattcaatctctttagtaattatagggttattctggttatctgtttcaccctgggcgagttctggcaatttgtagcttttgaggaattggtcagttttatctgagttgttatatgtatagattagaattgttcataatatttctatggtgtttcttttaatgttcatgtgttctgtagtgataacttcccctctttcattagtaatattgataatttatgccctcttttttttgttgctctgttttgctagaggtttatcaattttattgatcttttcaaagaactagcttttagtttcattgacttctctttcttttagtgaattctagtttcaatgcattatggtcagataacatactctgtatgattttaattcttttgaatttgttactgtttgttttatggcccaagctctggtctttgttggtacatgtttcatgtgcacctaaaaagaatgtacatttcattattgttggtagagtgttccatagatgtcaattagctctggttggttgatagtgttgctcagtccttccactaccttatcactaccttttcccccaccctcttcagtgaggtcatttcatacatatataatactgttggattgctttatcacattctgcttttcattctgggatcctctgattttttttttaattgcatgcattaaggttcactctttgtggctggtgtggtggctcactcctgtagtcccgaaacttagagaagcaggggtgggacgattgcttgagcccaggagttcgagaccagcctggacaacaataatgagaccctgtctgtacaaaatacataaataaaaagttaaaagattaaaaaaataaagattcactctttgtgttgtaaagttctgtcggtgttgacaaacacatagtgtcatgtttccaccattacagaatcatacagaatatttctctgccctaaaaattgccccgtgcttcacctactcagttcactgcctgctttccccaaactctggcaaccactgatcattttcctgtttctatagttctgttttatctagaaggtcataaaattggagtcatacagtatgtagccttttcacactggcttttttcacttagcattatgcatttaaggttcccccatgtcttttgatggcttgatactttgttctttttattgctgaacaatattccatttatgaagtattgcagtttatttatgcattcacctattgaagggcatcatcattgcttccagcttttggcaatcaagaataaagctgtaaacatttgggtgcaggttttgtgtggacataaattttcaactcaattgagcaaacacctagcagtgcaattattggatcgtatggtaagactgattagctttataagaaactgccaggtttctcacatcgtgactgcttgtgcattcccatcagcaatgatgagagttcctgctgcctctgcatccttgttagcatttttttttctttttttttttttttgagatggagtctcactctgttgcccaggctggagtgcaatggtgcgatttcagcacactgcaacctccgcctcccaggttcaaccaattctcctgcctcagcctcctgagtagctgggactacaggtgtgtgccaccacgcccagatcatttttgtacttttagtagagacagggtttcgccatgttagccaggctggtctcgaactcctgacctcagatgatccacccacctcggcctcccaaagtgctgggattacgggtgtgagccactgcacccggcccttgtcagcatttgatgttgtcagttgttttttattttaactattctggtaggtatgtagtgttattttgttgttttaatttgtaatttccgaatagattttccaacaaaaggtgttgttgaacaccttttcatatgcttatttaccatctgtgtatcttctttggtaagatttctgttcagagcttttgattgtttttgattaagctgttgttttgttactgagttttatgagttttgtttgtttgtttgtttgagacagggttttgctccgtcacccaggctggagtgcagtagtgtgatcacagttcactgcagccatgaactcctgggcacaagcgatccttcccacctcagcctcctgagtagccaggaatacaggtgtgcaccagcctgcctggcagtttttgtatttttcttgtagagatgagcttttgccatgttgcccaggctggtcttgaactactgggctgaagtgatctgcccacctcagccttccacatcctgttgggattacaggtgtgagtcaccgtgcccagtgttctttatataatttgtatacaagtacttcatcagatacgtgttttgaaaatattttctgtcactcagttgcctgtcttttcattcacttaatagtatcttttgtggggcagttaattttgataaaatctaactatttttttttttatttcatgggttgtgctttccaaacccattcatttggttttgctttgggctgaggatattaaacagccttttctaggaactttcagtttcaaccctttcatttatttatttttgagacggagtctcactctgttacccaggctggagtgcagtggcatgatctcggctcagtgcaacctctggctcctgaatttaaaagattcacctgcctcagcctcccaattagctggcattacaggcatgcaccaccacacccagttaattttttttgtattttagtagagactgggtttcaccatgttggccaggctggtcttgaactcctgacctcaagtgatctgcctgcctcggcctcccaacgtgctgggattacaggcgtgagccactgcacctggccaagtttcaacccttttagatttaagaaacttctcttacatttgcatagctaggaccctggtctttatagactgaagatgtgttctggttctttaaattgggtgaaatgaagcagtgattcggacccactgaagatcagagatgtttcaataaacgtgcctactggatttctctgtatgcccacaggatgaaccataggaagacaggggtggagagttctgagatcacaaggtcatagaattttatttgtgcattagtgtggacaaagattttggcagttgaaatgggaaaagagggtggatatgagcgtgattatgaggaaggaaatggcagggtttgaaattagagttagtgtgaaggtaatgatattggttatctctagattgtgtggctaagaaaaggcagagtgctaggagttcaagtggaaggaagtagagagatgtacttacattcatggtagcattggtcttcaagattatatcagaatggcaagggtatctcatcagctgtggtattggagtagataatacccttcttaggtatggaactgttaaaagcataattacaaagatacaggcattagtgtacttaaagcactggcatggagtcacctttgactgggcctagggaaatggtttatagtaatctcagtttttgtgtatcccattaatttggattttatgtaccctgaattataagattgcttgaaatgaaactacttaatgccttaattctcccagtagctgacttgtagacaaggatttaaatgcaagtattttattttggaggttatccttggaaaagccagtgggggagtgggaagtgagataggagagggaagatagcaaagattgcaaatacgagatttgttttcaagccaggtactgatttttttcacagtattcccactgagaaactccaggagcgaatgtaaaacttgtgtcttagagttatagtccttcaggggaaaggtagttggagtatttatataccatctctttcagttattggttaagattgttttcaggaggtggtagatctacctgacaggcgtgtatgtcaggcgtgccatgccgggaacaaaatggactcgaggttagagaaagctctcaggtgctgtcaggccagtgtacctggtaggggataggggatatacagactctcttttgactccttccttaataccttgccatgcagttccgggattttcaatttatttcctttaagacatcattggaaacatttatttccaccttaaatgagccattctagtagcatgttaggactggctccagatgccctttttggaacattaaattgtgagtcatggaagagtggcccatatcaacagacgtttccttgccagtcttatacttgaccaccaagttcagtagtctcaagatccaggtatgttcttccagttcttgccagtacatctcatcatatcatactgtgttggtgaatcaatgctttcatcaaaaggaaggccagtacctccctattctgacaatgcctggttgttagcctagaagcaatgagggaggtaggcacatatctccaggagggtaggcatctttggaggcatgcatcccagctaagacctctgcatagtttttagtcaggggagaccgccctcttgtagtaagaggaagaaagccgcttctggcctagaaggttcagaagaatcttgtcaggactgtgaattcaatctttgtaatttgcctgctttcacagtcgaaacttgggtctaatttttagcacagtctgtcttcaggcaaagaaatgcagatgctggcaactagaaactggacagttagaccttagcgtagcctggtgatagaatgaaggcagggtctgctgcacctgttcagtcaacagatgatgtcagtgttatggctcctgttgagtaacagacttttcttagcatcaatttggtgtgctggtccattctaacacttagggaacactgactgtgtgctgggaactgttctaggcatttgctgtgagtcctcacaacaatccatgaggaaggtactcgtgatcatcacagttttacacatgatgaatccgagattcagaaggattaagtaatttttccagggtccaagtgttggagctagtgtttgaaatttagtttaattcactaaaacactcattcttttgttattccacattgcttcccaaaacgtatccccattatgtccatttgacaaatgatgaatttgagatgcagaaattgagtgacaagatgagtttcaaggctagttaaagaaaactattgttagaattcaggatgtcaactgttttgctgttgaatatcatattgaacaagtggctaaatttaatactggctgttttcgaatgtttaccgtttttaaaatttcgttacgtggtctgtctcagggtttctcagcctcagcactatggctgttttggactggatgattctttattgtgaatactctcctgtgcattgtagaatgtttagcagtgtccctgacctctgtttactagatgccagtagcaccctcccagttgtgacaaccaaaactgactgtagatattgctaaatgtcccatgggggcaaaattgtccctggttgagaaccaggccaatctctaaaggtggttgtgttatgacagagctcacctagagtaattcagaagtttgttttgtgagcagggagttatattgctttaaagtggaaggagtacagtgtggtggaaagaacacgagctttggaatctcttggccctgctgcttatcagtccctgtagccttgattaagtaatttgtcttttttgaacttttgtttcctcatttgtaaaatgggcattatatctaccgggtagggttttggtgattaagctggaggatgatacatgtggaaggatgaggggaaaaaaggagaaaaatgatctgtagtagaagaaagtgaaggaaagatacagaaggcagttatcaagagcgggagtaaaaggcacattgggaaggtctaagacagcaggtgaacgaacggcatcttccctcttcccacactccagtcccaggtcactgagtctggaagaaagctctgaacagggctgagcgtggtggctcatgcctgtaatctcagcactttgggaggctgaggcaggcagatcacttgagactgggagttcgagaccagcctggctaacatggtgaaaccccatctctactaaaaatacaaaaattagccaggcgtggtggtgcgtgcctgtaatcccagctactcaggaggctgaggcacaagaattgcttgaacccgggagtcggaggttgcagcaagctgagatcgcaccactgcactccagcctggactacagagtgagactgtcaaaaaaaaaaaaaaaaaagaaagaaagaaagaaagaaagaaagaaagaaagaaagcaagctctgaacagttttcttttccttctttcttttttttttttttaaaaaaaaaacgtttaattggacttacagtgccacatggctgaggaggcctcagaatcatggtgggaggtgaaaggcactttttacatggcagcagcaagagaaaatgtagaaaaagcaaaagcggaaacccctgataaacccatcagatttcacgagacttattaactgtcacgagaatagcacgggaaagaccggcccccatgattcaattacctctctcccacaacacatggacattctgggagatacaattcaagttgagaattggatggggacacagccaaaccgtatcagggattaatacctgatttctttaatatgaaattgaatattcatgtatattttatgtataagctaactgttcttatgtcctttattacagcctttcattacatttattttctaaattatatttagtaacatgtttatccatataaaacagtagagatatgggaagttacctcaactaatccaggactctgcagagaaaataatcaaagttagaagtaagtcagccccatatttttagcacagtaagcaagtgtatgagctcatacaagtattgatttactaatattttagaagctatcaaataaaaggatggcagtttatctttttctgaatcaggcttccagtttatttttactgatactgtcttaaaatgtgcatttgcaacttggtttccggtccctcttcacaatagaatgattagcacttgattgaattgtcgaattatacagtggtttattgtatctttctttgtctctaggatgattgaggaaagtgggaacaagcggaagaccatggcagagaagaggcagctgttcatagaaatgcgtgagtcttgagtccttgttcatatgtgcgggaatgtttgtgtggtttttttttttttttttagatcaagtcatagctttaatcagttacaacttttatgttataagctttgcagagggaagaatgggagttaaagaatcatggagttgaaggaccccaagccaaagcatatatttgaatagaattgacttgctttcttagacaaggccataaataaataggcagaaatgttacctagaatgtctgtgattttgtaccatgccagtcaatttagatctcttgctgtaactccattgttaccatgaactttgcaggtggtgactaatgattaatacattatataaattaccttccactagatgacagttctgagacagagaggactcagtgttagggcaacacctagagctgttggaaaactaaaaagagtgaatgtgtattttgatatatttttaactttaaatattctgttaaaatttacattgttgtatacagttcaaacagagagaagaagatggctgagagaagttgggtggttcccaatccttgcaggattgttttgctctgtgactacttgtctatgtgaccatgaccatgtgaccttgaccaactcaaggttgcatttgctggacctcaaattcctttgtcatgaaatacgggtaattggtctggaccagagattaggaaacctttcaaaagtactgtactctttttttcccccagtgaaatcttacaaggacccttaacataagagtatgataagattggtagtgcttggttgaagcaggagaggggagccagcctgggatagcctctgaggtccttgcagaattctagaattctgcatatcgcaatatgaaaatcagtgggtaaaagtctcagaagacccaactctcgacatatttgacacctttagggtcttggtaatggtaagcagagtttgactcagctcagccatgtgttgtcctgtcagtcataggctggataactatttgttaggggtgataaagaagaaattttggcattggataggcagtccaactgggtgatcattaaggacttttgtagttcggagcttctaatggctagtaatccaagccagacaccttggagtcacttccctccacctcaccttctacctccaaagaaatcagaaggcatctgagttttactatgtacatgagtttgaatctgttcgtcacaccacagcagctttgagtccagctttgcagttagactgcttagtttggatcttggctgcctcacttcctgactgaataaccttaggcaagttaacttaatctctctgggcctctgtttcctcatccataaagcaggaatggcattgacttcatagaattgttgtgaagattaaatgagataatgtgaataaagcacttggcacagtgcctggcactcacatacttaagtatgaagtaagtagtacatacttaatatggatggttgtgtttattactaattttttttaatcactggtacttttctgaaccaaagcaataatttcctgatcccttcttccagtcttgaccctctcaaatctgctgtctatgatcagctaccagattgaactatttaaatctgtgctacttattattattattttttttttttttgagagggagtctcactcagccgcccaggcgggagtgcagtggcgccatctcggctgactgcaacctccacctcctgggttcaagtgattctcatgcttcagcctcgtgagtagctgggattacaggtgcctgccaccgcgcctggctaatttttgtatttttagtagagatggggtttcaccatgttggccgggctggtctcaaactcctgacctcaagtgatccgcctgtcttggcctcccaaaatgctgggattacaggcctgagccactgtgcctggcctaaatctgtgctacttctttgcttacattcctttacttgcttctcatcactttaatgggaaagaccccactcctaagaatgccaaacaaggcccttctggccccttttttgctctgcccactagttcccaatttttccatcacatgccttgcgtgttacttcccagcaatactgaattggctttcctgcagatcatgtggtttcatgcctttccgcctttgcacaatactgttgcctccaccacccggcatactgcttctgcctacccttcaaaactcagcataggggtcatcttttcctttcaacttttagtgcatttattgaggatctgctatgctccaggcactattctgggtgctagggctacagaggagaacaaaacacagtccctgacttcacttcatgaaacttccatgttagtaaagggaagcagacaaaataggaaaccaaatacacaaacacagtaattcctgatactaagaagaggctggggtgccttaagtaatacgcatgcaggcgttgatggggtagagatctgaagtagtcctgccaagaactgggtttacttctttgtgaatgttactactcttacacagaaacctcatatgaattatcatcctctgacttaaggataacagtcagtctgggagacgtttggtaagtatgacttcttgagtctcctatatttcttcacaggaagaattgcatgggtgactatagtgtctgctgctggaagccccaccccctcatttccagcaacgtcaaccagaaactccagcataactactttctatggatgccagaatcacctttttccagccattattcagttgtatcatttagtatgttgattttagtatgtcagttttgaatccagtactctttctcaactcttgttagtcttaatggttatagattcctacttaggtaggtaactatacaatttttttctttttctttgagactgtgtcttgctctgtcactcaggctggagtgcagtggtatgatcacggctcactgcagactcaacctccagggctcaattgatcctcccgcctcagccttctgagtatctgggactacaggcgtgtgccagcaggcctggctaattttcttgtttttcgtagtgatgggttcacactatggtgcccaggctggctggtctcgaactcctgggctcaagtgatcctcccacctctacctcccaaaacgctgggattacaggtatgaactaccgtgcctggccagtaactataccatttttaaagaaagacaattttgactcttccttttgtaattgtaatccttatacctttttcttgacctagtgtactggttagggccgcagaggttatattgaaaagtaggaaggatggccaggtgtggtggctcacgcctataatgccagcactttcggaggccaaggcaggcgggtcgtgagatcaggagattgagaccatcctggctaacatggtgaaaccccgtctctactaaaaatacaaaaaaattagctgggcgtgctggcaggcacctgtagtcccagctacttgggaggctgaggcaggagaatggcgtgaacctgggaggcagagcttgcagtgagccaagatcgcgccactgcactccagcctgggcgacagagcgagactccgtctcaaaaaaaaaaaaaaaaaaaaaaaaaggtaggaaggatagcgtcttgtttttgattttcatgggaatatttctaatatttctattctttctatatttctaatatttcactgttaagagtgatgattggtacaggttaaccagataaaggtgaaagaactgatatgtcctaatttgccaggaatcattatcattattttcttaagtcataactgaatattgaattttatcagatgttttctgcttcccttgagatgaatgtctttcctctttactctgttaatatagtgctggggccagccatctttttcttaaagagccagaaagtaaatattttaggatttgcaggctgtatgatgaggtctttgtcacactactcaactctgccattgtagcataaaagcagtcataataatttaataatttaaatagtttttttttaaccttagttttcagaatatttccttttggagctctttttaaaaaaataattgtaacttttagattcagggggtacatgtgcaggtttgttacatagtttgtatttttcaaccttgtgttacctttactattatgactttatataatatccttaagcctttatgtttttagacagtagtttttacattttctgttatgaacacagcgatgaaattagcttattctttctttgcttaatattttatcttgtagactctaagcattatgagaataagtatcacatctgtttatcatgatggtgcctcgataaatatttattaaaagaagaatggaatatattacatagaaataaatgggtagtttatgattcttacatgatataaaatcaccaagaaaagtgaaaggtgacaggtgagaagagtaatcctcaactctggtgccaaaatgaaagctctccagttgattgtacaaagtgcttgataccaggcctccatgctcagagattctgattttattttgtcttttctaaagtttgccaattttattggactgacttttggctttattggtcctctttgtgtatctttgttctctgcctcatttgtgctgtgtattttcctcttcctatttaggcaattctgttatttttctaacaacttatgttgggttactaaggccatttgttttcagccttttttttcttatgtaagcatttaagaataaactttcctgtgatttttttttttgcatcccaagtgttctgatatttactatttttcataatcagttctctatttcctctaatttttattattaattacttaaaaatatctttttattgatcagttggttggttgattggctgattgatagagacagggtattgctctgttgcccaggctggtcttgaactccaaggctcaagcgatcctcccacctcggcttcccaaagtgctgggattacaagcgtgggccaccgcacctggctggagtatctttttaaatttgaaagtaaatgttttagttaaaaaaacctgtatagcttaattgggttttgggtcaggaaatgtgagaagatctagaatctttgaatttgttaatttatgttttgtgtttttccaaatattccatgagtacttgaaaataatgtgtatgatttatgcattatttagatcaagctttttgcatatttcattaaaatcttttttgtccttggtgatttgattgcttgatcttaatcactgaaagatgttaaatatttctgctttgatcaagagtattaattttttccctgtacttctgttagcttttagaactttaattcttggatgcatgtacctttaaaatgttatgtctatctaggaaagtgaatcctttgtcattgtgtagttaccctctttttctagtaatgcttttgatgctttgaagtctattttgtagcatattgatagagctaatgctggctttctttcagttagcatacttagtacagtatgcatcttttcattcttttacttaaatttcttaattcttatgtttttgtctcttgtaagtagcataagctagaatatttagaaaaaaactaatatggcagtctttgccttgtcactgaagagtttattttgtctagcctttttaatgaatacacatatatttcatattttctgttgacaaaaagagtcaaattctgtaaaatatttgaagagatttattcgaagctaaatatgagtgaccatggcccgtgacacagccctcaggaggtcctgagaacatgtgcccaaggtagtcgggatgcagcttggttttatacatcttaaggaggcatgagactaaaatcacatacatttaagaaacatattggtttggtccagaaaggcagaacaacttgaagggatgaggtggggggccttctagcttataggtagatttaaaagtattctggttaaaaattgattgagtttatccaaagacctgggatcaatagaaaggaatgtctgggttgcaataagaggttgtggagactagcgttttctcatacagatgaagcctccaggtagcaggctgaagagagaataggttgtaataagtttcttgtatctttttttttttgagatggagtctcagtctgtcgcccaggctggagtgcaatggcatgatctcggctcactgcaatctccgcctccctggttcaagcgattctcctgtctcagcctcccaagtagctgggattacaggcgcctgccactacgcctggctaatttttttttagtagagatggggtttcaccatgttggtcaggctggtctcaaactcctgacctcaggtgatccgcccacctcgacctcccaaagtgttgggattacaggcgtgagccaccatgcctggccaatatgtttcttattaggcttaaagtctgtgttgttattaatgcccgagaggtacggtgaggcatgtttgatcccaacttcctatcatggcctgaaacagtctctcaggttaaattttaaaagagccctggctgagaaggaagtccattcagatggttggggggccttagagttatttttggtttacatttccatcatattttgtgcttcaattttgtcctttctttccccttcttagaggaactgagcttgctttcttccttccatcccattgtttccctctacttggttgtgagttgtatatttttcttttctttaccctagaaatattaacatcaattaaaatatagcttatcaatatttgtaacttttttcaaatatgagggtattggaatattttagggtacccccttaatgaaatttataccatttttagtattatctttttttaaggaccaggtgcagtggctcatgcctgtaattccagcactttgggaggctgaggcaggtggattgcttgagcctaggagtttgagaccagcctgggcaacatggtgaaaccttgtctctagaaaaatacaaaaattagccaggtgtggtggcatgtttttgtagtcccagctactaaggaggctgagaggtggaaggattgcttgagcctgggaagtcaacgttacagtgagctgagattgtgaaactgcacttcaatgcctgggtgagtgagaccctgttaaaaaaaaaatctcttttttaccccacagattagattttgttattattttttgtaatccagtccatttagttattactttctttttttttctttttttttttttgtgatggagtcttgctctgtcacccaggctggagtgcaatggctcaatctcagctcaagcagttctcatgcctcaccctctcaagtagctgggattacaggcgtgcaccaccacacccagctaatttttgtatttctagtagtgacggggttttgcccagttggccagccaggtctcaaactcctgaactcaagtgatctgcctgcctcagcctcccaacgtgctgggattacaggcatgagccactgcacccagccatttagttaccactttctttgcttgctattattcttatttttgttaaattcagataaatttaagtctaaatcaaggtggacaaaggcttgtgtccccagcatttccctttgtgggatgctttctctttttttcctagttcacccactgagagagtcatccttacagtattcagtggtcttggttgtatttgtatcttcctctctggtgggacctctggcctcatctctgtcccccagggtttttattcttattgcaaagaaaaagataaggaagtcatttgtgttagttatttggactaataatctgttgaaaaatttcttatttctcatttttttatttttgatgcagaatctcgctttgtcacccaggctggagtgcagtggcacaatctcggcccactgaagcctccgccttcgcctccagggttcaagtcattatcctgtctcagcctctggagtagctgggatttcaggtgctcaccaccatgcccagctaatttttgtatttttagtagggatagggtttcaccatgttggccaggctgtctcaaactcctgatcaggtgattcagctgccttgggctcccaaagtgctgggattacaggcatgaacaaccacacccagccaaaaattttttcaatcataaatggttgtgaaaaatttcagacaatttagcattatattatgcttacatcttctagctctatatctcttctcccttcttccttttttcctcctctccccatttgcattgcattttaaacaaaatacacttacttcctgtatcttccatgggtttgttacaggaaaggggtcccgatccagatcccaagagaaggctcttggatctcacgcaagaaagaattctcagtgcgtccgtaaagtgaaagcaagcttattaagaaagtagaggaataaaagaatggctactccatagacagagtagccacaagggctgctggttgcccatttttatggttatttcttaatgatatgctaaacaagaggtggattattcatgcctcccctttttagaccatctagggtaacttcctgatgttgtcatggcatctgaaaactgtcatggccctggtgggagtatagcagtgaggaccaccagaggttactcttgtcaccatcttggttttggtgggttttaggtggcttctttactgcaacccgttttatcagcaaggtctttatgacctgtatcttgggctgacctcctatctcatcctgtgacttacaatgccttaactgtctaggaatgcagcccagttggtcttggcctcattttaccaagcccctaggtagggtggggttgctctggttcaaatacctctgacagattagattggctgagcacctccctcaaaacccatggcttcctggaacgcagtgtggagtcctctgccctacttgaataatactaaaagcatgagcgtgtaatacacagaatactaaaaggaggtggcttcccctctactttgattgtcctcctctgtcagcttttctttgctaatgtccaaaattctatctacagtttgtctaactttttgattttgtatgtttttaggagaaagtagatcagagttttttgcactagcaacacaacttcccaattttaacgtgtttattcactcaataactatttcaggtgctagttttattgtgttctagttagcattgaacagtgaacagaaacaacaacaaatggtctttgccttcatgtaacttcgtttcctggaaatgacagtgcagtaggagccacatgggggaagcactggggttcagaagggatctgggagaagccatgcccaggatgagttggtctgaggaggtgaaggaagggctggggcggtagcacttgtgaaggccccgagatgagaggactgggtgcagttgggtgattctgtgcagtccagactgattggagttgggtgtgaggtgaaatttgaagagtgtgcctgagccataccttttagttgagctgggtagtactgtgttgtgtttcttgaacctaacttgattataaaactctactggggccgggcgcggtggctcacacctgtaatcccagcactttgcgaggctgaggtgggcacgattgcttgaggtcaggagtttgagaccagcctgaccaacatggtgaaaccccgtctctactaaaaatacaaaattagtcaggcatggtggcacacgcctgtagtcccagctactcaggaggctgaggcaggagaattgcttgaacctgggaggcagaagttgcagtgagctgagatcgcgccactgcactctagcctgggtgacagagcgagactctatctcaaaacaaaaacaaaacccaaaaacactctactggggcacttgttaaaaatgaagattccaggccaggcatggtggctcatgcctataatctcagcactttggaagggcaagggaggcaaatccattgagctcgggagttcaagaccagcctgggcaacatagtgaaaccccatctctgtaaaaaatacaaaaaattagctgggtgtggtggcacacacctgtggtcccagctactcaggaggctgaggtgaatcacctgagcccgagaggtcaaggctgcagtgaaccgagattgcaccactgcattccagcttgggcaacatagtgagaccctgtctaaaaaaaaaaaaatagtgtcccagggtttctcactggagattttgtttcaggaagttgatctgcagtgggacctggaattttatacattgagcatagtgccaggcaatgcttatgatcagatgatactaattaacccctggcatcatatgatcttcactgtgattggagttagaagatttagcttcatatcctgccttctcctatcaacacacacacatacacatatacacacacacgtgcacaggcatgccaaattggctgttacttatctcacttgtattatttatatctttttactcataaaaagactttgggctgggtgtggtggctcatgcctgtaatcccagcactttgggaggctgaggcgggtggatcatgaggtcaggagatcgagatcatcctggctaacatggtgaaactctgtctctactaaaaatacaaaaaattagttgggcgtggttgtgggtgcctgttgtcccagctactcgggaggctgaggcaggagaatggcgtgaacccgggaggcagagcttgcagtaagccgagatcgtgctactgcactccagcctgggtgacagagcgagactccgtccaaacaaacaaaaaagactttgaagttgatctggcttctacatttgtcatttttctaaaactcttcccttgtctggaaatcaaaggtgtttgcagtgcactaaaatctcatctgaggttgcatttttcttcaacatgttaacagagtagaactgtatcctttttcacgaaagcacagttacacaaaatataggaagctgtcagtgggaatcagctttgggccaatatctcaaataagaaatatttggaagtagttgtggagttttgcaaggagtagttgccaggcatggtgggcttatgcctgtaattccagctactcaggatgctgaagtgggagggtcacttgagctcaggagcttgagaccatcctgggcaaaaaaataaaataaaataaaatatcctttgaggtaatggatgaggactttccttctaagaaaccaggaaagatgattgctccagaaaaaggcagacatatgggaggttttagaatctgattagtagaatgttggcacaatatgattttaataagattctaaggctattgtttgcatctaactctttacaaattattttgggatttggagtgttattagatttctaaaatgctgttgtggcacggctccctagagtttctgaattgtgtgccatcctactaatctctgtaccctttttccactgggctttatggtgatgcatgttcataaggaacaatggcaaaggaaagcagagtgacccttgattcgtgactgtacctgaaacttcagtgtagagatctctggcaaacttggctggagcgtatggagcttatcattttccgaaagtattatagttatctttggacttttgtgatacttgctgtattttatcttttgtggtacccaaatcttggctcactgcaagctccgcctcccgggttcgtgccattctcctgcctcagcctcccgagtagctgggactacaggcgcccaccacctcacccggctaattttttgtatttttagtagagacggggtttcaccatgttagtcaggatggtcttgatctcctgaccttgtgatccgcccgcctcagcctcccaaagtgctgggattacaggcatgagccaccgcgcctggccaaaaaaaggctggttttaaactgctgggctcaactgatcctcctacctcagccccccaaagtactgagattacaggtgtgagctactgcatctggactttgaattatattttaataaagcttttatatttaaaaagagaaagtgggactgtataatatatagagagagagggataaatattttgtgagaaccaggtatcccctgaggaaataattttaatcatgacatcaggaggaaggttgattgaagtcagactaagataaaccttcactttttgttcagtatacaaaaaccaaaaacctggaaaaatccttcctttaaccccctccaccccccgcctccataccgtgtaatgaagacaaatgagagatgcctataaatactgatacaagataatttgtgccagttctctgtccccttattgagtcaaaacttgctgccaaattttataaaggaaggataggtgaaatctcacattgggggccaatcctatctacagtggtcttaaaattcaaggagacttcatttgcagcaattaaaatgagaacaaaatgtgatttatagactcatgtataattttaggctttgttctagttactctggccatatatcgcttacccctcaaacagtcattctatttatgcgttttgtgggtctagactcagaacagcgttcagtgctgacatcttgactttgcttcatgatgcctgaggtctcagcagaagactcaaaggcttagggcttgaatcatttgaaggctcgctcgcctgcgcgtttggcagtcgatgctggtttggttggtggactcagttcttcttcgtacgatcttctcactgtggcctctccacatcagtctgggctttctcacggtatggcatctgggctcccagcacaagcatcccggaagagcaagagcagagcaagctatgccgtctgttatcatctatctccagaagtcccgcactgtacttctgccgcattctgtgccgcgaggccgtcacagtgtcctggtcagattcacatggaaggaaagaatctctagaccttgatggagagggacaacatactagaagtacataaaatactgttctgaaaatattgttgtggcttttttttttttttggaaaatacaggctgccacagactggaaggggacctttcaggcaaccggtccgttccctcatttcccaaatgaggacacttatgtgcagaggcacgccgcatggccacagccacggggcatggccacagtcgtattctgtggttggtcaggctgggacaggaatgcagcttttctgactctaggcttgggtctttctcacgatgctgccctactcccctttcctaatcatagttcactcactcacctcataagtgttcctccccctggagttttctccgatgagcagacaggatatcaggagctagactagcagagttcctgcacatactggagatgcacgtgtttcctatccttttctccctctgttgttgttttaattgacccaccgtttttaagaagtcctagctgactggtatactatgacaatacaatagaatggagtcatttcctagcgtttggaaactaaatggtaaatctagttgagcatttctgtttgccttttttcaggtgctcagaattttgatgtcatacgactatcaacttacagaacagcctgcaaattacgatttgtacaaaaacgatgcaaccgtgagtcatttctactcatttctgtgatagctggatagagttctcaatattagaaaagactttaacatcttttagttgtattgtaatgttaattgaattatttttgtcttaagtatttattagtatgtaagctttgtaatggaagaacttgtcattttacttctttgtccttcaaaatgtttaacaaactcagtcatgtaactagttttgaggctgttgtagtattaatgttctttaaatgggagaatggatttctctgtcacttttattaaggaaatgctttatgtaaaattaatacaatttatcagctgctggaggaaaagaaaaacaatgtttttgataaaggtataattggaattgattttcttcattaagcttaatgtaacatgaatcaaccttttctataaataattgctaccatgtggatcataaaataaagtgtgtgtgtgtctgtatatatgtatatgtatgtctgtgtgtgtatatacttaatctttcttctctttatttccatgaagatgaactagctcgtgacagaattattgtacttttctcgtgtttgtgtgtatcagtggaaaaagtattttatacaatggaaagagcattaaccttagaattgaaaaaccttggttttagtttttatttatttattttttattatactttaagttctagggtacatgtgcacaacgtgcaggtttgttacatatgtatacatgtgccatgttggtgtgctgcacccattaactcgtcatttacattaggtatatctcctaatgctatccctccccctcctgccatcccatgacaggccccggtgtgtgatattccccttcctgtgtccaagtgttctcattgttcaattcccaccagtgagtgagaacatgtggtgttcacttttctgtccttgcgatagtttgctgagaatgatgacttccagcttcatccatgtccctacaaaggacatgaactcatccttttttatggctgcatagtattccatggtgtatatgtgccacattttcttaatccagtctatcattgatgggcatttgagttggttccaagtctttgctgttgtgaatagtgctgcaataaacatacgtgtgcatgtgtctttatagcagcctgatttataatcctttgggtatatacccagtaatgggattgctgggtcaaatggtatttctagttctagatccttgaggaatcgccacactgtcttccacaatggttgaactagtttacagtcccaccagcagcgtaaaagtgttcctatttctccacatcctctccagcacctgttgtttcctgactttttaatgattgccattctaactggcatgagatggtatctcattgtggttttgatttgcatttctctcatggccagtgatgatgagcattttttcatgtgtctgttggctgcataaatgttttcttttgagaagtgtctgttcatatccttcgcccactttttgatggggttgtttgattttttcttgtaaatttgtttaagttctttgtagattctggatattagccctttgtcagatgggtaggtggcaaaaattttctcccattccgtagattgcctgttcactctgatggtagcttcttttgctgtgcagaagctctttagtttaattagatcccatttgtcaattttggattttgttgccattgcttttggtgttttagacatgaagttcttgcccatgcctgtgtcctgaatggtattgcctaggttttcttctagggtttttatggttttaggtctaacatttaagtctttaatccatcttgaattaatttttgtataaggtgtaaggaagggatccagtttcagcttttgacatatggctaaccagttttcccagtaccatttattaaatagggaatcctttccccatttcttgttttcgtcaggtttgtcaaagatcagatggttgtagatgtgtgctattatttctgagggctctgttagacctggttttgccatttattataaacaaataatcttgggcaaatcacgttacagctgataaattctactctactttaagtcttactcacaaatcttaacttaaaattctctccgaagagtttatcatgccatcctagatcgaagtgatgtttctttctccagtggtttctcaaagcattattttttacattgtgagttgttacccattaatgcttcatgaaatcattttgatgggctgtagccagaattaaaaacatataataggaaaaaaaaggaagaaaaataaaatattagaatgcaacttatgtggtaaggctaaatgtgttctgatatctggatgtatctatgtgtttgtgtgtgtacatgatgatttaaatatatttctgtgatgatttaaatatatttatatatctagatatatgtatgtgtttgtgtgtatatgtgtgtatgtgatgatttaaatatatttctgtgctcgtggtcaaaaagttcgaaaaccactgccttagaacaactctcgtttttataattcctgccataattattcttgggaaacagtagtctacgtgtggagtgttgagagcctgactaggctagtggcattagtaatataaagtaaaagatgcattgttctaaaggttttattttgttacctttcacgtaggattctagagttgatctgaaaaaaattttgagactgtacaggataagtagtagtcagttttcaagtttttccatatgtatgttcagttgttcctttactttttgttgaaagggtcaataaacagaagaaaataaacaattttcttcaatgctgaagagtcttctcatgcttattcattgaatatgaatatattcatgaatctgtacaagtttttccatatgtattttcagttgttccttcactttttattgaaagggtcactaaacagtcaataaacagaagaaaataaacaattttctttactgctaaagagtcttcccatattcattcattgaatatgaacatattcatgaatctgtacaagaatgttcatggcagtgtccatatatgagaaggtctgctttttgaccctcttgtgttccctggtctgtttgtctatccttctaccaataccagactgttctaatactgcactttcttgtagcagtaaccactattagaatttagtaaatctagatgtcaggcaaggcaagtcttcctactttgctcggcttttctttttaagattctctgggacagtcttgtctttttaacattcattttcatataaactttagaatctgcttgccaatttctactaaaaccaacaaaacaactctcctgtgttttttttattcatttcttttttcaagtataatttacacacagtaaaattcctcttttactgtacagtcctgcagagattttgattgggattctgttgaatctgtaaatcaagttggggagaattgacatattgccaatgttgagatttcctcctgtgaacgtggtatatggtcatccctagaactatttaggtctttaatttctttgtagagatgttgcacatccttcattggatgttttttattttttaaatttttatttatttatgttttgaatcagagtcgctctatcgctcaggctggagtgcagtggcgcaatcttggctcactgcaacctccgcctcctaggtttgattctcctgccccagcttccccagtagctggaactacaggcgcccgccaccatacccagctaacttttgtatttttagtagagacagtttcgccatgttgtccaggctggtctcgaactcctggcctcaagtgatccacctgtcttggcctcccaaagtgctgggattacagatgtgagccaccactcccagcctcttcattggatttattcctaggtcttcagtgacatgatactattattttaaaatttctttttttttttttctttttttctttttttatttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtcccggggtacttgagattagggagtggtgatgacttttaacgagcatgctgccttcaagcatctgtttaacaaagcacatcttgcaccgcccttaatccatttaaccctgagtggacacagcacatgtttcagagagcacagggttgggggtaaggtcaccaatcaacaggatcccaaggcagaataatttttcatagtacagaacaaaatggagtctcccatgtctacttctttctacacagacacagcaacaatctgatttctctatcttttccccacatttcccccttttctattcgacaaaaccgccatcgtcatcatggcccgttctcaatgagctgctgggcacacctcccagacagggtggtggccgggcagaggggctcctcacttcccagtaggggcagccgggcagaggcgcccctcacctccccgacggggcgactggccgggcggggggctgacccccccacctccctcccggacggggcgggtggccgggcgggggggctgacccccccacctccctcccggacggggcggctggccgggcggggggctgacccccccacctccctcccggacggggcggctggccgggcggggggctgacccccccacctccctcccggacggggcggctggccgggcggggggctgacccccccacctccctcccggacagggcggctggccgggcagaggggcccctcacttcccagtaggggcggccgggcagaggcgcccttcacctcccggatggggcggctggccgggcagggggctgactcgcccacctccctcccggacggggcggctggctgacccccccacctccctcctggctgccgggcgtagacgctcctaacttcccagacggggtggctgccgggcggaggggctcctcacttctctgacggggcggctgccgggtggaggggctcctcacttctcagacggggcggttgccaggcggagggtctcctcacttctcagacggtgcggccgggcagagacgctcctcacctcccagacggggtcgcggccgggtagaggcgctcctcacatcccagacggggtggcggggcagaggcgctccccacatctcagacgatgagcggccgggcagagacgctcctcacttcctcacttcctagatgggatggcggtcgggaagaggcgctcctcacttcctagatgggatagcggccgggcagagacgctcctcattttccagactgggcagccaggcagaggggctcctcacatcccagacgatgggcggctaggcagagacgctcctcacttcccagacggggtggcggccgggcagaggctgcaatcttggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcggatcactcgcggttaggagctggagaccagcccggccaacacagcgaaaccccgtctccaccaaaaaaatacgaaaaccagtcaggcgtggcggcgtgcgcctgcaatggcaggcgctgggcaggctgaggcaggagaatcaggcagggaggttgcagtgagccgagatggcagcagtacagtccagcttcggctcggcatcagagggagaccgtggaaagagagggagagggagagggagagggagagctattttaaaatttcattgttatgttgctgatgtacagaaatacagtgatcttgatcttgatcttatttctagcaattgttctcgactcatattaatttatctgtagaatctttgatttctatgtacatagttttgttatttctgaataatgacagtttcagttactcatttccaatacactgattatttctttatctgaatatttgtattggtttggcctcaagtactacagaaatgatgatagtgggcattttttatctcattcccattatcagagcaaaacctttcattttactattaagtaatatgtttgtggcaagtcctttgtagataacatttgtcttagcctgttttctgttgcttataagagagtacctgaaactgggtgatttaaaaagaaaggaatttattttgtacagatacggaggctgggaagtctaagattgaggggccatatatgttgaaaaccatcttgctgctggggactctctgcagagtctggaggccatgcacaccatcccatggtgaggaggctgagtgtgctagtgcaggtctctcttcctctttttataaagccaccagtcctactcccatgataactcattaattagtccgttaatccatgggtggatgaaggcagagccctcatgactcaatgacctcttaaagcccacctctcagtactgccacactggggattagattacatttcaacatcatttttgcagaggacaaatattcaaaccatgacaaccttaatcagattaagaaagtttcctgatagtgtatttcttcatttctaaaaataaggtttcctttaaaagttgtcttttgattatgatttctaacttaatttcattttgatcagagagcatggttcatatgattttaatcctttaacatttattgagatttgctttatggctcaggatatggtcaatttctttttttttttttttttttttgagacagagtcacgttctgtggcccaggctggagtgcagggctgagatttcagcttactgcacttcgcctcccaggttcaagcgattctcctgtcttggcctcccgagtagttgtgattagaggtatgagccaccacacctggctaatttttgtatttttagtagagatggggtttcaccatgttggccaggctggtcttgaactcctgacctcaagtgatccacccacctcggcctcccaaagtgctgggattacaggcttgagccactgtgcccggccaaggatgtggtcaatttttatatgtatctttgcgtacttgaaaataaaacatattctctcatcagtggaggctgtactttatatagtgctcattatgcctactttgttagttgtgaagtttaattgtctgtatctgtactttttgagtgtgtatttgcactatcacttattaagagaggtgagttaatatctcccactaagcttctgaattcctttgtgtccctttgaggttatgtttatttttgttttatatgttttgagactattctgttagatgtaaataaatataaagttcctgtatctttctttattttcttttttctttctttttttttttttgaccacagggtctcacttcgtcactcaggttgaagtgcagtgacacaatcatagctaaatgcagccttcaactcctgggcttaggcaatcctcctgctgtagcctccccaatagctaagactacagggatgtgtcactatgcctagctaattaaaaaaaattttttgtggagatgggattccactatgttctccaggctggtcatgaactcctggcttcaagctaagccaggagtgggattacagacatgagccgctgcaccaagcctctgatatctttcttatgaattaaaacttttatcattattcgctgaccctctttaacaatatgttttgtcccaccattaaaaattacataaaattcatatactataaaattcacccttttagagtgtacagtcttttcactgatttttagtatatccacaaagtcgtacaaccatcatcattatctaattctagaacatcttcatcaccccagaaacaaaccgcatacccattaacagtcactccacattcccttcatctcccagctctggcagctactaatatacttttttttaatggatttgcctatgtggacatttcatatatatagaaccttagaatatttggtatcttttatttttaactgtctggtatcttttacttagaataatgttttaagggtttatccatattgcagaatgcatcagcacttcatccctttttttttttttttttttttttgggacggagtttcactcttgttgcccaggctggagtgcagtggtgtaatcttggctcactgcaagctccgcctcccaggtttaagcgattttcctgcctcagcctcctgagtagctgggattacaggcgtgtgccaccacacctggctaattttgtatttttagtagagatggggtttctccatgttggccaggctggtctcgaactcccaacctcaagtgatccacccgcctcggcctcccaaagtgctgggattacaggcatgagccaccgtcaccgtgcctggccacttcatccctttttttggtcaaatagtattccattatatgcatatgccacattttatttatccgtgtatctatattgatggacatttgggttgttttcacttttggcttttatgaataatgcacctatgaacatttgtacaagattttgtgtagacatatgttttcaattctgtaggagtggaattgctgggtcgtatgggacctgtgtgtaacttcttaaggaactcctaaattgttttccaaagcagctgcatgcttttgcatttgcaccagcagtttatgagaatttcaacttctctacatcctcgctgacccttgttttccatttaaataaaaagtctagctattctggctggtgtgaagtggtatgttatcgtagttttcttttgcatttccctaaatgactaatgatgttgagcatcttttcatgtgcttgttggccatttgtatatcttctttggataaatatctatttaaattattttcccatttttaaattgggttatctttttttaattgttgaattgtaagagtttttatgtgtctggatcccagacccttaatggatgcatggtttacaaatatttttttccattctttgggttgccttttcactttcttgatagtatcctttgaaacacagacttttaaaatttaaataaaatgcagcgtatctcttttttgctgcctgtacttgaagtgtcttgttcctgatcttgaggggagagctttcagtcttccctgattaagtatgatgttggcattgggatttgttgtagatgccctttatcaggttgaggaagttttcttctgtttttagtttgttgtgtttttattatgaaagggtatttgatttttccaaatgctacttctatgtctattgagttgatcatatggttttccaagctccgccctcccccctttttttcctgttacgaataaagttacatcacctttgttttggttgaaaattgtcatccacttatatttaaatcttttttatgtccttttgttttagacatatcccttacaaacagcgtataatttggttatttaaaaaattgtgaatttgtcagtctttgtcttgtaagtggtacgttagtgtgtttatagtcactgcagttaactgacatatttgggtccgcaccagccatcttttcttgtgctatttttgctgcttgttctgtgtttcttgccttcttttgaatagttgtgttttcctaatttcagttcttcccctagtttttcagcgttggaaagtatactttcagatttcctttacttgaaaatgtctttattgaaccttttttcttgaaagtttttttatactaggtgtagaattttgttggtggttttgatttcttttcaacacattaaaattattttgcagtcttctgcttcctttgttgcttgaagtcaggcatcattcttaattatttttctttcaaggaaatgtctcttttctgtgtagttgagtattgtttactttttttgtgcacttaagaagtttttatattccatccaggaatttttgtcgttttcaagaagagtgtagacccagctaccgcgcctactttattactggaaatggaatttaaaagaaagtcagcctcttaaataatggaggaaatatgcagtagataaatttatttttggctgagctatgagttgttcagagctctgagtagcctctaaagcatattaatattttacttaatgcagttgtatttgtctctctctttagggtcatacagtaaagtttcagttgtaaaatgttgctttagttgctcggctaaagtaatacagtaaagctgactcaaggtaatacagcaaattttcaaaaagactagaagttcttaggagtagttcttgatctttttatcaagttatccattgttaggaattgcatgggtcactatttgcagagacgtgaaatactcgctatttaaatgtgaaggctggaagtagtccttcccataccgctgtggtggctccttgatgttgtctgggactgatgttctttatttgaccacagaatgttttcctcattgttggctaaagagtttcttctctttaaacttaagaactagttgataaattttagattcctattgtgaagggtagtaccacactttaaaattgttgacagtttattttctttgtcttttagttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacaggctagtagtaccttaccttacacgcttacttcattttaagaacacctgtctctgaatcattcttcttccatactgccgtgctaagttgccttgctaagctggcaacttagaatcatgattaaaagggaaattattggctgggcacggtagctcacagctgtagtcccagcactttgggaggccaaggagggcaaatcacaaggtcaggagatggagaccatcccggctaacacggtgaaaccccgtctctactaaaaatacaaaaaattagccgggcgtggtggtgggcgcctgtagtctcagctacttaggaggctgaggcaggagaattgcttgaacccaggaggcagaggttgcagtgagcagagattgcaccactgcactccagcctgggcgacagagcgagacattgtcttaaaaaaaaaaaaaaaaaaggaaaattattcggtgtaagcccctctagaaactggttcacagtgacttactgtcctagagtatgtcatatattaaactctggaatattgtggagaatcacatttgagatgtattgtttgggaaaattatagataccttaatacagctgtcctccagctcatgaaaaacactaagttttgaatttgattatggggctttctatttgacttctaagtctcctctttcttttttcttctatgcctagtttgttcagaaggctaatctttactctgtaacatcaaatattggactatagtaactgattttctctcttttttttttgagatggagtttctctcttgttgcccaggctggagtgcaatggtgtgcaagctcggctcaccactacctccaccccccgggttcaagcgattctcctgcctcagccttccaagtagctgggattacagacatgcgccaccacgcccagctaattttgtatttttagtagagacagggtttctccatgttggtcaggctggtctcaaactcccgacctcaggtgatccgcccaccttggcttcccaaactgctgggattacaggtgtgagccaccacacctggccaaacagattttctctttatgtctaggaacctattttaaattttttcattgcagaacatagtttagtagatcttgaaacaaaagaagaaaactatttaaatgtactccaattaaaacggaaatgatttgctgcacttatattcgtagagaattgagttggtattgtaaagaatgaaacaacaaaattgtaaagcacagatttatgattgtggaagtacagaggttaaatggtgatgttctgtgaaccaagagttccagtttctgctatactcttggccatctgatttgaatggattgtctctgcttcattttttgctgtctgtagaccttctttgagttcatacatttgtaaaatgctattagttatatcttataatagggaggagtctgtgaattagtggtaacactatggaaatgtcaaagccaagtcataatttaagcactcactaaattcacaccatttttataagccgttatcagattagacattgtatccgtttaatagaaaattattaaagaaatttacttatttttttgagatggggtcttgctgtgtttcccaggctggtctaactactgggctcaaacagtcttccctccccagcctctctagtagctggcattacaggtgtgtaccactgtgcccggcagaaatctgaattttaaaaataagagtgtgtaagtgtcataagtcccagaattctaatgccattttttagtaattttagttagtgactccataggttaattttttcctgctcaggaactgtctttttgtttcaaaacccttagtaaaaattgttattctgtaataagtaagcagcaccttatcatgacactgactcactcagtaaaccaattcatgggtcacacaacacaaattaactcaagaaacaatattttttaaagtcagaaattaaaaccatcttactgtctaaaaatggtcaagcagagattaaaatcttggattccataatcatgtcaagtaagttaaatactatggcgctttagtctactgggctgctctaacaaaatgccatgaactggactctctataaacaacacagatttatttcttacaattctggaggctgggaagttcaagatcaaggtagattctgtgtgtggggagggcctcctttctggctcctagacggcacctttttgtggtatcctcacatgacaaaggggcaaaggagttctcgggaacctcttttataagggcactaatcccgttcatgaggaccccctcgtgacctaattatcttcagaaggtcccaccttctaataccgtaccttgggggttaggatttcaacatgtgaattttggggaacacaggcattcaggttatagcatatggctaaagaagggagaggaaggaagagggcagagatggcaaaagggagaatgggaggaccaaactcagaagcagaaggtacaaggatatcctgggccatattccgagaaagctagacacatacagagagacgagaataagtggacagtgaatcagttgaaggcagatgtgtagaaacacacaccgaaaataactagcaaaaaaaaaaaaaaaaaaaaaatgagtgagttaagaagagtaaggggtatagtatgttattagtgagttgggtaatttttactttgatgtgtttaaaacatagaccatggtatcagaataaatgatcacatctttactaactttgatacctttatataatagagcttatttggctatctggaagcttaaaattgaccttcttgtgttggaaaaaaagaaagaatctggttatcagaatgttaattttgaaaaccagggcattttgtcgttaaatacttcaaatgttagtctttttattgattggccgctttattacttaggctggagagttccttttatacatagacaacctagttatttattttaattgaggcttccagcctttgtatttcataattccataaggttaaagtttgaaagcaaaaattatttaatcttctctcacctccaaatttatagtccctgtgtttggccagatgatttctgatcattataataagagagtataagaccctacaacaacggtcaggaacaaataggatctaagacttttccttaagtattttcttaagacctaattttttttaatactgagagttctgaatatgttatattttgataattaaaaacattgaaaagcacagagaccaatattcacaaaacacctgggtgtagaatcttagtgaaagccacaaggagttgtgaaaacactgatagctgcatttttttcctctcagtttctccggtacaatgttattggtagtcatacagtctggtgcaaaggtacaacaaaggtgctttaaccaatataataacgatatccaaattcccagcatgagatagaggaggtcttccttactcttctatagctgagccagtttcacactttaaggtttgttacttaaaaatcccctttctatttccaacctttgtgttagtccagtgtctttagctgtaaaaagcctacccacatggccttttcataacaacatgtgtataggctgacaaactgaggggtccagaggcaggccagcccctcatcttggttgcatcagagctctggctttatttctttgcgcggctttgcccccttcttgtatcagctccatccttaggctgacttcacaaaatccctgtgagcagcttctactaaatgcctcctctttgaagttgaggttaaggaagagttggcttctttgaacaccgagcagaagtacccatcttttagacacccatgacacagcctcaggaggtcctgacaatgtgtgcccaaggtggtcagagcacagcttgcttttatacattttaggaagacatgagacatcaatcagatacgcttaagatttacattggtttgatctggaagggtgggacaacttgaagagggacagggagcttccaggtcataggtagatttaaacatattctgattggcagttggttgaaagagttatgataaagagttgtggagagctaggttttatcacacagatgaagcctgcaaatagtaggctctagagagaatagactgtagatgtttcttctcagacttaaggtctgtgttgatgttaacactggagggtatcatgaggcatgtccatccccagcttcccatcatggccttaaccagtctttctggttaaatttcagagtgccctggcccaggagggagtccactcagatggttgcagggggcctttgaattttatttttggtttacacttacaatctaatatctagatttcctgtggttctttttgtactgtttgttgtttctggttttcattaatgatgttttatttcctatttgctttgttattttttattataggctgaacattatatagcaaaattatttttattatataccaaacattatattgcagaattatttgcagggataatttgaggcctaggatgatgttttcttcaagaaaggatgtgtgtttgcttcttccaggtgcctggagaccttaacaatccaggatcacgtcaattcagtttcttaatcagtacatgtgaggacctgtttacttctggacacgattacctttaggtgaagcctttgggctctgagcccaaactaataggagagtagggtaagcaggaccacgtgtcctgccaagggaccccttctgccttggcaagtccaagcctccatgtctttctccttgtccccagtaccatcaaaaagttactctatacttcagcaattttgcttccccctctggaatcaaatcacttacatggaaaaagtgatttcatccattgcactcacctccctggacatccagcctctcctgcatttggtaacttcagttgttagttctcaacaatttatattcaaggagattttttaaaactttccccatcttttcttttttgctcagaggaagagttgatcagaatcacctagggtgctattaccagaagctcattatttcttcaaatatttcctctgtttttgttttctcgttttctgattgttggcatttctacttctttcctctttatctattagtgttcctcacatatggtttaatttctttaactttgtttccttttggaagagtttattgatctgcctttctgctcattaatttgttcttcctctggagccatcctactgtttattccatctgttatttctttagctattatattttctatatgtaatatatctgatttttcttttttgggatttgtggttcttgtttcgtattgtctttttaaacatgtttattcttagttttaaattcttggtccatttgttctaggacttatgcttccaaacctggtgtatgttgttctgttttgttttgtttttctaagtagttgtatccctgtgtctaaggactagccaaggagtggatgtttgctgagaatgtgggcagaacttggacatgtgggctagagtgttcacatgcatgcatagtcctttcaagcatgggatgtgctggaggtgggaagaaaaggggatcaggttcttcccacgtaggagtatggggtgccttacagttctaaatttgaacatgacatttctggccattataaaggtatgttagtcaaggtacaaagatggaaataaatacatatatttatttatttttctgtcgtccaggctctagtgcagtggcacaatcttggctcactgcaacctccacctcctggattcaagcgattctcatgcctcatcctcctatttgggactacaggcatacgccaccacgcctggctaatttttatatgttcagtagagacggggttttgccatgttggctaggctggtctcaaactcctggcctcaagtgatccacccgacttggcctcccaaagtgctgggattgaatacagccataagccactgcacccggccagattgctcttatactttatttctgactgttgaatcttattttttcctctgatatatttcatccatttatgttttacaaatgagtctgtggcctttaccaaaagtgttggttcagaaatagaatgaaatttcaccttaaaaatggaataaactggtaaaaaaaaaaaatgatgtatctaatgaaactagtttggacaaagtctgtaaaatacatctaaatcttaaaaaatacaaaatacggtattgaacacatcatttaaaggcctagggttattgtttaccatctacaataacactcagtagaaaacattcttgctaatttgaacaatcgaaagattcctttggtgtaaagatacttatataatttataatagagttatatgaaaaaattcctgtgtagtttgcaaatgtggctaacaaccatttaaaaatgttggtttaggctgggtgcagtggctcatgcctgtaatcccagcactttgggaggctgagacaggcggatcacctgaggtcgggagttcaagaccagcctgactaacatggagaaaccccatctctactaaaaaaaaaaaaaaaaaaaaaaaaaaattagccaggcatggtggtggtgcatgcctgtaatcctagggaggctgaggcaggagaatcgcttgaacccgggaggcggaagttgcggtgagctgagatcacaccactgcacttcagcctgggcaataagagcaaaactccgtctcaaaaaaaaaaaaaaaaagttgatttagcagtttaatttgaatccatttaaaaagttatattgttcccccttaatactgaatgtttaaaacaaaacaatacaaaacaaagcagaaacaaaccagtccatttcaaataaaagcaaatgtcttccataaattcttaatctgcccagcctagcatgttatggaatggatgttgctgataaaagataatattaggttacagtcttcttcattagtgatttttaaacaaaactgtaatttcctgggaggcacagacatttcatatgttggtgtacagtatttatttacatccctgcttgtttttagaaggattcaggatcataagaaaaaagccagccaagtaagatcagagtcctatgctgagtgggaagattttccaccgttgtagcacatttaaattttcttttttttaagagacaaggtcttgctctgctgcccaggctggagtgcagtggcatgatcatagctcactgcaactttgaactcctgggctcaagcagttctcctgcttcagcctccggagtggctgggactgttgggtgcgtgccatcatgcctggctattttcttttgctttttaaaatttcagagctgtttctcagtgtgaacaggctatttattttattttttattttttgtagagacagggttttgctttgttgcccagagtggtcttgaactcttggcttcaagggattctccagcctcggccttccagagtcttggcttacaagcatgagccaccacacctggccatccatcacttacttactctttatcttgtagcttttcttccaacagaagtcatgagtttgtgctaatttacaaataagaatcttctgaattcagaatatgcagacttgcaaagggttttaccattaactaatctttcagaaaattttttttgtttattcttttgtgcttttcatttatttttttaaaagaaagggcaggaggaatgctttattctgagtgtgtttctttttccttgcctttgttttcttctgaaacagagagaagtagtaacaagtccagagagacttctcctgtccattcagtacctcacttcgaaattaatctgatcaagacactgtttcatcatgtaacttcccacttcagaaaccttcagagaatccctgtggttttgaattaagctcacactcctccgttggtttaatgataacactgcttacctccctgcccacaccaacctctaattacgctcctggagacgctcttcttttccaatatgacatgctcattttccccagacagatgccatgcgttttgttccccctcagctcccacatctgtctgggattacccagtctccttttgttctgtccaaatcttttctatttctgagaattcaacccagattttttttttattattttttttgagacagagtctcactctgtcgcccaggctggagtgcagtggcgcgatctcagctcactgcaacctccgcctcccgggttcaagtgattcttctgcctcagcctcctgagtagctgggattacaggtgtgtaccaccacgcctggctaatttttgtatttttagtagagatggggtttcaccatgttggtcaggctggtctcaaactcctgacctcctgatctgcccacctcggcctctcaaagtgctaggattacaggcttgagccactgcacccggcctcaacccaagtttttacctaccatgtagcctgccttattatcaccaatcccattttcatccttttgatgacttacagttcttgtttatattattattttggcctttaattacataaggttgtaaactgcttcataagtgttcaaaatggaatggatgtccgtgagagcagagattctgctttatatttctttcattcctcaattagtataatgctagattatttataaatgtttataagattgaaatgaaaagcagcaggcattctgattgtgataaaattgaataatattctaagttgattttacttgattaaagctgtttgacatttgccaaatggattcttgatttgcagttgattattgcaacatccattcactgtgaagttttgtaaattaagattaattggcagaatgcgagtttttgaaaatcaaagagagatgctcttattacgtttagctacatatgataatcggactggtaatagtgtttctgaagttgaagtttgtttccgtgtgagaaatttgtggttggcagcatccacaatcatttgctaaagagatagaaacagcttgtgttaagtacaaaatactacccgtagtcttgttttcaaaagtattaatttgaatagcaaactcctactagatagtgtaaagctagaaacgtcatccagatttggttagttttaaatattgaaagacagaatttgagaccttattgaactgaaacgaatgatttcccatccacagggaacaggtggggacttcagaggcttcagaaggtacctgcatgttaaaacataacagcgtttattcagggtgactcattgtctgcttagcttggcacagagctaataatggtgttttctcagtgttggataataactctttttagaagtcatatgcatagtttattgtcagactgtaaaatgatagggctatggaaatgaatcatgcagagaaggctgagaaagggatcatcatgtcccttactgaaggaggacattccctggagggcttctatttgagtggggttaaaatcacaagtttcttctgtcttatcatctcaacaaatattacctgtttatcttttcatcttagtgtcttgatagaggggttcgtattcactgttaatggcgttatatttcaaatgttgacctaccaatcaactctgtagctatcataggccagatttgaagtgagtaacattatttgtgatgaaaccaggttaaatatcatttccaaatcttgtttgaagagaattgattctggtataaacttggactttacattggaagtagtgaaaacatggacattggtgaggacatgtgctgtggccactggcagctaattattcagtttcaacttgaccagtgtatacagaataatttcagatgtctcgtgggaaggatcaagaatgagttcttccaagaagaaggaatcagttagataaagaacaaagtcgggcggtatcagggtgctgaggagctgcagttttctctctgcttgcctctagttgtagaggaagaatgctggggctctaaagaaacattagaaaagcaaaagtaatgcttcctcttggccttgtttagaggcagttgtaggaagttaggcttaaagtagactgaggggtttcagtgccaagaaaagcattctgtgcagaggagtcactgctgatgtttggcctgcaaagcaaacaattgagagaaaagagctaagttttttttctttttgaagggaaaaatataagtaacgtgatttgtggaagtaaggatgttgagactaccccttcattaattttatcggataactatttctttatgccaagttatactggaattttaaagtaggtatctttaataagtttctttttaaattttttattgagacagggtcttgctctgttgcccatgccgaagagcagtggcgtgatcttggctcactgcaacctccacctcatgggttcaagcgattctcctacctcagcctcccatgtagctggaactacaggcgcgtatcaccacacctggctaatttttgtatttttattaatacagtttgaggctggtctcaaactcttggtctcaagtgatccacctgcattagcctcccaaagtgctgggattgcaggcgtgaaccacgacgcctggcttctttaataagtttctataactgtatttaaatatacaattataacttttgtgtatatttttgtttatattaatatttccttttgaagagtgtataaaccttttgatagcactaactgtgaacctaaagtggtaaatgaaaagtgatttgaatggggaagaagggttaataattaacacctcgagcccactgccccattctcaggatgcatacttaacttatgaatgtattcttaaacataaaggttcactaagtattttcgccaaatctctcctgtctgtaaattcatcccgctcacatttactatgatccttaatctcagattcctctacttttacctgaacttaaaactccttccactgtgcttatacagtctgtttatcctgttgagttacagattgacactttggtgcatatcccctgacccttaataaagcctgtgatgttaagcacgcatacatttgttcacctgaaagtgcatacaggtggagggaagagaagattcgtagtttgttgggtgggagattatgtgtggagatttctacgtggctgttgtgaataagaaaaatggttaaacagtggatctcagagatggtatgttaagggaccacacattactggcaatacttaattgaggggttaatgagtcttttttttcctttttttttttttttttttgagacggggtcttgctctgtcgcccaggctggagtgcagtggcgcgatctcggctcactgcaagctccgcctcctgggttcacgccattctcctgcctcagcctcctgagtagctgggactacaggcccctgccaccacgcccggctaattttttgtatttttagtagagatggggtttcaccgtgttagccaggatggtctcgatctcttgacctcgtgatccaccagctttggcctcccaaagtgctgggattagaggcatgagccactgcgcccggccaagtctttttttttttttttttttttttttactataaatagcctgatctagattattctgtaaattaacagattctttcatcggagaccagccattgagactaataataatcttaatgaatggaaaaatacaagtgttttagtgctgatccaggttaattgagaattatatctgttattctgtatttgaatatgagagtctctgaatctaggactaatatttacaacagggttgagtcaaaggatattttgaataaggatgcaaagtgttgtaaaatattagtgtttctaaaaacattttgaagattaagaaaatgttgtacaagtgctaattattataatatatagaagtaaagatatcatagtacccatgaagatccattgtgtaatgtttatggatgggtattaatgaggtaagtctcttctcaggaagagttgcaagtgtgacctggctctcttgctagtgtgctggactctgccacactttcctgtctgtctgcatagatagcaacagtttcttttctgcagcaaggaatagatacagttttgtctctttgaaggaggagagatttggagccagaaagatttacacaactgcagtgtgattaattttctgtaatcttttattatgtcctttgatttatcactgccaacaaaataaaagctaaagtcttactcttgcattcaaagctctatgttggtggttctcagctctggatgcatatgaaaatagcacaagggactttttcaacataagaacaggatggggtttaggcatctgaatagtatctttattctcataccttattgaggatttgtatgggtttagaactctaaaaatacacaagaaatgatcctgttgatttctacggaaatacccttttgtgaattcaattgggatttgcgaaataataagaaatatacatgttggtctgccctcagtccctggcacagagcccctgagacccttgtaatttcctgagtgataggggttgtaggagaatcttttgttctaacgtttgatcgctgcccgggttcctgagacagagctcctgatacccccttgtagataggtggtagaatcttttgttctagtatttggactttgaccgcagttctttacactgaactcctaatacctttgtaacttcctgagtgataggagcatcttttgtcctaaggaggccactcttaggatatagactgtttgccaggggagctaatcatgtgattgattagagagttgggactttaagccccactccttaacctccaagaaggaagaggggctgaaggcagatcaccagtggccaaagatataatcagtcacccctaggtaatgaagcctctattaaaaacccaaaaggactaggtttggagagcttccagatagctgagcaggtggaagttcctggagtgtagcacacctcgggaaggcatggaagctgtgtgccccttcccgtaaaacacaccctatgcatctcctccatctgactgttcatctgtatcttttataatatccttcataaataagtggttaaatataggtgttttcctgagttctgtgagccagtctagcaaactaatcagtccaaggaagggtcatgggaaccgcaattttatagttcgttggtcagaagtataggtgacagcctactacttgctactgatatctgaagtggggagcagtcttgcgggaatgagccctcagcctgtgggatctgatgctatctccaggtaaatggtgtcggacttgaatcagattatagacatccagctgttatctgctggagaattgcttgcttggtgtgtggggaaataactcccgaggcatctggtgtcagagtgaattgctgtgtaagagagtaggaaaaacagttttgttttgttttgtttttccccgcctccatctccttagaggattgcattgaatcgcaacgggattctgagcagtttagagaaaattggcatttaaattacactgaaccttccattttatgaacatagtatatctctctaaatcttttttgatttctttcatttgtattttgtagttttcagcatacagatcttgaacatgcttttaaaaaatattatttaattatttatatttttgttgctgttgtatttccaatagtcttctgctagtttagagaaataaaattgaattttttatgttgaccttacattctgcaatgttgttaaactcacttattatagtgttgttagtagttctatagctttctacatatgatcatattgcctggaatggacacagttttatttctttacttctaatgtgttttttgtttatttttcttgtcttatttcaccagctgggttctgcagtgtgaggttgacaaggagtggtgggagcagtcctcttgatttgttcttaatcttaggggacaagcactcagtctttcttcactgagtatgatggtcaccatgattatttttaaagatgcccattgtcacatggaagaaattctctttttttcctgagttttctgagagtgtcaggaattgatgttgaattttgtcatctctgcatctattcaaatggtcgtatcgcctttctctctttttggtctgttgagatagtgaattatattgattggttttcatatgtcaaaatagccttatattcttgggataaagctccctgggttgtgatttttgtccttatttatttatttatttagagacggagtcttgctgtgtcgcccaggctggagtgcagtggcatgatctcagctcactgcaacctccacttcctgggttcaagcaattctcctgcctcagcctcctgagtagccgggattactggtgagcgccaccacgcccggctaatttttgtatttttagtagagacaaggtttcaccatgttggccaggatagtctcaaacgcctgacctcatgatccgcccaccttggcctcccaacgtgttgcgattacaggcgtgagccactgcacccggcctgtccctttttttttttttcctacatttgatttgctcattttgttcaagatttttgtaactatgttcattagagatactgacttgttgtcttttattgtaatgtctttgtttttagtgtcagaataatgctggccttacccttatcctaaacaaattaatgcaggaacagaaaaccaaataccgacatgttctcatttataagtgggagctaaacatagggtactcatggacataaacatgggaacagtagacacaggggactgctagagtggggacagagggagggggcaagggttgaaaaactaactgttgagtactgtgctcactacctgggtgataggattattcataccccaaacctcagcatcacgcaatatacgcatgtaataaacctgcacgtgtattccctcaatctaaaataaaaattggtctgggcatagtggctcatgcctgtaatccaagcactttgggaggctagagcaggaggaccacttgagtttaggagttcgagaccagcctgggcaacattatggggccctgtctctacaaataaataaataaatgaataaaataaaagttgaaattattaaaaaaagaataatactgaccttataaaaagagttgggaagtgtttcttccctttttttattacctggaagagtgagtagaaatgcagtttttcttctttaaatgtttagagatctccagtacagccttcagaatgaggagctttcttttttggaagactttaaaatgtagattcaatttgtaatggatatgggtctattcagtttatctgtttctcttgagtgagctttggtggtttgtgtttttcaaggagtagtctgtatatatctagttcattcaagttgttgaattcatggacataaaggtttttaaataatctttctttattatttctgcaatgtctgtagaacctgtggtgatatcccctcttaatattggtaatttgtgtcttcttttttttcttagtcagtctggcaagagatttctattgttattgatccattcaaagaagcagcttttggttttattgatatttttctctatttttctgttttcagcatcattaatttctgctcttatttatagtatttttcacctttttcttgttttgagtttaattttctgttctttttctagtgtcttaagttggagggttagatttgagaaccttcttcttttctagtataagcatttttaatacttacaatgtgaaattacccaccatttcattcctctctctaggctgtcttcttcccaccctggcggcaaccagtgttgttattttctcaatatcctgtcacatatagtttatacatatgcaaacaaatatattatttttctctctcttttttaacatagttgttagataaccttctaacaattattttgttctataccttgcttttttccccttagtctgccttgcatatgattctgtctttcatatataatttcttattctttttgtgatagcagtcttcactattaatggacattttggttatttccagtcttttgccattagaaacatgctgcaaaaaatgactatgaatatgcacattcaaaaacatcattttaggcttctcgagtgtgtaaattccatgtgaaaagaatggaacagttttctaccccctttatttctctcctttttctgtgtttagataatgtgctgtctcttgataaagggcctacttggtatagagagaaagaaagaattacattaattcttctgcttggtctatccaaataactccagggatattcagacttattttcttaataattcctttattaagtattagaccaacattaatcactttattttagtgtattatttttctatttagagatgaggtctgactgtattgcccaggctggtcccaaacccctggacttaagtgatcctcctgcttcagcctcctgagtagctggtactacaggcatgcgccacagttcccagatataatcactttagaagtcgataggatcctaaggacggccttcttcttgaaggcatttccaaggtgctgtgcttttccctctagattattttcaaactcctcagcattgccagtacccttggccctctgtatctgcagattcccatgtgtggattcagacacccatggatatggagggccaactctagaggggacttgaatatccgtggattttggtatctgcaggggtcctggaaacaattgcccatgaatactgagggctgattgtatataatccttagaatgttatcagttcttgtgccactggtttcacttttacccacaagcagcttttttttctttcttttagtaaggaatatcaataagtcaacaagtatttatttgtacctatagtataggcagtgactcatgttttgtttgtcctgctcatcgaatagtttaaaatatagagtttgaaaatatccctcagtaagagaatggataaaatgcagtatattcatacaacagaatgctgcatagcaggatgaactaatatatgtaacaacataaaaaatcttgtagatattttgttgagtgaaagaagccagacacaaaagagtgcatactgtaagattccatttgtatgaagttcaattgctgccaaatctgacctatgatactagaagtcaggatagatgttactgggctgggtgcagtggctcacgcctgcaatcccagcactttgggaggccgaggtgggtggatcacctgaagtcaggagttctaaaccagcctggccaacatcgtgaaaccctgtatctactaaaaataaaaagattatctgggcatggtggtgtgcacctgtaatcccagctactcgggaggctaaggcacgagaatcacttgaacccaagaggtggaagttacagtgagccaagatcacaccactgcactccagcctgggcaacagagagagattctgtctcaaaaaaaaaaaaaggatagaagttaccacggtgggaagtgggtttaggaaagaggtgcttctgggtgctagtaatgttctgtcttttgacctgagtgctggttagttacctgggtatttattttgtgaaagttcattcagtgaactttaaatgttcatgagggaacattttgtgaaagttcattcatgaattatgcacttttctataggttcattatactttaatgaaaagttaaaaaggataccatacagaattaactaaaggcataatcgttgatcatggttagagcttaaaattatataaaaccagagagattacttactttttcctggcacatatactctctctctctttaaagtgatcatttaaaaagtaatcaattatgaaagtgataaatattacattacaaaataaaaggaagtgtagctaaactatttctttaaaaatctttcaagccaggtgtggtggcatgtgcctgtggtcccagctactcaggaggcgaaggtgggaggattgtttgagcccaggaggttgaggctgcagtgtgctgtgatcacgccactgtatttcagcctgggcgacagagggagaccctgtctcaaaacaaaacaagacaacaacaaaaaaaatatagttcacctaagtcagacttcacactgcttagactgaggacagtctttggaaacagtaacttatgacatctacaaaatttatctcattatttttgagatttctgttccttttattattaattaaggtcagtgtcttttcatgcacttaatagtcatttgtatttcttccatgtctattttgtgtatgtgaatgcagcttccctttttctcttgtgtctttttttcttttctttttataaagttgatttgttttgggtcagtggttctcaattctggctgttttgaatcacttggggaactcctaagaattaccagtgtcaacgccccaccctaggccaaataattaggatctctaagggttgggcctaagccttggtatttttaattttgtgtgtgtgtgtgtgtgtgtgtgtgtgtgtgtgtgtgtgtgtgtgtgtgtacattctattatggaaatgtttatgcatagcaacatatataacaagttttttttttttttttgaaagagtttcgctcttgttgcccaggcaacaagagatgatgctatctcagctcactgcaacctccgcctcctgggttcaagcaattttcctgcctcagccttctgagtagctgggattacaggcatgcgccaccacacctggctaattttgtatttttagtagagacggagtttcttcatgttggtcaggctggtcttgaactcccgacctcaggtgatctgcctgcctcggcctcccaaagtgctgggattacaggcgtgagccactgtacccggcccatcaggcattcttaatcccactctggacttcagcaatagtttcttttgttgcttcatctttgtgggccactttacttcaggttagaagctgtatccatcagagttcttagttgtaagtaatagataccatctctggctaattaattaaaagggtgacccacagattctgtaagtaggttgggaaagtaggcttgaaaactacactgctaggaacatagtgcaaaatgattgcacagaactctcatgaagacacctctctggccacagaccttgctgcttgtgctccaaacaccactgatgctgggctctgggtgctgccccaagaatcattatctctgctgccccagaacactgaatgtagctgcccctactgctgccatccccactaggtggattcttctggagttcctgcttctccaagttaatatttacccccttgaaatctagcatagtgcattttattggtggagctctgttatgtgcccctatcctagtttcagagaaagatgagaaagcaaatatatgtttttttttccttctttgtactttagtagtggaaagtctacttgtcccataaggtagggtgtgcttaaatgtagactcagctttcaagtgcttggtgtcaaaaaagaaagtccactgtaaaagctctgtatcagtcttagaaacccattccttttaacctaatgatctatcttataaccactagcttttcttacataatgcagtagatatttgatgcaggaatatgccttatttatgggtgccatattgctttgtacatggagctgtatctttatttctgaagaacaatatattttaaaaaccccattctaattttagctagttgcagtcattcctattttgttttatgaataaactcaaggagatgttatagttaaaagctcaactgtaacaaatattgatatttcctggtggtgttttcacagataattttctagcgtataggctatttgccttttttcaggtgtgatctttctgtatataaagacagtgtggaaaatgggaaacactgtattagaaccattgtggatataaataggatgatacattctttttctaaacaaagaaggtatagctctcattattgcaaaagtgttttactctaagttacaatgaaacattgtgaacacaagcttttaaaaattaacacaaaaagcacattcttggcttacctgtgataactttaacaaccaactagtgaagtttttatctgctgtgaaaccagggcatagttgagtgaatgaagccgtggacactttgggtcaggggcctcggtgatattgtcttggttctgctggtggtgtgcagcattaccttaggtgattcatttatgttcttctacatttcgtctttccagttcctaaagaagaattaatgttactatcccttcctcttcacttttcttacagtggtgtattagaagatctgagacaggtgtgattgagcttcttagaataaacacgtggtaacataaaggttgttacagtaaaaacaaagatgaatgtactataaaatcttcatagtaagatgcaccctgttgtttagtatgtaacaagaaaccattgttgtaatatcctgatgtaaggttatgtttctgaattatattcaaaccaggtggcccctcagttttgaatacttaagaactacagctgtggatttaatgggtttaattaataggaaattcacttcaggttcatccatttgacctctgctacatagccaacagaaattacatagaatgtttctaaaacttccagaaaattcaggctagctttagcattcttcacctagcataggtgaagtcttaattctacaaatgaaaaaaaaaaaatccagggtttctaaatgtggtaaaattgtaacagacaaggtcaggaatcaacttactgggttgctcagtatttagtgatacattcgagtccttttgtggtttcagatagcaattatttctaatataatttattttgcagtgagggccgaggcaagttgacggtattttcagttaaagctatgttagcaaccatgtgtggtggaaaaatgctggacaaattgagatgtaagtattttcatattatttgaaaaatgccattttcaaattaggacttttaaatgaatattgtcagaattttgaatgatgttatattgagcttttaaaaaaattaccatgtcactcacgctgcagcagctggctcacagtaggtgagttatgccacctactgttcagatggaaaagttggttaatttaatttattgttagtcctttttagtgagaaaatggaaaagactcagaatcataatgctgacatttaaaaacttattttagaaatgttttccacattattaaaattatgcttgaaaatgattatattgagaacttttagttaaagtaaatttgattgcttttactgagttcggtctggtttagctcttaataactccattcttcatcaggtgatgtttgctgtgattacattattccttactactctagagtcagccacagttatttagaagctgatgacctgtttttttaaaaaaattcctgttatctttgctaatttttttttaaccattagtcattttggcattttaccattcattagatactataagaaggtgattagatgaaatcaaaagagatgaaattcacaactatttaattttgctgcttatggtttttatttattcagttattagttattaactccctaagatatgccaagaattgtgctaggtgctttacatgtattttctcatggaatccttaaaattcctttgagcagcaggtgatattttcttcattttatcgatgagttaaccaagggggcaaagctggggttttaactcagatgtcagagccctgttctgagctatgtgattgtgctcccctgtgctagtgctgtagcaggagacacacgtgtaatttcagtacagtgttcagagtgccataaagcagtagccacagagtaggaaactggatgccagctttcaagggatgagactgaagtcttaatgaggtagtgtggtagtgtggtaccctgtgagcccggatttggatgactgagtccttgcaatattcctccatgcccttttttttttttaaattgaaagatacagaggtttgatcagattcaagtattaatacaagtttttcggcaagattacttcataggtgtatttgttttttgtgctttttcttactttaccatgacactgaaagttggaaagctagatggcccattagatatagatttagatattccaaagaaagatcttaatgtatttggtcaactgttatccagtttatcttcatttcaaagttagctgcaatatagaacatgtttttggtaataagaattatggttttatttaaatattcttctgaggtttttcacatggtatatcccaaaatattctttgggctgaaattccttttatatttttgtaaaatataaaaatatgtttttctgaggaagataatatgtatgaaagtatatttcatcaaacacaaagaaaagttgtagtcttgtctaatttttaatgatgctgataccagataaagaatatatataccatctttattaatattggggagactggttgaaaaatacagtagtagaaaaatacattagcagaaaattaactgtattctagatgactctggaatctttaaatttctttaaagtctactatatttacatagagccagctcacctggcatatggtaaatacttaaaattttgtcaaatgtaaattgttgattgaataataaaattactccagttctgcgttataactgttagtgaaaaggcgcaaattctagttctcggtttggaagggatccaggtgatagcagtttttttgatgtggcttctgaactttttggaggaacacgaagtgaccaagattgaagtggtgcaaaagcccacgggccaagccaaaggtgacatgtcagcatgctcaggaccccaagtcattgcaatagtgtttggatggctgtgatacagactgtgctgggttaccaatcactgtgtttatctgattcaagtagatttcaagtgtggtttatcttttccttgctaaaaattatagtttctctgctagttgtaggtctgtttcattatttttgttgtactgtaattatcttggcttgggcttgagatgttcaacataagtaaaatacttgggtagggaagcctatctctactttttaatcttccaaggtggaaaacactttaaaatgtggcttgccccttccattttaaacagaacttggctgggtgcagtggctcatgcctgtcatcccagcactttgggaggctgaggtgggaggatcacttgaggccaggagtttgagaccagcctgggcaacgtagtgagactgtgtatctataaaagcaattttaaggccgggtgcagtggctcccgcctgtaatcccagcactttgggaggttggggtggatcacctgaggccaggagtttgagaccagcctggccaacatggtgaaaccttgtctctactaaaaatacaaaaattagctgggcatggtggcacatgcctataatcccagctactcgggaggctgaggcagaattgcttgagcccaggagatggaggttgtagtgagccaagagcatgccactgcactctagcctggccgacggagtgagactgtctcaaaaaaataaataaataaaaataaaagtaatttaaaaagttagtttggcatggcagtacatacctgaggtcccagctcctcaggaagctgagccaggaggatcacttgaggctagaagttcgaggctgcagtgagctatggtcatgtcactgcactgcagcctgggtagtggagtgagactgtctcaagaaaagaaagagagagagagagagaaagaagggagagagagaaaaaaaagaaaagaaagaaacgagaactcactgattatacttttaacattttcatctcttaaggatgccattttctgatgcatttaggatttagggctgattgtgaagcttggtttgtctactcctcctattttgagactattatgctttttcagttcttgagttttttgttggtggtggtggtggtggtggtggtggcggcagtggtttgtgtatgtcctttatcactggcaaatatgatgttatgtgtttttggtgctccactctctggaaatctctccttgcttctgacttactacttttaatatgctacggacagagaagtaataaccaaacctcttagcattctatttaaaataaggatttaaagtgattgttatgagagaagcacttgagcttgtgtagtatgattgttagctttggctattttcagaacctttccctccttgttttctggttctcagcaatgtcctacttagttgaggtggctgaataattgtgcagccaaaagagagaagtaacactgtattgtaacagcaaatgatctttgattgtttattcactttctcatacctaattattccattgttttggttcttcttgtttgctccaacctccttctactgactggactctctgttgttacctctattaatgctcctgttatattaagttttctcatttatggaatgttttagcatttctacttttttttttctgctttgatcttcctgctttttactttcttagaatttttcctatgattttctcctctctaccttttttatttgacatggggtttttggttttagtatcaagatagcatttgaatgactgaacaaatatttgtactttctgtttaaaacatttcttagatttttcagatttgtcttaagagagtttctgtctccaggtagcattcatttacagagatggttcattgttgtggccattagagactatgtcctagattcggaggtaacttttatcaggattctaaataccaatgatttataatcggaatatggactttaattaaaagcacaatcaaaattcagtaatgtcagaaacccaaaatataactcaaggaaacaaaatttgtagactgtaaagcccattatgtattaaaacatgcttaattatcaattaatttgactgtgcaatttatttactttaattctgctatttgttttcgaagaaatttagtctccttattcaaattgcatctggttgcactaaaaggagcaaaagattcataaatttattttaaaattcgttaaaaagctggtgctactattttgaaaggcagttcaacaatatgtatcaggaaggctttaaaaagattcatattcattcactcagtctacttcttgagtttatcctaaggaattaatcagaagtgtaccccaagttttttgtatattgcaacacttatatgaaaactggaaacatctttagtgtccaaaagtgagaactcagttaaattttgggacacccacatgattgaatataatgcctttaaaaataggttttagatcaaaatgcataagtgtaatgtagttttaaacaaaaatttgctgtgcacatagaaaataagaaatataccaaaataataacaggggtttttctctgggttctaacacaatggttttataataataatttatattatttatctttttgcatgtttttgatagaccacactatcagcagtcagagaaaagatgacctgagattctttctgttttggtcagaattgactattcctactgatgtttcaactgtttgcttccttcatgtttcattagcagactgtagaagggcctccctttgaagttacagttaaacagtttcacctgttcagattttagactcctctgctgtagttttttaaccacccatggctgcataattatcctcactggtttctgttaaccatcccttctcctcagtagatggaagtgactgtttaatctaaatgagtgatggctagatttacatttttcagataaccaaaatgttttagaaatggaaggaagtaaaagataagccttaaatatgtattttatgaataaggggaaaaaaagaagaaaaaggaaaacaaaaaccaaaggaggtctggagccttgtctcaggtggttcctggctgagtcaacaccagaagcccaaggcatgcagactcccaccctccagcctcattgcagcttaatgatgtggcatattaataagtttcttttttttttcttttttctttttcttttgagatggagtcttgctctgttgcccaggctggagtgcagtggtgtgatctcggctcaccgcagcttccacctcccgggttcaagtgattctcctgcctcagcttcccaagtagctgggactacaggcgtgtgccaccatgcctgactaatttttgtattttcagtagaggccgggtttccccatgttggacaggctggtcttgaactcctgacctcaggtgatccacctgccttggcctccccaagtgttagaattacaggcatgagccaccgcaccccgccagtggcatattaatgagtttcgaactacagtatgcactcgggcctagttgtgtttaggtatttatcaacatacagatgtgtgtgcatggttttgtgggttaggttgctgagctggtagaaagatgacaggcgatgagagtcatttgccagggaaagcaaacatgtaaaagaaaatggctttctgtttatagactcatttcttcagtctaaacagccctttcatctgcaaaaaaaataggtggctagtcatgtggggatgaaaggggagttgaaatagatggatagatccagccagtaaaactagggtcattatcaccaggaaaaaatcaagacatatgtgatgatggtggctcactagcatttttttgcttattacacaaaagatattatagaatattttaaaaattgcatacacatgtacatttaagggcttgattgtgggtttttcacaagggagaaagcttcctttttagctggaaataactgttagggaattagcatactttcagaggtgtataaatagaaagagaattacttgggaaattaactggggatgtgggaagtaatttagtcccttaataccaggagggtttagggctttatttaattagagtactagtttaatttttaaaatattttcattaaattttattattttattcacttctttgataagatccttttatatgtacataggtaaatcacaataacttaggttgattgttaaacttcatttaagatttaagaattagcaatcatttttaaattgtttttcttagagataaaagcctattcacaaaaaaattgttttaaacccataactcaagaagtaatgaattatttcactgtgccttcagttttggggtctagcagtatgtctcattaaagcaaatagacatgtttccacttctcttattgtaatataggcctgttatagtttcttatgaataaaaaattttgtattactttgaatctattcatatgacgtagtaactaagtataactgaaataatacttttttgtgggagtggttagtcattttactatccagtcactcctttttattactctgaatgagttaggtatagattcgttggtgtgggtgtatacctacacatttttgtgattgtgaagctatacatatatatattaatgtacttgaaagctaaagtcactggtcctgaatatttccaccactagtggccacaggttaattactcattagttaattagttatgaatacacagagtggcgatagaaaacttgactgagagtggcttaagcagattgggatttatttttctcatgtaaaaataagtccaaacgctgagaagttcaaagttggtaccctgacttatggctgtcctcacagacttcacttcttcccgtctttcttctgccatatggccttcgtccttaggatcaaaagatgtttgccatatcccaggcctctgtacttactccaggcagaaggaagaaagagttgcctctatgaagaaagcaaagggttttccagacatctactccagcattgcaatgtgcaaaggaggctgagaagtcattcgttaagtggcacatagtcattcccagcagtcgggctcagctagtgagtgagaaggggaagaagatactgaggcacctggcagtgtctgccacctcccatgttgaccctttgttttcattcagattcaatgaacgattattttcctccttgtaagactagcagctatttatttatttttgagatagggtcttgctctgttacccaggctggagtgtagtggtatgatcagagctcactgcagcccccaacttctgcactcaagcggtcctcccccttcagtctcctgagtagctgggagtacaggcacctgccaccatgcctagctaatttttttttattttttgtagagacaaggtcctgctatcttgcccaggctggccttgaactcctgggctcaagcgattctcctctgcctgggcctcccaaagttctgggattacaggtgtgagccaccacgcctgaccagcagccagctatttaaaggttaaatcatttatgttcttccctcctttgaagagcatcatttattcatatcattggtaacattttcaaagttctctatctgcagtctagaactgtggtcaaatattgtttctaactgtctgcatggtagttccacttaaaaatttgctagtttgggccagacactgtggctcacacttgtaatcccagcactttgggaagccgaggcgtgcatcacgagatcaggagattgagaccatcctggctaacacggtgaaaccccgtctctactaaaaatacaaaaaattagctgggcatggtggcgggcgcctgtagtcccagctactcaggaggctgaggcaggagaatggtgtgaacccaggaggtggagcttgcagtgagccaagatcacaccactgcactccagcctgggcaacaaagtgagaccccgtctaaaaaaaaaaaaaattgctagttagttcaaacagtaatgttcaaagctaagtgtaatatctttatctttgatttgcttatgtcaatcaggatttgtcatcatttccccaaactagaaacttaaaataatcctaacttttaaacttcctttattccgtaatctagtttgccatcaactgcagttccttgcattgaaatgccttggacttggcctcccctgtccccgcacacactgtcactgctgtaatccaggctcccccacaacctcctttgtgcattgtttacaaggtttcctagctggtgtctccaattccattctttttcttttattcattgtgtgccggtcattaacagtctaattgccttgaaacctagctttctaaaaatttgatctctacttaaaagtttttaagctaaatccagattgcttccctctttcatcgttttcttttataacagaaatactcttcctattcagtctttatttttctttttttctcactataaattggctgttgtagaattttttcttcaataccctgtttcctgcttatcaccggtaagagatacaggctgcatgctcctgtcatagacttttatcctactcttctttagtgccccccagtccctatcctcaacctgttttgaccccatcattccagatcctctctttcaaggcctagcttccaaatgtctttattttagaacttgacaattcctgcttatgtgtttttgtatctattctaaattatattttgaaggagtgtggtgtaatggtatttattttggagtcagataggtgtggttttaaacttgatttggcctctgaactttttgaccttaagcaagttaacctttctaagctgtaatagtagagtaatgcttagtgttagagtttgttgcatgagagcaaaaacccggaataacagtatcgtaaacaaagttgaggtttaattttctctcacataaaagaagtccagaggtgggtagtccagggccagtatggtaacttcatgttcatctgggattcacactttgtcttttttttcccctaccattctagagtgatttctatatcaagattgagattaccacatagtgcaagatggcagctggagctccagctatcatagctgcactccaggtagaagaaggaggaagggaataaggaacaagtggcctgcttttttggctcagttaggtttgtttacctagtcttctggaagtcccctacaacccttctgcttacaagctcattttagctagaagttagtcacatgaccgctacttgctgggaacttgcaacttgttagttggtacattactgcacaaaataaaattagtgttctgttactaaggaagaagaggataatgtggctactggcagctcagcatagttaactgaagtggcgcctagcacatggtggggcttatcatgtatctttttgcctctgttttttctgttgtcagctcaaattcttctctgtttcatgtgtatcttatttttccagctacattgaaagtttcttgggggataaggaccatttgtcatctttctctgttatgcttctaaacacctaacagagcgcttgcacttggaccacataataggaacttaatatgtatttgttaattaatttattttactttctactagggtcatcttttagtctcttgctggattttttcccccatatgggtatttaatacttttccatcaactgtaaactagcagctgtcatgagaggacacactgaagattttcattcctttggtaatttcttcttttctaatgccttaaaaattgccctgtggatcaataacctaacattttatctttctttaattagtgtattcagaaattttttttgacctgatgcttcagtataaattccccaaaattgaatccaaaaagtaatgcatgtatgtatattacatatgtctgttaaataggtatagatctctactatacctcttcactgtgaatatatagaatatgaattttcttttctttttttttttggagacaaggtctcactctgtcacccaggctggagtgcagtggtgtgatcatggcatcacggctcactgtagtcttgacctcctgggctcaagcagtcctcccaccccagcctcccaagtagctgggagtacaggtgcacaccactatgcctggctaatttttaaatttcttttgtagggatgaggtctcactatgttgcccaggctggatgaatcttcaaaatgctatgtttgaaaagtcctcaggaaatgatttttctgtgcatatttgacttactaatgtttgtaaggaagttcaacagattgaaaaactgcctacgtcacatttctttgttaaattcttttgacttctggttttcttttactccccaactgtggatgagaagagaggaatgattggagacaggaactccctgcaagcagataaagttggagtaatattactggaagattctttctcatctgcttgacctgacttaatataaaaatagggtcttacagtatcaaagtgtcttggaatagaagactttagatgagttacttttattctgctttggaactcattagataaatattttaaatatgctctatggctccttcagatgtgttctttcacaggcatgcattacatcatcagtatagaatatacaagtataatacaatttctttcataccctatcaccaagatgctaatgtatttatatactcaatcatgcatatgtcttatataaacacatgtggagatactaagagataaagatatgctgctgcaaattcttcttggaacaaagtgaggtataaataaataaaagttatatatcatctagttttaaacactcaaaagtaggatagtcacacatgaatggttatttgatgtttaagtagaatattaagtgagtggaagagaggggcctcatctgcagggtagccacacagtgttaataaggatgagaatagttttaatattaactaaaagtcacaataattttatgatacttttttaatgatactttttgtttggtatacaaatgacatagagccatttataaaaagctgatatttccttatagcttgactttatttggttttgttctcatagatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcaggtaaggacagttttatagaatctagggctagaagagcgctcttccctcccttcaccttctaacagattttgccagattgcttccagtctagtaaggtcttgagtaggggaggaaaaaagctttaaaggtggtggggagtggatgaataaaagcggggggtaaaaattcacctgaaaactcttacgggggaactgggggtgggggggtggtgtctttggaaaaaaatgaaatattttaaagaaaaatgtttaagaacaagtgtgtacatttttgctacaggacatatattactttttcaaatgagttcttgaaaccatgagatgagggaattttgatataaaactgtaacaatactgcattgtttcctgagtgctggagacagggaacgctgtatagctctcactcgccagcataaaatccctcaagggtacactaccattttcatattagaaaaagatggatttgatttccttctggtggtcttgacagagaggctggaatgagtgtgtttctgagatcttaaccatgcttcagagaaccgtctacacctaacaaatggttgctacagccagcgtccatgcctcagccacaggatagacactggctgcagcgtccatttgttaacgtagagattagataaaagaagcttaatgttaaacttacctagaaagttctgtaaaggaattaaaaaacgttttgctaaaactaataggtaaaaaattaatggaaacaggatattgacatattctaaaagtatctccccataagatatttattaattacaaaaagaacatagtaaatttacaatggagaaactgatcagatatcactttaccaagtgatcaaaatccctatcaccactaaagggataaactgataccgcctgcctcctgataggacgcattgagaagtactcaatatcacttctccggtaactcctgccaagaaagcataacctgaatctcatcccaaggaaacatcagacaaactccaatgaaggaatttctacaacctaactgaactttacacttcaaaagtgtcaataatatgaaagattaaaaaagatgaaatgttctaggttaaaagagtttaaagagacatgaaaagctgaatgaactcacaagccaggattttctgttgctataacggacgttattgggacaattggaaaaatctgaataaagtttatagactggatcatagtattatgtcaatgaatgttaacttcctgattttgatatttgtacgtaattatttaagagcatgtcctgttttttaaaacaattgaactatttaaggataaaggagcatccttctgcagtgttaacatttgaggaatcttggttaagggaaaatgggaattttttggtaatcttagaacctttttgtaagtctgaaaattatttaaagataaaaaggtaaactataaaaggaacacatctaaaagtttgagaactgaaaggatgttgtaaactagattctcctgacctgtgatactctgattcaaaaacgaatgaaaaacacatgcacacatggcccctccccacctacatacttctttacatttaaagttaagaattcatggttatttgaattcagactttcaaatagtatttagtttgtttagaggttattcagctttagcactgaaggtggtacccatgataatggagaattatttttagtaacatctgaggagatattcttcccaaatttgtgcacactttgcctgactggttttgtgcagatttgcctctatgcactatttattttttctttcagcataaatggcaatcagcatcagcttttagcatattaaaaatatctccatgcttcgttctaatgaaacatagttcacattttcccccccgaatatgcattttcaaatgatgtgaggttgtctgaacataatcctggtacaagagtgtccttcaggtgttaacgtgcccttcagggacgtaagtgaagatgagtatgatgaagtcacagctcttctgcattttttatctggagcccgtctcactgctgctcctgctgctgccttggaggtatcatcaccttccatggtggcccacacaatactctggggtaatcttgtgtatggtgtatacatggcttttcacacaagatgcttcctggaggtcaggctaaaaatggatcaagttctggaatggtactcttaagcaaaatggtattggaatggggaagggaatttgtacaaagaactctcagtgatgaacactgagaaatggatgacagttatgtggggtataaacctaatctttaatttaattgcaacgttagtattccgatgagaatctggtgttggaataacagtttaaaatgttgaagaaatttttaaaagtgcagttgttaattctaagaatgctatctaggattctgcaaattaaccttatgacatacataattgtgagggctttgaactcacaacctgatcattactttttacctgcttcattcatattcctgtaaaaaaaaatcaatctgcatttttgtatatgtcaaatttggaaaagagaagtttatctcagtccatgaaaatgttaaaaaagaaaaaaccctcaggggaaatagaaatcactcatagaatatactgatatattgaccaagaagtgagacagcttggacaaagtttcatgctgcaagagttaaattcaatgagttttgcgtttctttttgaaaatgggcttttctcatggtttgttttgcttcagtatgtgtttccttaatgagaatcagctcttacgtcatcagatagaaaacaatgttgatgcaaattagaaattgcattgttttttcatatgcactttcccccagcattttgatgttctgggctgaacaaaaaagcgatcacaattaaagagaaagtatgactattttaagaaagaagctgaaaatcctgcagtaccttcctttagggagagaagtgactggtttcaaggacccatgagctgcttcactttctgcagtgctgtgatgatgaagctgcagctgagtgaagaggctgtgaagacgttttgcctcctgtgctcacatgatcgatggacagaattaagctttcccctggatccgatatctagttttgatgaaaccgatctattttggaagttgtatgctcgtctcatgaagaaggaaatcagtggctcaggattgaaggctgaaagacaccatccgacagtgataccagtgcatgcacctggagggatttagtttggctgattatttcgtttgtcctctatttacaaagccatgtagattcttagtggttgttccaactctgttttcctcatataccttatgatttttaagtccacagtgttgtactctgcgcacctttccattatagcattttgatgtaaagaaatttcagcttctttcttaatgtaacacattacagcagaaatgcttttttttaatgatatgaagagaattacacattggtttattttaatatagttttaattcttttttaaaacacatttttttttttgcctgggaaactaacccaaaataaggtctgtggattatgtagtttagttgtttttaaaacacaagagaaattagatgcgtttataagttaattcagcagaacccatctattaggatagctaaaattaaatactgacttcgaatactggtaaagatatttggagtatccagtactctttacaaactgcaagaagccctggtggtttcttaataaaactaatctgacacctcctcatgacctagcaattaaattaaaacctaatcctaggttttaagacttttcaggagtgctcttatcaactatattcatactagccccaaaccagaagcatcctggatgtccattattaaaaaaaattggggaaaagctaatttaagagatggtatgtctggagtttgccccaaaataatgaaggctggagggaaagcgaaagcaaaaatgaaaccaaattagtcatatgttaagaactgttgaagctgggtaggcatatttttttttttttttttttttttttgagatggagtctcactctatcacccaggctggagtacattggtgcaatcttggctcactgcaacctctgcctccccggttcaagcgattctcctgcctcagcctcccaagtagctgggattacaggtgcctgccaccatgcctggctaatttttgtatttgtagtagagatggggtttcaccatgttggccaggctgatctcgacctcctgatctcaggtgatcctcctgcctcagccacccaaagtgctgggattacaggtgtgagccagtgcacctggccgggatgggcatattatactattctctctactttgatatatttttaagaattttaataatagaaaaattgtccttgcaaatttgtgattgtgattattgtctgaacatagtagagtattgttatagcaccccaagactaatactttggtgagtagcccagatatattaacattcttcagagtttacaaactaactgactttcgacgcttaaaagttgtttaaaataagtagtaaatgtatttaaatttctccccaaattttccaaactttagagttttggaaaatgcaatatttctccttagaaaggagatgctatttgttatttattaggtcttcatattaatggcatctgtgtcccatctagaacagccactgccacgatgctggctgcactgggggaggcgtggctggggctgcatgctccatagagctggtgggagccaggaacaggcagaagctccaccctattctcagttgacagggtgggagcttcgccttccctgggcgcagctgcagccggtcaagccatggctgcagaccaggcatctctgcactgtcaggggcctgggaaggctgcccttgcccctgcaggcttggaggtgtctgctcccgctgcctggcatctccctgctcccgctgcctggcgtctccctgctcccaacacctgctccagtgtcagagcgaggctgaggccgagctcgggcactgttgcagcctggccaggtgtgcacacgctcggggcagcactgacatgccagccccctgccacctcagcacccccggactttgggcactgatgagcatgggaggaaggccacgggcctgagggcagcttggcactggcctgcaggtgccccttggcacgaacacctgggtgccatgaacagcagtaggaggcagacaggcccctgggtggaagggcgtgggtccccggtgaagccccaccttcaagacagggagggcctgaagcctgggggtcgggctgctagtcccatggactggagtgggaacttgtggtgctttttccaagcctacccatggccacccatgaacctgtcagcatgcgcttcctcccctttaagacccacaaaagccctaaactcagccaaactcgaacaaatgattaccagctgtggagaggagctacccaccccagagtctcctgtctgctaagagctgaagagatgatgggacaaccagctgcagagaggagctaccctgccagggtcttctctctgctgagagctgaagagacatcaggacgatcagctgcagagagaagctacccactccagagtctcctctatgctgagagctgaacacttgtcaggacaccctggctgtggagaggagctacccattgcgagtctcctccgaactgttctattgctcaataaagttcctctttgccttgcttaccctccacttttccacatacctcaatcttcctgggtacgggacaggaactcgggacccaaaaaatggcaagtctaaaagagctataacgtaaacagggctgaaatatgccccttgcttgccatgttgtgggcaacaagaagaagaaagaaggagaaaagagctgtacccctctggggagcccagatgtaggagctccccaggccggggctgtaataccctccttggggctctgtggttcctggcatctccaagcttctgggtgccaccgtgtttgctggtgccagctgtggaagcagcttgcagtatgcctggtccagtgcaacctcacagagagccagggcccgtgctggtgcctggagctgcctgccccactgcagctggcatgcctggctgtgcatagtggccggaccccacactccttcacactcgcttcactgctctgcacatggctcgcccttggtaggcatgggatccaggctggtagcgtgagccgagtgcagcctgccaggccgagtgggtggaacgagtccagtgggcccaagcaaaactccggcaaaggtgccactggccacaaaggaaaagcatcaccccaggaatcctgtaacaatattgactttagttcgaagagttcaacccaccttgcacggaatttttaatttgatgcctatctttatgaaaaggaaacctgaggctgggcatggtggctcacgcctgtaatcccagcaggccgaggtgggtggatcacctgaggtcaggagttcaagacagcctggccgacgtggtgaaacctcgtctctactaaaaatacaaaaattagccaggcgtggtggcgggcgcctgtagtcccagctactcaggaggctgagataggagaattgcttgaacccaggaggcagaggttgcagtgagccgagatggcaccacagcactccagcctgggcgacagagtgagactccatctcaaaaaaaaaaaaaaaaaaaaaaaaaaaaaaaggaaaagaaaaagaaacctgaataagcaaagaatggagagaaagggagaagtgagcagataggaaagtagacacactcttacaatcagtgtatgcaggagatactgttgataacactttattgggcaccatgccacatttcccttgattcacggaggcagtggcaattgtataaaaatgggattatactattgctggttaattttaagaataacaacaatatttcatgcctggaggtgtcctccgattgcatttgacaaaatattctctccagctatgtagcgaaatgatttttctcctcactttgaagtgagatgtcttttggatgttctgactttgttttcctggacattgaatagagtttggcaagcattgcctggcaggtgtatctatatttgttatttcataggtattctaattaaggagattttataatctccgttagcaaccctttgctactgtgtactttggtgtggattagtagtgtttcattgatttgaagacactttttcatatcttaatatttctgatgttgagatatatagccaatgatacctcacaattgcagttggttaggcagtggttatgatgggctgtcatttcctgcacatgtgtgaacttgatcatagctgatcatttgttgtcacttcaactgagttgtatccacttttggcactacatgtgttgtcatttaaaatgtcctcagaggccaggcacagtggctcacgcctgtactcccagcactttgggaggccgaagcaggtggattatggagtcaagagatcgagactatcctggccaacatggtgaaaccccgtcactactaaaaatacaaaaattagctgcgcgtggtgcgtgcgcctgtagtcccagctacttgggaggctgaggccagagaatcgcttgaacctgggagtcagaggttgcagtgagccgagatcatgccactgcactccagcctggcaatagagggagactccgtctcaaaaaaaaaaaaaaagttctcggaagagagtatactgtgatttggcattaaagacaatgttgttataaatgcagaaaggtgtggacagaatagaggggaatacactggatgttagtaaaacaaatattcagcattggaggaattccatattattttgcaaagcaacaaccaggtgctttttagagcctttttttttttaaggaggctttatagagcctttttaaaaaagaggatatccccaaatagatgaagctgtatttttttattactgagatataaccaaaataatttattgtcacactaaagcattgcatctgaaggtagaccaaactgccaagttcccctgaatagatgaaaggaatttcagttcatcaagaggctggtgtgaccaattcacatgtcacgaaggattatgcttaattaagtcattgagttagttaaattggctgagtgcttttctttcttaggggtagaaaaaaaaataatggtgtgtcttacaagtgatcttataagtgcatcttagatgggatgaaatgcagggtgtagaatgggttttattatgatcaggtctctatagtaatgaggcctgtctcactagcatacttagattgaacaaaattgtagagacctagaagtgagattttattctagttgggcctgtgaaggagagagtgtcttactaaatgaatccttacatagaaatgacaagtggcttcaagattgttttctttttagaaaaggatttttgttagcagtacttgctgtccacatgctctaggaaagcaccccttccccccgcttccccactgatgattcatgagctgaaagaagttccccagcctgtggggtgtggggctgtcggtccaggtcattcttggtgttcattggtggcacagtccagtgtgcagtcccattctggacttccagtgtcccctctgccttactgctttatgtatgactaactagtattcaagtaaagcagaaaaattcatcacccaaaaaacgaaggaccctggtcttctcgtcactttattcagtggctcaatggcagcctaaggaagaggagtgtgctttctcagatgttggttttattattccttttaatcataagcaaatttgagtttaaatcatcattttgcaatacagttctgttgatgtccttatttttcataaaaaactcgactcactcctcattgcctgctggataagctgcttagcatgacgttgtggctctcagcagtcgaaccacagtctaccttttcaccgccattcctgattgctcccgctctaccccatccctctcctgttcctacccttagcataccatgggatctttttagctgttgccacagggccatggggttgcactgtttacatccccctcagtgttgtgcgagagcatctgtgtctccacagccttgccagcagcacatgttcccacacttgaatttttgccaatctgatgggtgagaaatgttatctcagtgtagttttgatttgcatttctcttgttttgagtaacctgttttgagtgagtcaaagcagtcaaactttttgtctttgtttatattcttagttctcactgaaatgccagtaacccctgactttctgtctctcctccaaaaaaggcttcagattccacatcctagcaaaaatatgccttcttctttgatgtttttaatctttcatcttaggattgtgtcctcttctctacttccatgacatgttacctacagctcagttatgccctgaagggagggaccttgctctccttcagctttccatccccagtgactgacagtgtctggaaaacgatcgatactatttcctggattaattgaatgattttttaaactttttttttttttttttttggagacagagtcatgctctgtcgcccaggctggagtgcagtggcgcaatctcgactcactgcaacctccacctcctgagttcaagcaattctcctgcctcagcctcccgagtagctgggattacaggtgcccaccaccgcacctggcgaatttttgtatttttagtgagatggggtttcaccatgttggccaagctggtttcaaactcctgacctcaagtgatccgcctgcctcagcctcccaaagtgttgggattataggtgtgagccaccgcacctggccgcccgtgcttaatgaagcattttaagttaagtatgacatgagaaaattagtaattttggtttgaattctaatgaaagcttaaacttcataatgtatttgcatcctcgttttcactgatattattccatgattttttcaaaggaaataatctttgcaatgagagaaatatagtatttcagaatatttgaagtttttctaatctttcctttatccataacaaataaaaatatctctaagaaaaagcagagtaacattatattattttgtcattataaattactcttattttcaaagtccaaaataaatctgtgatgtggggaaattcagtgtgaaaataattgaaagactgcccctttcagttacaacaactctgtaactctgattaatgtatgtttgcccttgtcagataaaatatctctgtaactatactcagaagtttgcataaaaatgttttaacctgaaaactttagaagtgtccctttcaagacagttaactaaatgtcatacatcatttaaatgataaggcaatgggtaaatatttctatgttgcacattataggagtttttgttggaaatgatgaagttggagactgtagcaatgatgatctatagctaaattattttattttctcatgttattttattgatactggatttttcatttttaaggggttactcctctccccttttaaaaatgggaagaggtagtcaagggtggaggaagggaagtgagaatggcatgtagggtaatagttgtcagtctagattagaataacaaagagcaacaaacaaacgcttgtttctaagaaaaaatatgagactgcatacagtgataaaagcagtctcagtgttttatagagggaggcataaatcatggtggtttcgctcagtggatcaggcagctgttaaaaggattagaaatgaagaatttgtacaaaacaagatgtttaatagaacgttaagtgaaaaaacagatgatgtattcatatctattctgttcacaagtatgtagaaatatatatacatctggagggaaatagagaaaaatgagaattgtgggaatgcatgatttgcattttattatagttcatattaatattaagctcttaaaaataaggagaaatgcaaagaatgtgttcaactcaagagcaaaaacaaaataaaaagataggggacaaaaagagccaacctgcctttcataaaattatttattgagtcatggaattttagagatgggaagcctctcctaacaggtctcaaaatttttggtctcaggacttcattatactgtaaaaattattgaggaccccaaagagcttttatttatatgggttaagtctgtcagtatttccatattagaagttaaaattgaggctgggcatggtggctcacgcctgtaatcccatcactctgggaggccgaggcaggtggatcacgtgaggtcaggagttcaacaccagcctggccaacatggtgaaaccccgtctctactaaaaatacaaaaattagctggccatggtggcacacgcctgtagtcccagatacttaggaggctgaggcaggacaattgcttgaacctgggaggtggaggttgcagtgagtcaaaatcgagccactgcactccaggctgggcaaaagagtgagactctgtctcaaaaaaaaaaaagtaaaattgagaaataaaagaaaactaagtcacttaaaaataatgatgaacctattatatgttaacataaataacatttttatgacaaataactatttcaaaacaaaaatttaatgagaagagtgccatggttttgtatttttgcttatctttaatatttgcctctatagaagacacatggattcccatgtttgcttatccattcaatctgttgtgatatgctcttttggttaaaatttggaagaaaatttggccccggacagctatatagttgggaaagggagagtcttttagtagcctttttagataattgtggcttcgtcacattgtctctggaaaaccccactgtacactcttcagagaattagattgaaaaagaccaataatgtcttagtattattatgaaatattccaaagctccgtgaaactccatgaaaatgtttaaataccttccaggggttccctgatgacactgagaactgctattttagcccttgaaagatgagaaaactgaaactcagagatgttcagtgattttctccagatcacgtggttggtggaagacagagtgcttggacatggctctgctagtttcattcctcatgtttttggaaaacgtcatatatggtgtgactttaggacaatttttggagattgatcctaagtttatttatgagggtcttcagagatatcaaaatctaattctaccttgtcatcttgaagattaaaaaaaaaaaactccatgattgggtgcagtggttcacgcctgtaatcccagcactttgggaggctgaggtgggtggatcatgaggttaggagatcgagaccatcctggccaacatggtgaaatcccatcttactaaaaatacaaaaattagctgggcgtggtggcgcatgcctgtaatcccagctactcgggaggctgaggcagaagaattgcttgaaccagggagtcggaggttgcagtgagccaaggttgcgccactgcactgcactccagcctggcaacagagcgagactctgtctcaaaaaacaacaacaacaaaaaaaaaacacaaaaactccatggtaggcaaatcaaaactttttagagaaagtagtattagaattataagtggattataaaaatgtaatttttaacacaagctatagaaatattaaacttttaatttatgacaaaggatatgatacatttaattttgttcgctactttttactagctaaaaattttctagcatcttctatcagtaattttattttatatacatgtgtatgtgtgtgtatatatatatatatatatttttttttttttttttgagacggaatctcactgcatcactcaggctggagtgcagtggtgatatcttggctcactgcaacctttgcttcctgggttcaagccattatcctgtctcagcctcccaagtagctgggattacaggcacccgccaccacacccagatcatttttgtatttttagtagagatggggtttcactatgttggccaggctggtctcaaaccatctgcccgccttggcctcccaaagtgctgggattacaggtgtgagttgccacgcccagccaatctcaataattttgaatagacacttttgactttatcttggtttgttggttatttgcatgtccatagaggcattttccatatctgttcctgcattcaaatattaggtggctttatggtttttaatgttattcactggttcctcccagatcccaccaaggtctcaaacaatagtattcttggatcctgagatggaaaacacttagggtaacctttatttagcctatttgggtaggtacttctcatgcttcaccatcagtgctcatgatgtgtagaggccctttgaatgacagctccataccgccaatcattctgtcagcccttttgcgtagttctcagctcctcccgccccccagtagttccatattagaagttaaattgaggaactgtccaattacttaactacttcctgccggcctgcaggctttctggagatgagattgtccctcagctttcttcatcttttccagatttttattgcacagcttctttcctgctgtgccttctactctacctcccttttctattccccattaagcagtttcttattttaaatattattctcaataagatgacctccaatttacgtatactggaatcaagattctcccagtcgctagaaagatgcagaggaataagtctgtctagtcttgagccttatgagacaggaactcttgttgggaggttccggtggttggtctgatggcatccctgggggcctccgtccttcaggccaagcatcacagtgtcttcactcctcgcttccggtttgtgttaaatatatatatttttagtggtaaaaatcagagttattttgtaatcagccagcaatatctttaggtcagccctaaccaattttatcttttctaccttttttccccccttgaaataaatgatttaaacattttatggggaaacacctatattttttatatcctgttcttcacattaagaaagtggtgggactgagaacagttacttgggagagaccaaggtgaaattctgggtgtgcttttggcttcgccccagccaccaccctgcctctgaatggtgggatcaggacatggaggaggcagccgacggccatgcacctcctgagtgtgtgccctgttgtctgggctcttcttttggaacaatttgaagtgagattttcatgtccaggttacaatcacggaactatcttgttgagttgtgtgacctggactttcagctcctttttccttttctttggagctggaaaggtgtcatgtgggctggagaaaataaaaagaaagttcattaatttgaaatattgtggagaatttgttctctctatatcatataactctatttctatcttatctttctagactgctttctaatttggtgtctaagtgggacatactctttcagtgtttcatatacagtggaagcttactatatatttgttaaaaagagaaataaagatagaacagaaaaatgcagtctagctagggagatggtataacaggagcattgtgatgggcatttggacatgtaggttccaatctcatccttatcgtaactatctctatgatgttgtcaaattatttaaactactttaagcttctgttttctcttctgtcaatgagaaagttgttaaatgatgtctaggtgtttgccctttaaattattattattatcttttcaatagttacttaagtgcatcttgtgtgccaggcactgttaggagagctggaaatatggtagacaaccagccacagtccctgctcttatacttgggtgtggggtgtcttctcttccccactggaaagcggaaatggtgacttgaaggacagtcttgggtttgtgtctgatttgggccaggccactacaaaacttttaaatggtttatttgcttatctgtaaagtgaatatagtaatgtctaacctagtttaccttatacagttgactaaaataaaataatgtatatgggaatacatttgaatatactaatagtagtagtgtaaagtacagcatgtagtagtgtctgtagtaatgtaaaatattttattttgctataaaatttaccgtgtaattcactaaagtttggatgggaaaaatcctaaattaaacttggagtttggagattcctaaaaaacttaaagtatgtttgtttttcttctctttacagagaaagataatgctaaatatgtttttagacacaatgatggctgaccctcctccccagtgccttgtctggctacctctcatgcacaggcttgcccatgttgagaatggtaagcagaacttttattgttcaattccgcatgctatagaaagtataggaactgattatttgcaatgtccttagctattaatatcattgaaaattacagttgacatttgctgtcattctgtcatttcattttgtggttttggctttcagaagaatttttttttaaaaaagggagggtacttattacttttttttttttttgagacagagtctcactctgttgcccaggctggagtgctgtggtgcaatcctggctcactgcaacctctaccttccgagttcaagcaattctgtcacctcagcctcccgagtagctgggattacaggtgccggccaccacacctggttaatttttatctttttagtagagatggggtttcactatgctggccaggctgatctcgcagagacttattactttaaaaaggataccaagaagtaggctgggcatggtggctcacacctgtaattccagcactttgggaggccgaagcgggtggatcacttgtgatcaggagttccagccagcctggcaaacatggcaaaaccctgtttctactaaaaatacaaaaattagctgggcgtggttgtgggtgcctgcaatcccagctacttgggaggctgaggcaggagaattgcttgaannnnnnnnnnnnnnnnnnnnnnnnnnnnnnnnnnnaaaaaaaaaaaaaagaaaggatactatagtagtcatatcagatcatacaacttcagctataggcttttcctccctaagattccagatgattgtttcttgtttgagcccaactgatttttagccatgacttcctgcttcctctttgatttatcaaactcatatctctaaaaaactgtatatatgctatatcaactgctaaaactataattattttggaatgatttaaagaaaaatagccaagatataatttaacagtgggttccctttttttttcctcattttttttccttcaccattttgccttgaaactattcttggtgtccctcccagtaatttgacataaatctttgttttgctttgagttaaaatggtacttatctcttagtgacttcttaatttttcctgttcttgccatcagtttatctcctcctttaggttgttggagtttgttaaggggaaggccattgtgtttctagtaaccttccctctctccaggctcttgcctttcttcattcctcaaaagagaacgaggaagagccaagagtccacttttatccccccggaagaataaaataaacatccatactgtttttattttctcgctttcctatccatacttcagaataaaattttctcagccttttacccaactatggctttagttcacaagtacctcagattaaggattcatttcttaaaggaccagaatctctctagactaaaacagcaaaatttttaaaacaggattcttggatagatttaaattttggagagcaatgcttttatagccttaagtgttttagtagttttatgtccaattgattttcataagatcattttgtatttgctataccaagtagaaagagcctcacttgtcaagatgtattattatccatatgcatatcaacatttttttgtgacttttataaagtgtataatttattgattacattcttaatgtatatggtttgtaatatttttatcagagacagaaatgttataaaatcattaaaatatctagaaataaaatatgttacctatcacactaatatttttctgtatgtcttaattttaatggtgagaaacaaattataaaattatggtatttatggtttttttttggtttgggctctatgaagttcatcatgaattatattgacattactatgcataaggagaaatattcacttaagcaaaagttgcactttttaaattgatttactaatccaagtgtaggtatataacaaggtaactaagtgatgcactttaccaaaataatacttataccagaacctgaacagtccttctctttcttatttataattgacccaacacacttgttaattttttcatcattctggttctctgcttttccacctgtcacccattccactgactaaggattggctcttgagtggtttggaagagaaggtaggagaatcacatagacatatatgttcaaccaaaattatcagaatgtatttggtaatttaatactaacatacatatatcttttaatattaacctaaattacttagaattataaatattggctgcacagatgttgacctcattgacatttgctgagattgagggagtcctgttctctggaggaactatactaggttgtatagttaatttggagcacatgctcttaattagcatttccagcattccatagaaataccttgatggcaaaaaactgaatttcttagaagtaatatcctttggatttctcattactgagtttagttttcttttagtccctagtgatcatgctatataatcttgttatattgtttttatcacctcatactcaattttttttgagtcttgattcactagttaatatatatttttggaagcaagtctagaagtccctataattgaagtaagattgtggtcttatatatataatgctagaaagagttgttcaatgaagatttgaatattctatccctcttttcgttttctttttctgtttgtttttgagatggagtttcacccttgttgcccaggctggagtgcaatggtgcgatcttggctcactgcaacctccgcctcccaggttcaagcgattctccagcctcagcctcccaagtagctgggattacaggcatgcgccaccacgctcagctaattttatatttttagtagagacggggtttctccatgttggtcaggctggtctcgaactcctgacctcgtgatctgcccgcctcggcctcccaaagtgctaggattacaggcgtgagccaccatgcctggcctatccctcttttctattaacttccttttcttgtgttcagagttgaattgtcagaggaaataattatgctaccaacatttaaaagtataaatagtgatctgtaacatacagttgtgtattgcccttgatagtacattggaatgattagattagaatcattagtctgtgttgaatttttttttctgatgtattaaatcttttttttttttctagtaaatggctagttagactagcagacaatttagattctttagttctaattttgttttgttttgttttgtttttgagacagaatcttgctctgtcgcccaggctggaatgcagtggcatgatctccactcactgcagcctctgcttcctggtttcaaatgattcttgtgcctcagcctcctgagtaactgagattacaggcatgtgccatcatgcgcagccaatttttttgtaattttagtagagacagggttttgccatgttgtccaggctggtctcaaactcctggtctcaagtgatctgcccacctcagcctcccatagtgctgggattacaagggcaagccaccgcatccggctctacttttatttttacctttgtttttatattagttttggtattcctctgtattgacttcattctccaagtgaaattttattctttcttcttttattctatcccttccctcctgcccttttttctccccttttctctcctgtccacaagtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttgggtaactgctttgtgtttcatctgtgtccctgagtgttaatctgtttgatcagtaacagcacctgggccagtttcctcatggatgcctaccaaataagggtgtgatatagtaaaatcttaacactaacatttatgccaggattgcaaaaatgttgtgcttcctcacttgattttaaaagcagaatttttaaaaattccaggaaacaaagatagtacatttgaaatggtctcttttattcagtaaaatggaatgttgcagtgctctcttttcaaagcaaaaagtgagtttctttttattttaaaactgtacaggctgggcacgatggctcacacctgtaatcccagcactttgggaggccgaggcaggcggatcacgaggtcaggagatcgagatcatcctggctgacacagtgaaaccccgtctctactaaaaatacaaaaaaaaattatccgggcgtggtggcaggcacctgtagtcccagctactcgggaggctgaggcaggagaatggcgtgaacccgggaggtggagcttgcagtgagccgagattgcgccactgcactccagcctgggcaacagagtaagactctgtctcaaaaaaaaaaaaaaaaaaaaaacaaaactgttcaaggggattccgcccccccatgcttattcttttgagctctaagtaagacttaaagttctttttgcaagcaaaatttcctcacttttatagggtttaaatgtgcaaggaaagttgcagaaaataaaggagttaagtatttatgcctgtaaagttggaaaaaacattgtattttacaaccattgccacattggtgtctttaccttcaaaagtagtttttaaaatagtaatatcttggcggaagtcaatatctgatttttctgtggttcttataaattatgtaacatggttatcatcaattattttccttcctttctctcagtttatttccagagtcctaaaaatgccatattttccctccaaaaagttgctacagcctttgttttaaaatctttcctctagtttttgtttgttggttggtggtttgctaaacagtagaaaaacatgtaaggtcagaagtataattcaggatctaggttctttagcctggttatcctattggccttcaagtattagaaagctttaataaccagtttttattttccctttggttgtcttaaaactcaaccaagaaaaagcaaataaactcacttcaggaattaaagaaaaaaggaaaacaaacttcaacccacatctacacttaactctagttccttcatctctgaaaatctgttaaagatcctttttttttcctagataggtttctgttataattaatgataaaattttgttaaactgaatatcctatcctgggtcttgttgtgttgtgaattccattttttttggtggtggtggttgtgaagagccacttttaaaatccaaaaaaaggaaaaaaacacagtagtttcttttctttttcattgaataaagaaaatttacagattttcaaattgtttctttttgctttcttaaagtacaagtacttcactatgttaattgttaatgttttttccactggttttttttttttgtgtgtgtgtgtgtagagtctaattctttacactgggatagtttttgctgttttacctttcatgatgactgagtttgctggtatatttctactgaaaattcttattccggatgttggggctaagagaattgggaacttcttattccccctggtttgaatttcctcatttggctaacctataactcttttaaaaatgggggttttgtatttgtttagagacaagtgactgatactgctttatgatttgcatgttttcatctactcttgaattttttcattgagttataagatacatacagaaaagtatacaaatcacaaatgaattcttacatttctgtttgaccctcacagcactattgtgaactaagtcttatttgcatatgttgttattcttatttcagcttgttttatgaattcctttatttttgttaaagagacttaaatttttttaaaaataagcattgttatcctgcataattttgaagctagtgtgataaacgtattagttctgaattttgatggatgtatgccttgtgtatggtagatgcatactggtaaggctgagtaaagaggtttccagctaacaaaaagatgtgctatcaatttaatagtaatttctttgagattgtcggctgtgtttatactaacgttttgaacaaatgtttctatatgctcatacgtgagtttaagtgtgtgtttaaccagctagtataagaattttcattgtagatgtgacatatgagttttaagtagtacctggaagtttattttgatttttccaaaaatttctgttgaatgttttatctcagtagctatgcagtataattcattcttttagtctttggtccattttgtttgcctttattacaaagaaaatgccgtatggtaccatatctgagatttatcctgtctgttcattctttcattcaaaatttattttttaaacacctactgtgtgccaggtcctgtaagaggtatttgggatacatctatgaacaaaccggacaaagactcctgccctgtggagcttaagttttaatgagtgtgaaagagactgctggagcttgtcagcattacttttttcctattcttgttggcacatgtctagactacacttttcagccttcgtgtagctaaatggaaccatgtgagtagttcttgccagtggaatgcgaacagaatgataggtgtctttccagaagaagacagttaataaatagcagggtgccttctgtaccctctctgctatcttggtggaaagaacgtcattaggactccgcggagggtgaaaccattaagcgaaaggtaactgggtccttgaatgatggatggagaagaatatccagcaacccacttgactgtgatggaggcatgataagaactttgcgttaagtcactgaaattttagtactagaagtagagttctgttaaaatcttaagatgtgtgttattgtcttagcagtcacgtggcacacttgatgaggaaactgacattggagagggaaagtcagaaacccatgttatatagtggtaaccaatttggtaaatgtgtcatctgtgataatttggaaggcacgcctcacacccaccgggctctaggtcaagtgttggaaaagatcagaatgtgagactgttaatggtaaggtgacataggatagagatgagcttagaaagaattggctagtgtacaagcaataaatgaaagggaacagagaaagctctgactcttggggcagtgaaaggaaaaacagactgcttccagaccctagagagaaagccttaagagttgagaaaggctttaagccacaaagtcctagtagaccttctcagttgaaaaaggtgacccagtcctgtggtaaagatcagatgaagggtatggtctctttttcttggctgattatcagaatcccctttggttctgcctgcagagattctgatttattggtctgaggtacatgaaaccctggatataaacagtttttaaaagttccccaagtgggccgggcatggtggctcactcctgtaatccgagcagtttgggaggccaaggcgggcagatatctgaggtcaggagtttgagaccagcctggccaacatggtaaaaccctgtctctactaaaattacaaaaaattagctgggtgtggtggcgggtgcctgtaatcccagctacttggaggctgaggcaggagaatcgcttgaacctgggaggcggaggttgaggttgcagtgagccgagatcgtgccattgcactccagcctgggcaaaaagagtgaaactccatctcaaaaaaaaaaagttccccaagtgattctatcatacagccaaagccagaagcaactgaccttgttcatatggcctccaggtggcttctgttagttgaaagcaagtggcaaagaactacattagtcttaggaaagaactttttgtgtgtggttactggcacatggaatcaactggaaacaaatagatcaaaggcctactaagtttctgagggaattacattggcaaagaaattatgagcctgaactgaacaagcccttaaatatttgagctataaaactactatttaaaaaaaaaaaaacaaaaaacctctgagaacttggtctggcagggtaggttgatgggttgtgaaggttgtgcagcccctctggagggtatgccagagcccacctggcccagaaggatatcggataaggaagaaactcctgctccggctccaccgttgtatattgggagcaggaagggacggtgcagatagttttttttttttttttggcgatggagtctcgctttgtcgcccaggctggagtgcagtggcgcgatctcggctaactgcaagctccgcctcctgggttcacgccattctcctgcctcagcctcctgagttgctaggactgcaggtgcccaccaccacgcctggctaattttttgtatttttagtagagacagggtttcaccgtgttagctaggatggtcttgatctcctgacctcgtgatccacctgcctcggcctcccaaagtgctgggattacaggcgtgagccaccgcgcccggcctggtgcagatagtttgcctttttagttcatagattgcatcttaaggagttctgtatgatccttatgaagaagactgtgccatatccagagatcctggatgcaccgactgaattggactgcacgtgttctgcctgggcatgtgtggcatggtgggaggaggcaagggtgctctgtgcataagaaaagggaacaaaaaggtacctgaagattgaagtttcagtagtatccacggtttcctttgcttaaattccactggagagaactagtcatataggcccatctggccacaaggagggtatgttgtatattatatatatatatatcgcttctcagccaaggcagtttgaagcaggtgtgcctctgtctttaccccccactgccgatatacattgaccaaatagaatggtctccaaaggaactggctgaggcagaagtcctcagatggaggaggctgggcacctgcatggatggagcacagcccttctgccaacctgcatgggactctaacatgagcagagtagcaagtggagtcaggaacttagggctggggagattggaggttgaatagggaagtcatataggccttgttgagaaaatgagatttgagcactcttagaagtttaccagcagagatctggggaagagaagaggtagtgttcagggtaggggtatacctgtaaatccagggaaagaagccagcatggccagaatgcaatgagcaggggaggattgtaggagacaaggtgaaaacattaatgtgggcccattgaccattgtaaggacttttactctgagtgaaatgaggagtctttatagggttttgaatagaagaataacatgatatgatttatatttttaaatggtcagtctagatgccatgtaaagagtagacagtagaaaagaaagagaggagcagagagaccatttaggagaaattctaatgataattaaaacaagatatggtcggacagtagtaaaggttgtaaaaaggattgaattacaatatgttgtatacatcagcctaatgggttggatgtggcttgtgagagcggaggagtcaaggaaaagtctaagattttgtcctgagcatagaaggatggaattgccatagactgagatggggaatgctgtggatggagagcatttagatgttaggatcaaggatgaaccttgattcaccgtttgttccggacatgttgaacttaagttgcttattagatatccgtccatatggagttgttgaggtcattgtatattatgagtctagagtttaagagagaagtctgagatagaagtataaatctgggagtcaatggcgtatatttaaaatagccatgagactgggtgataccacttacaccatgaagagaatgagtgaagatagagcaggaaaaagaggagtaagaactgacccttgaagctcttcaatatgaggacatctgggagaagaggaagatcctgcctccagtgaggtgggatgaaagccaggagagtgtgtgttctggaaaacaagtgaagaatgtgttttgaggaggaggaagtgatcaactgtgtcaaatgctgccaacagtcaagtaaggaataagaactgaccctttgtctaacaatgtggagattgtctggagaacagtttctgtggagtgatgggggcaaaaaccgattaaagtaggtttaagaaagatggagacagctagaatagctaagtctcctaatgaataaatgaatatctatttctaacccatttttttttcttctttttttttttttttttttttttttgagacaggaaaccactctattgtccatctggagtgcagtggcgtgatcatggatcactacagccttgacctcctgggctcaagcagtcctcccacctcaccctcctgagtagctgggactacagtcgtgtgccaccattcccagataatttttgtagagacagtgttttgctagttttgcccagactggtctcagactcctgagctgagcacaagtgatctgcccacctctaccttcctgtgctgggattacaggcataagccatggagcccagccctccaacaccatttcctttttttttttttttttccagatgcagtcttgctttgtcgcctaggctggaatgcaggggcacgatctcggctcactgcaacctccccttcccaggttcaagtgattctcctgcctcagcctcctgagtagctgggattacaggcgcccgccaccacgctcggctgatttttgtatttttagtagagacagggtttcaccatgttggccaggctggtctcaaactcctgacctcaggtgatctgcccgcctcggccttccaaagtgctgggattacagtctgagccaccacgcccggccaccatttctaatagtagttcctattggaattttagaagactcattagttgcacttcacttttcctccccacaagatgacagccaggagttaggcaaatggcagtctgtttgagaaagtagttttaattgtggggaaactgtggacttgccagtagcccccgaatcaaatatacccccacccaactgctggcatttccagcagggagcagatcctgaacatttatggatctgggtggagaggagaattcgtgctctctgcggagtgtgcagatcccaagaaaaaagggagaggaaggggttgatctaggcatgttcatttccttctctaaaaccaaccagtctgattaggagaggagtgagtgagggtcagagagtccctctacctggaaataagagagtggacagtaactaaatattaatttttgtattcaaacatgcaaggttatatcagtcttcttctttgagacgcttgataaatatttgagtaaccttgccatcagtactgtggtgttccagtgactcttgctgcataataagcagcaaaagttagtgacattaaacaccaatcatttgattacacctgcagatttggatggggtagagggttggcttttttctgctccatgccatctggggccttcgctggggtgactgaaataccagggttggaggatgtggcttgagtgactggagggttcttccctcctgtgtctgaatgccctgggatggggaaggccgggatctgctggaacagacactggggccacctatgtgtgttctcttaatgtggcttgtgcttctcacctcttggccgctgtgtcttaagagacagcatccctagaggaggcatccagacagcagttgtccaggagagcatggccgaggcacaggcctttcaccccaggcggtgggaggagtgcagcctcacttctgctgcgttctgccttatgtgaagagtcactgaggccagcccagaatgaaggggaggagaacgggactccactcatggtgccggtgatggttgtgggagggtcacattgcaaaggtgcctgtgtggtggagacattgtcgcagtgatcttctacccagtatctgtttggaaattacactctgtcccacatgggataaagccttgtaatcagaacaagggttcccacataagtggttaatttaaccatagtgattattatgttttcctactaaattatactttttgaaggaagactttattaaaacaactaactataatatttactaggatttttattaccatatttaaataggttagttttttttaagtaaagtattttgggtatataattgtgtgtgtttttttttaaatcactattaaatggtctttagccttaaccttccttttccttgatctgggcatacgtgcttttctgattcactttaaaccaaactccctccatgcctgcgtacttccttccctccctcccaagctcctattaattgtgtggtaaaatatatgtaatataacatttaccatcttaaccatttttaagtgtatagttcagtggcattaaggacattcacattgttgtgcggccatcaccagcatccatctccagacctttttcatttttcccaactgaaactcttcaacctttcttttcttttcctcttttttttttttttgagacggagtctccctgtgtcgccaggctggagtgcagtggcgtgatcttggctcactgcaacctctacttcccaggttcaagcgattctcctgcttcagcctcccaagtagctgggactacaggcgcgtaccaccatgccagctaatttttgtgtttttagtagagatgcggtttcaccatgttggccaggatggtctcgatctcttgacctcatgatctgcccaccgtggcctcccaaagtgctgggattacaggcgtcagccaccgcgcccagccttcattcagcctttcttgatatgcaaggaaggctcatagcaaatatgcctccttctctgccttccattcagatctctgcttccttggtttcactttaccaagatagatctgattcccatctagttactccttggcaggaagtctctcactctgtatgtccattgatacaaaatacgcctgtaccacagatacagttagtagagggccttcatggagggtagttatgtaactgactggttgatagtatggaaatttcacctttcttcccagcagatggcagagtccacctctgaacaaagttacttattgtgttcttcaaaatcttctataaatgaggaagtattttggatttctttaacaatctctgttaaataaatattgctttacttaaaaaaatgttgatggacagcttatatatgtgcagcatagttgtttgggcattagtgatagcaaaagtaagccattcagggagtcagagcaaattttctcgtgacagacctggatcaattgagattgttgacttatcttggtcagaagcagtgttcaatttccatgtgactggtgtccctctcctcacatctcttgaattatgaaagataatatgtattcatgggaaaaaggtgtgcttactgagcatgctcctgaccagttttaaatagccacgtgtcataattaaacaattaactttgtgcaaagtacaaaactagacaatttttttttaacttataagacaatatccccacttgtggcaagcaagagctaagacatacacatggagaaattaaaaacagaatatacaaaatcaagtcctttaacccaatggccacctcttctcaaagaaactgctgaggctgggtctgccatgccccctgtctctgcttctatcagtcagtgtccttgtttaagctgtctgacctcttgtcttgggtgacaccagcattttatcatggtctgtacttcctgcctcagcccagctttctcataagtcagtcctccacagctcacttccctttagcaccgctggtccttggccagcaagctgccttcactttcaactgcttctctgcacatttcttccaccccctgtctccattgaaatttggctgtcctggaagaacgccacttccctgcaaccctttcaggtggttatttattctctcacatcccatgcattgactattagggtcaattgactatcgactattagggattgactattagggtgactgttgactattagggattgactattagggtgaccatgtaatttatcatcaaaaccagacccacttgagtgtgaaaggagacactattaattatgcagggacaacatgcataaactgtgattatcttggacaaaccaggacttgtgcttactgttttaactttgtttttgcattaaaaaattactacaaatttaactgcttaaaatagtggaaacttattgtctccgtttttgtaagtcagaagtccaggctgtctactccaggtgtcactgagctgaaatcgaagtgtcagttgaggctgtagttatcacctagggcttagagggcctcctgctggctccctgttcgcacaatttgtttagttgcacctgtggtgccgaggtccccattttcctgctggcggccagctgaggatgagtctcagctcccagaggctgcctacagtttcttttcatgtggccccccataggcagtttgcaacacgaacatttgctttcttctcggccagctagaatgcatctctctgattttctttcctgcaaccagccagagaaatatggcttttacggggttcatgtgattagaccaggcccacccagtgtaatctcccttttgccttataacataatgtaatcgaaggaatgatagcttatcatatttatagcttccacccacactcaaaggggaagagatcatacaaggacagggttcgctgaaggtaaacagaattctgcctacactagtcaccctgattatttttctacctgttttccaattagctacttctagactattacgtcttgaatctcttagtttttttaaaaaaagtaatattagcaaaccaaatttggaagaacatacaaaggactatacaacatgagcaagtgagaattacccctgaaatgcaaaagttggtttgcatgcaaaaatcagtataatataccttgttaacagactaaaggatgaaaaataagatcatctcaataaatatgaaaaaggaatttgacaaaacccaaaattctgtcacgataaaaaaaaaatgcaataaactgggaatagaagagaactttctcaacctgaaaaaggacatctatgaaaaacccacagtggtcagtcagagtggctcacacctttaatcccttcgagagactcaggagggagaatcacttgaagccaggaattcgagaccagcctgagcaacatagtgaaacgctatctctaccaaaataataacaataatgaaaaaaaaatagctgggcttggtggtgtacacttgtagtcctgcctactcaggaggctgaggtgggaggatcacttgagcctgggaggttgaggctgcagtaagttatgattgcatcactggcactccagcctgggtgacagagtgagaccctgtctcttaagaaagaaaaacccacagttaacatcatacttaatagtgaaagactgaaagcttttcccctaaaaccaggaaaaagacaaggatatccactcctgccatttttattcaacattgtactgaaggtcctagccagggtacttaagcaagaaagcaagcaaaatgcatccatattgaaaaggaagaagtaaaactacctctcttcacagatgacatgatcttgtatatagaaaatcctaacacacacaaaaaaccattatagataataaatttaccaagtttataagatacaaaatcaatacaaaaatattagattggtgcaaaagtaattgtggtttccccgttacttttaatggcaaaaactgcaattacttttgtaccaacctacttcaaaaaatgcaaaaattagttatatttctctatattgacaatgaacaatctgaaaatgaaattaagaaaacaggttcatttacagtagcatcaaaaagaacaaaataggattatatttaatcaaagaagtactaaacttgtgcactaaaaagtggaaaacatggctgaaagaaataggccgagtgtggtggctcatgcccataatcccagcactttgggaggctcaggtgggtgggtcacttgaggtcaggagtttgaaaccagcctggccaacatggtgaaaccccatctctattaaaaatacaaaaaaaaaaaattagccaggtgtggtggcgcgtgcctgtagtcccagctacttgggaggctgaggcaggagaactgcttgaacctggaaggtggaggttgcagttagccaagatcgcaccactgtgctccatcgtgggtgacagagagagactccatctcaaaaaaaataacaaaaagaagaaattaagacctaaggaaatagacatgctgtgttcatgggttagaagacttaacatttaaaatgacagtactccccaattcatctacagattcagtgcagtctctatgaaaatctcaactgcttttctgcataaccccataaactgatcctaaaattcatatagaaatacaagagatccaaaatggtcaaagcagtcttcaaaaagagaagcaaatttggaggctgaggcaggtggatcacaaggtcaggagatcgagaccatcctggctaacacggtgaaaccccatctctactaaaaatacaaaaaattagccgggcgtggtagcaggtgcctgtagtcccagctactcaggaggctgaggtaggagaatggcgtgaacctgggaggcggagcttgcagtaagctgagatcgcacgcaccactgcactccagcctgcagcctgggcgacagagtgagactccgtctcaaaaaaagaaaaaagaaaaaaaaagaatagcaaatttggaagactcacacttcctgattttaagacttacttcaaagcaatagtaatcaagacggtgatactggcatgaagatagaattgagactccagaaataaacccttgtatttgttgttgtcgatttttcaatgagggtgatgaccatccaatggaggaaagaatagtcttttcaaaatatggtgctgagacaacaactggatattcacaggcaaaagaatgaatttggatccctgccttataccatatgaaacacgaattcaaaatggattatagaccccttaatgtaagagctacaactataaaactcttagaaaaagagattagatgtaagtctttatgaccttgagttagtgccttcttaaatatactaccaaaagctcaagcaacaaaagaaaaatagacaaattggacttcaacaaaattaaagattttggtgcttcaaagggtgccatcaagaaagtaaaaagataacccactgagtagaaaatatttacaaatcatgtatctgataagggacttgtatccagaattataaagaactcttaaaactcagcaacaacaaaaacaacaccccaactaacccagttttaaaatgggtaaagggcaaaatagaatggtcgttatcagttgggaggagaaaatgggaaattattgtttcatcagtatagagtttcagatttgcacgatgaaaaagttatggcaacgtgaacatacttaacactactactgtactatacacttaaaaatggttaaggtggtaaattttatgttgtgtgattttaccagtgaaatatgtagattaggctgggcatggtggctcatgcctgtaatcccagcacttcgggaggctgaggcagatggattgcttgactccaggagtttgagaccagcctgcccaacacagtgaaaccccatctctacacaaaatacaaaaattagccaggtgtggtggtgggtgcctgtaatcccagctactctggaggccgcaggaggatcacttgagcctgggaggtggaggttgcagtgagctgagattgtgccactgcactgcagcgtgggtgacagagtgagactccatctcaaaaaaaagaaaaaaaagtaaattgggggaaaaaatggggaaaggatctgaatgggtgtttctccaaagaagatataccaatggttgagatgcacatgaaaagatgtttaacataatcatgagggaaacacaaatcaaaaacacagtgaggtgctatttcgtacccagtaggacagctaaataaaaaagactgaccataacagtgttgacaaggatgtagaaaaatcagaacccttatacttcgttggtgggaatataaaatggtatagccacattggaaaacagtttaacagtttcttagaatgttaaacatagactcaccatgtgatccaacaatctgctcctaggtatacacccttgagaactgaaaatacatgtctccacaaaaacttgtatgtgaatggtcatggcaacattattccaaagagctaaaaagtggaaataacccaaatgtccatcaactggtgactggacaaagtgtagtttatcaatacaatggagtactattaggtaagcaaaagaaatgaggtactgatacacactaaaacataggtgaacattgaaaacatgctaagtgaaaaagtcagacacaaaatgtcacatattgtgttactccatttatgtgatatgtacagaatgggcaaatgcatagagacagaatgaaatatacagaataggcaaatgaacagaatgtacattagtagtttccgggggctggggagagggaggaatgggaagtggctgctgagtattgggtttcttttttagagtgatgaaaatgtgctgaaattagatattagttatggttgtacaactctttgaatatattaaaaaccactgaattttacagtgggtgaattttatggcatatgaatagtatctcaatgtattctttttttgcattactataaaggaatacctgagactgggtaatttataaagaaaacaaatttaattggttcatggttctgcaggctgtgcaagcatggcaccaatgtctgctcagcatctggtgagggcctcaggaagtttacaatcatggtggaaggcatagcagaagcaggcagatcacaggacgagagcaggggcaagagggggagaggaggaggagccagctcctttaaacagccagctctcctgtggactgagaactcactcatcaccaagggaatggcactaaaccattcttgagggatccgcccccataatgcagtcacctcccaccacgccccacctctaacactgggaatcacatttcaacatgagatttggaggggacccacatccaaaccatatcactcaataaagctattattttgtattttaaattggatggctagggaaagcctttctgaggtagtgacatttaaactgacattggaatgactaacttgaggttggtagttgtgaattcagcttcagaccagtcagcatagctgtgtatttcactcccaccacacattgtgtgggtgaaggcagagagtggatagggttgggttttgatagaaaagtatgacgaaggaagagaagtggcaaggaggggggtgttgagtgtgtgcaaagaaaatataatatcaaatgtagacatggagcttggttcaagagagaaattaggccgtgagggagacaagataaagatggtaggctcaatgtagtataggttcagtgggttgaagtatttttctaggcagactactagaaggaatgtgctagaaagacagaagttggtgagagtaggtgcttgaaactgagatttcaggtaatgtacagtaactggcaataaaatgttgtaggtaggaggtgactagaaatggcagccaacatagggtgggagaacagttgctgaagaagaattcagagaggacatatgtattaacagatatattagcttcctgtggaggccataacaaactaccaccaacctggggtcctaaaccctctcacagtgctggacacaagtttgaaatcgaagtgtcagcagagccacactctctctgcaagctctaggaaagtatctctttgtattaggattctctagagaaacagactcaatagggtgggcacgcgcatgtctgtgagatttattgtaaggaaatggcttatgcagttatggaggatgacaagtcccaagatctgcggggtgagttggcaagttggagacccaggagaactgatgatataggtccaatcctggtctgaaggcctgagaaccaggagaaccaatggtgggtagttccagcaggctccagacctagaaagagttgatctttcagtttgggtccaaaggcagacgtttgaagacaagaggacttttttcttattcagggctgggtcagcctttttgttgtattcaggccttcaaatgattgggtgagggtcatccacactagggaaggccatctcttttacacagtctaccaatataaatgttaatctcatgcaaaacaccctaaaaggaacacccagaagagcatttcaccaaatatctgagcttctcatagcccagtcaaattgacacataaaatttattttattttattatttctttgagacggagtctcactttgtcacccaggctggagtgcagaggcacaatctcagctcaccgcaacctcccaggttcaagctattctcttgcctcagcctcccgagtagctgggattacaggcatgcgccaacatgcctagctaatttttgtatttttagtagacatggggtttcgccgtgttggccaggctggtcttgaactcctggcctcaggtgatccacccgccttggcctctcaaagtgttgggattacaggcgtgagccacccaccacgcccggccccttgacacgtacattgaacatcacactgttctttccctcttccagcttctagctgcagttggcgttctttgactttgtggctgtgtcacttcagtctctgcctcctgggttacattgccttcttctcatctgtctcttctcctctgtgtatctgtcttatatgaaaatacatttgattgcattttgggcccaaccaggtaatccagggtaaatgcttcctctcccatctagattcttaagttaattttgtcatagaaggtaatattcactcttctgccatataaggtaatgcaggttccagagattaggatgtggacatatcttttggggggccgtcattcatcccactacgatcagtgcattggaaagatcaactgtaaatgttgaaatcaacaagaattatgacagtagtaatgttggactccgcgaaggagggacaacttgggttttggtctgattatacgacattcaaaatcggagttttaaggaaaagggaaaatgatctgagagtggcagtgtggttctaggaggacttctcctccacctggaggtctagttgtttgaggggtgtgagaaagaaagcagctgccacttgaaatggctgcagggaagctgagccttcagggaatgccaggtttcctcctagagccgtaggtgaaagcaacattcagagaagaggttgatgcgtaagcctcggacagaggagggattttgccgatgctggactatgaagacaaggagaagggttttgagagttgaggattggggtcgcgtgaggggatgtactgagcctcacaggaataaaaaccaggtgagagtcttggatttcttatttttaaaaagtataacctgatataaaggtcgtgctggaattaaccccagataggcagatcatggcactgtggcaatgtgttagttgagagggtgttggttgccaggaacatgcagggctctgggttcatctttttactcttgttgatggtgttatggaggcctggggagaagtgctctgaaactctcccattcgacagctgacttagagctaaagtgactgcttcgttgaccagaggcctccctttgaaattctggactttctagagccccccaagggttagggggaatagtctgggatatcctgataacctttatccgcattttcagtaggttgcttgggatgttttagatattgctcctttcaatcatctgaacgttgcccaattctactgtgttgtttgcatgcacgatttattcataaaaccacttacagctgcaaaaatgctaagtttaaaacgagaacattcaaaatggacccagctgtttaaaaagatggatgcgatcaaataaagaattggtgtgtagtttatgaaacaataaggcattttttcaactgtagcctgattattcttagagcgatgacaaggaggtttttccattacaaagaagtgtatgacttagcttaaaccaagcagttcttcaaatgagcaatttcctgtggcagtcatcacttagccacagcccttttgtcaactttagatcttttttttgttcttgcagatggccaccagagctgcactggagagtgcatcttctgcttccatgtgtgggaagatcactgtgttctctgtgacccagtagtgtgaattgcttatctgtttctgcattaactcaaatttatcagtgattattgcctgaatacctcatgctttctgagatctacaggtacagatttagggttgaactctttctctaaataaatttaatccatgtgtgttatatgttgtatatcttcatttagtgactacgaaatgtctagctatgaaatgtgcatgttaattactcattaagcctttggatcgcctttgatgagccagatcctgtgctccccggcattctcttgcacaccttctttctgaatgttttctcacagttccggcttttacatgcccctcactccaccccagacgctaataaatttctgcagttcttagttccagctcgttcttcttgtttaggttaagactcctacattcagagatctcatggacatttctgtcttgaagtctcactggttcttctgtcaatatgtggttctaataatttttcagttccttttcttggacttccaagtagataattacatcatctgtaggaagcagcaactgaatcactttctgatagttttacccctgtctcaattttttacctctttgtgttagtaagaacttctaatttgtggggaagcagtgcttcccagaattccctggaaagaatcacctgggctgtttgttaaatatacaaagtcccaggccttcacccttgggaatattagtaggtctgggttgaggctgaggaatctgctttgttttattttttaaacaaaggccctggacattttttatcttgagaaaactttggaaaacactgttttagagcagtgctaaataatagttgtgatagtcttttgttgctgcttttagtgtgtctgtaccatgtgtgatgtcagtggactgctggctctcctcctattttgacctgtggtagcacttgtgacagctttggaactgtgatgtgtccggtgtagcgatacaatgggctgtctaaacagggcagcgagctttctgtcctggtattcattcagtgacatctcagttccaggccctggagagtgccaccatacacagaagcacatgggaagacctcttagtcttccaactctcatactccctctaactccagtctgcctttcttgggatcctggctgcctgtggatctacttccatagtatttgtgtgctctgctttttttggttttagctgactagaacttttgtttacctaaacctgaaatattggtcacactccttcctacttcagttctgccatggaacccattactgcatttgagtgccagagaactgtctgctgtctgtattcgagaagcaacttctaatacaaagatgacttataacacatgaaagttttttcttacagagtaatgttttgaaagcttttacagttatgtctttggtctgagactcttatttatgtcttccactcacaggcagcactatgacagtgttaaactatttgcagttgcctaatacactatattttcttagttttatgtttttgaatctgcgattctagtttcctttatctcctcttctccccatcctcccagctttcccttaccaacctctgtatatcctttaattagctcaggtatcactactttttctgattctccgagtggtttgatgtgtctcttcatggcccgctatatcacactgaatacctcttttaaagcacttttcacactgttataatcatcttcatagaatctgcttatttgtctatatatttcattagattgtaagtcctcagtttattttcagcctttgcatcccaattacctgctacacataatcaacgtttattgaagaactttatgaaagttggcattttccacttgttccagttttaaattactttcgattttggaaatgttcattttatgcccagccaacttgcaaaaaatgtaggagattgataatattcagttttggcaagggtgtacagaggagaactcttgaagattcttggtaggagtatgaatagataaatgcaggtgacagaatttaaatgcatgtaacctttgacctaacagttcctcatataggaattctcccagaaaaaacacttgtaccaagtatactaggatttttgtaggagagtatcatagagtatcatggcagcgttatttgtgatggcaaaaaaaaaaaaaaaaaaaaagagagatggccaaaacaccaaaacatccattagtagtgaaatgattaagtttattatggtatgtacttactatgggattctgtgtggtagtcataataagtgaaatagatctggaaagatctattttattttatttatttttatattttttgagacttaatctcactctgttgctcaagctggagcgcaatggcacaatctgagctcactggaacctccgcctcctgggttcaagtgattctcctgccttagcctcccaagtagctgggattacaggcacacgccaccatgccctgctaattcttttttgtatttttagtagagatggggtttcaccatgttggccaggctggtcttgaattcctgatctcaggtgatccacctgcctcagcctcccaaaggactgggattacaggagtgagccactgtacccagccaggaaagatctatttcatattaaataggtagtcataataagtggaatcgatgtggaaagaggttcatattgaatgagaaaagcaagttacatagcagtatatataatgatctcagttttgtaagaatagatttgattttgtgtgtgtttattatttttcttatttatgcataggaaattgtctagaatagtatgcaaaggaaaaaagccctgtttatcaagttatgctatttaaattacttgatttttttcaatgatgtgtaatattcagtattcatttaatttgtcttcctctggaatgtctgagttatccttttttgaactagcaagtaatatataatttcttattatgaaatatatcaagcatatagaaaagactttattggctttttaacattttgctggatttgcttcagacctttttgttttttttttttttttttggagacggagtcttgctctgtcgcccaggctggagtgcagtggcccgatcttcgttcactgcaagctccgcctcctgggttcatgtcattctcctgcctcagcctcccaggtagctgggactacaggcacccgccaccacacccagctaatttatttttagtagagacagggtttcatcgtgttagccaggatggtctcgatctcctgacttcgtgatccgcccacctcggcctcccaaagtgctgggattacaggcatgagccactgtacctcgcccagatctttttttaaaaaaaagaaagaaaacattacagagaaatttgaagctctccatatcctccaaacccattttcctccttcctcagagataacctctattttaaatttggtgtttagtattttcatttatatttttgttttttattactcatatgtatgtgaccattcataatttatggtgttgtatctcatgtttttaaacttcatcaaaatagcatcatggtgcatgtaccctacaacagtttccttttttaacctgcattctttttcaaatgatctccatgttgatgtggttattttcagtgccatatagaatccacacctgttatcctcctattgattgacatttagcttgtttctaattttctacttttccaaacacagcttcagtggattttctggtacaagtcttctggtgcagcgtggagagtttctcttgtttttaggagtggaatccttgggacgagaggagtgtgcattttcagttttattcgatattgctaaattactctccaagctggctttactattttacactcctaccagcaatatatgagctttacttatgggtaatatattacctttaattctcttgtaaagcagtaaaattctcaataaattttttgaaaaaaaaaatgagactatgaactgctggttaaaactatatagagaaaataaattctgtccatgatattaaactaatgtttaatagaaaagccaatactcagtgcaacatttttccctgttgtgtgtactcacctcatccccctgtctccatttgaatgcttcccacccaggctaaattgatgacagcccaattaggagcaaagcttggccttgaactttggtcaaaagctttgtttttccctatacacattcacagctttttcagttttaaaagtattagcatttcatgtagcagttattcgtatttcaaggatacccttcttagccccagggttggtgtgtatggaaccataaatttatattggctatcatgacagatctagtaatgtgtcagtctactgatgttgaattctagcaaatctttgtattttttttctcgaaagggaagccaaagctatttgccgctgagcacaagatgcagctgtccttatgtagctccctccttggctgttgttgaaccagttggaataacagtggcttctttttcgtgggttaaggggtttttgtaatctataagcatgtttcagatatgtgaacaaattacattttattctacctagcctttttttttttttttttttttgagaaggagttttcgctcttgttgtccaggctggagtgcagtggcgccatctcagctcactgcaacctccgcctcccaggttcaagtgattctcctgccttagcctcctgagtagctgggattacaggcgcctgccaccacacccggctaatttttttgtatttttagtagagatggggtttcaccatgttggccaggctggtctcaaactcctgacctcaggtgatctacctgcctcagcctccctaagtgctaggattacaagcatgagccaccgcacccagccctacctagccgtatttttattactgtgagctaaaactcctaagtcttggaagattaacaaaaattacatggattatatttctctcatatgttaatcaaaattatagcttaccagttaaactggagcttagcaattctaatttttcactttttattgcagttattttgaagccttttataaaataacatattggttgagtgatgtgtcacatgcctatgactataggcatactcccagctactcgggaggctaaggtgggaggattgctagagcccagaagtttgagaccagcctgggcaacatagtgagatcccatctcttaaaaaaatatcaactgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaaatcaaaaagagaaattatataattttcaaaataaatttttatgaactttaattgtataaaaagaaatgggaatttcaaagtggtagacggagggcaccttacttctgaggcttagatagattagaatttttaaagtaatctgtaagtacaatgggcagggcaggcggaaggaaaggaaacccttagtaggcctcaggctctgaagaatctctgtgaaaagtagatgagatctgtttgcaaaaggaaacctgagtccagaaccagggcaggcgagcattgctgctaatgatggggatagtgtcgtcagtgttcttgcttggaagtagttgctgcggggagctgtgaggggcccagggccagtgacagggcaatgctggaagtgtagcatggtgatggaggtgtctcaggcaggtgtagagtatataggagcttggattgcagagacaaggtagggttccaggtgctggatggattctaggaaaacaggaagctaccttgctaagaagactagctataaagcttttcaatgaggtggcaccttccatccctctttcactctcactgaaaacaactcccattcctgccctccaggcaggcagcacacagagtagatgtctgaacaggaagtcttgactacaaaactgagcacttagttaaaaatcaccccaaatgagaggaacacaactggagaagataactgaggaggtaacaaaagaatttatcttagaaatagaattaatagaataagcagaactagattttgcagcaactatagttaattcctcagagagatatgagcagttatgttttctaccaaaaataattaagtagtgatcctggaaattaaatgtttgattgttaaaataagaaattaaatagatgagctgattaacagggtttatagctgaagaacaaatttgtgagctggaagctagaacagagaagtattccttagtacattactattattataaagtaaaagaaaacaaagtgtagaggatggattgaggagttccttctaataagagttccagatagaggctaaagaaaatgcagagagatgatacttaagcaatagatccagtttcaagatggttgaccaagcacatcctgaccttgtcctgtttctacaccaaatccatagaaatggtaagacattaagttagattaataaattccctttccagattaaaaataagaaatgttccatacccaaagctgtaagatatctttaagtgaaggtggtatgtgttaaaatgagaagttgcagaagggaaccgctaacactgcctggaggaagttctcagtactgctgggaccctgaagctgctcagccaactccttcagaacagattcagccaaggatccccagccgggaggccactgttgactcacattgcaagtggtcagtcctggaggatgtttgcatggccaacaaccatgaaaatccaggggaagcctagcacaacaatataaaatatgaacatatgaaatatcaaaagcagatttataccctaggaagcagagcaatcaggaaactttaaatataggtaaatataatttccttagaagaccaaggatagactttcatgcgcattaaaacaagcagaaatcataataaacaggcagtcgtgaaaatgaaaaatatagttgttaaagtaaactcattggatgggctacatagcaaattggatgtagctaaagaacaaatgagttaactaaaagatcagggtgagaagaagttcttccaaaactcagcatcaagagataagaaatagagtatgaaggaaaagttgaggcatttgggacagtgtggaagttccattatttatctaataggagctgtcagtgaagaaaattgaccagagacaatgtttgaaaaattgaggtctcagctgggtgctgtggctcacgcctataatcccagcactttgggaggccgaggtgggcagattgcttgaattcaggagtttgagaccagcgtggccaaaatggtgaaaccccatctctactaaaaatacaaagattagccgggtgtggtggcacgtgcctgtggttccagctactcaggaggctgaggcaggggaattgcttgaatacaggaggcggaggttgcagtgagccaagatcacgccattgcactccagcctgagtaaaaaagaaaagaaaaattgaggtctgaaaatattctagaatgtctgaaaattatttcagaacatctgaaaatattctagaatttccagtactgaaaaggtataagccctcaaatattaaatagaataggcatcattgtgataatgatgaagagaaattcttaggaaacactggagagaaaagactgatggtcttcaaaagaattgaaattcaagtgctagatgtcatcactggttttaagaaaacaatagcaccgtgtttttttttgtttgtttgttttgtttttgtttttgtttttgagacagagtctcgctctttcacccaggctggagtgcagtggcgcgatctcggctcactgcaagctccgcctcccgggttcacgccattctcttgcctcagcctcccgagtagctgggactacaggcacctgccaccacgcctggcttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaacaatagcatagcgtctttaagctgctgagagaagtaactctgaactaaaattctatcccatccatactagctttcagcagcaagtgtaccacagtagcattctcagactttaaggactttgctggaaaaactgtttaaagatatactggctgggcacagtggctcacacctgtaatcccagcactttgggagggtgaggcaggaggatcacttgagctcaggagttcgcaaccagcctgggcaatgtggtgaaaccccatctctacaaaaaatacaaaaattagccgggtgtggttgtgcatgcctgtagtcccagctacttggcaggctgaggtgggaggattgcttgagctcaggaggtcaaggctgcagtgagccatgattactccactgcagtaagaaagaaaatgaacccagaaggtaataatgggatccaagaaaaaagaaggaagcaaataaatcaggaaaacaacaatggtccatctaagcaaatgttggttgtaaaatataagatgatttttaataagttgcaatttaggtcaacaaagttagcaacaaggaattttatgggtaggtggagcaaaaagggaaataaaaacatgccaaagaattcaagaggactatataaaatgtaactccaacttgtaagaaaatattattttaagtatgcattaaaaatttaagggtgactactagacaagttagatataaaatataaactttaaacctattataagataacagtagcaaaaacaaccttgaccaatccaagagaagacaggaaagtaggagaaaagaaagtcatgaaaaatagaagatacaaaataagtcctatgattaaatttaaatgtatatattgatatatgtatattcataatcaaatatatattactgatatatatatcagtaatcaaaataaatggaaaaactaaactcatctacttacaagataaaaactcagatttaagaaaacaacaaaaaccacttaggtgctatgttagaggatacagttaacaataaatattattacatatattataattttacaaaatattaacatgagacaaaacaactcaaagcaggcaacattgggatggaccgagggagacttcaaatgctagaaagtgaaatttgtcaagaattggtgtcagcacaagcctgtttatcctgctcttagtaacattgcatgtttgtgggtgtatgtatttatgtgtatgtaaacatatacataagtaattattacagaggctttctgagtgatgtccccggttctgcccttttcccttcagtctgttctaaatatagcagccagaatggttctgctaaaagcatcagatccttatctgctggatgcactccaagagcttgtcacctcattcagggtaaaagccacagtccttacagtggcatagaaggcactagcccacctgacccccttacctctcagctcatcttctgccctactcccccttactccactccaggctgactgcgctcacatcttgccattctttcaacacaccaggcaaacttgcattttagggcctcgcacttgctcttccttttgcttggagagcccattccccagatgtccatgtgcttccctccctcacctccttctgttcttaggaagaagcctccctgaccacaatgcagtaaaattggaaattaacaacagaaaggaaaaaaaaaaaaccttaacacacatcttgaattttaaaagaatataaacttctaactttatggaatgacaagaattcataatcaaaattaacaaaattaaatgactggaaaagcacaatgtacctaaacctatgctttacatctcaaatgatacttgatgaaaaatcataaccttacatgtactttctaggaaagaaaagattgaaaatagaggaacctagatttcagtactctgaaactgaaagaagtactgataaatctgaagtagaagagtaataaaaatgaacctaaaaattattgaaataagaaacttgatcacgataacaaaaagatggctatttgaaaaaattagtaaaataggtctaatttattgactaatttctttaaagtacaaacataatttcagaaatgaaaactgatatggggtacagacagttttgctttctgtaattataagaaaatactatgaacaactttatgctgataaatcggaagacctaaatgcaatatacaattttctaagaaaataggtattaccaaatttggtaaaagaagtagaaaatctttaatagtcaataagcaagttaaaaatattagaatgagaatcaaagatctacattccaaagaaagcatcaagcctcgactatttcacaggtgagttctttcaaaacttcaagaaacagataattttcatttgatatataccattccagagtacaaaattggaatgtatccaaccaattttactaggccagcataaccttcatccccaaacaggcaaggacaacaccaaaagagaaaattataagctgtcttcccataaggatacaggtgcatatttgggaggccaaggcgggtggatcagctgacgtcaggagttcaagaccagcttgacccaacgtggtgaaacctcgtctccactaaaacacaaaaatgggctggacatggtggtgggtgcctgtaatcccagctactccggaggctgaggcaggagaattccttgaatcgggaggcggaggttgcagtgagccgagattgtgccattgcactccagcctgggcaacaagagtgaaactccatcttaaaaaaaaaaaaaaaaaaggaaagaaagaatacaggtgcatgactcttagtggtagattaaaaaaaaaaagaagtatacaggtataaaatttctacattaaaaaattagtaaatttatttgagcattatcaagtagcacttatcctggaaatgcaagaataattcaacttgcatttaaaataattgaaagtctggccaggtgtggtggctcattgctataatcccagcactctggcaggtcaaggcgggaggatcacttgaggccagaagtttaagaccagcctgggcaatgtagcaagaccctgtctctacaacaacaacaaaagaattaacttagcacagtggtgtatgcctttcgtcctagctactcagaaggctgaggtgggaggattacttgaggccaagagatcaaggctatggtgagcgctgattgcaccacctgcactccagcatgggcaacagagcaggattctgtctccaaaaagaaaaaaaaaaaaagaatagaagatctatcctatcttgttgcaccaacctaattgctgactccagcaacatggcaaactaagctaattgtaatctcctttctccaatgacagagacatgcacgctggattaaacataacaacaacaattgaaatgtagaatttagcttgattaaaagtcagagaaagccctggctatcagaattaaacctaacactgtggtgttccaggggtctatcagattggatactggatttagccccagaggttagggtttagtgcccccatgaagtaggaaatctgtcttgggttcacgaaacaaggtaagtggaactaatatttctgtaaaggccaggactttagaagagctgcctccttaaaacaaagaggggctagaaaaactccagtggcccagagaaggtacaaaaaatatccagcagccaggctctgggaaaaaagaaaacttacaaaatctaccagttttctgaaaagtttagaggaaaaagattttattctagtgaacagtttgcacactggggagatgcagcctttggcacaaaatgaagcctttggcacaaaaccttgtgagagaaccaagagagggttgtctattatagggaaaggtcctgtccaggttcccaccctggtccacttatgcaaaggacggttgcagacttgcctagttctgattggttgatgtttgctgagttctgattggttgatgcaagtcacagtctattgcctgaggtaggaacagacagttatgaaagtcccaatgttaaataaacatagggtttgctgggaaggcagagtatgtgtgtgacctctagccagcaaatggctgcttggctgtatttgaatttaggccatttgccactcaggattcatctggaaggattgactctttcagggttcgcaagttaaaaattaagtttctaagccgggcacggtggctcatgcctgtaatcccagcactttggggggccaaggcaggcccatcacttggggtcagtagtttgagaccagcctggccagcatggtgaaaccccatctctactaaaaatacagaaattagccaggcatggtggcacacacctgtagtcccagctactcaggaggctgaggcaggagaattgcttgaacccgggaggcggaggctgcagtgagccaagatcgtaccactgcactccagcctgggtgactctgtctcaaaaataaacaataaagttcctcaggcccagtagcagcatttctagtgttcagtaaccacacggggctagtggcttccatattggataatgcaggtatagcaagtcttcatcatcccttaaagttctgttggataatagcactgctctgaagtacctgccagaagaagacaaaaaaaatccctctgtagccatacacttccacagctcagttcaaatgggactcctatgcagaaaacaacccctgctaagggtgagcttattaccaaaaattgcaaacccaatcacaaaacaatctactgtgagggaaaatcagcaaacaaacacaacagataggtttagcatgccaagaactttagaaatggcacattcaaaaagttaaagaaatgaaattgggaatagtggcattgttaaaagggacaagttgaatgaaaaaaggccaaatttaactttcagaaatcaaaaatattaaagttaagctcaatggaggggttaaatagaaagttagagactgttcaagtgaaaattagggtatgggaattagatgtgatgagattaatcagaatacagagtgctgaacacagataaaaggagatggaaagtgtgaaaggtgagtaaaggatataaagggtggaacaaaaagatcaatccagatttctctacccagctaatctattcaagagcaaagaagaaataaaggtatttttcaaaaaagtctcaaggagtttgtcaccaacaaaacattgctgaaagaattaataaaggatatactttgagcaaaaaataatttgaggcaagaaggaagaaatagtgcaaagtggaattgataaatgtggatgactttaagcaccaggtataaataataattactaattttggtgagcttataataaggtgcagctgaagtactaaactatggcatgaaattggttgaggcatgattaaaggactgaagttaccaggtgaggttacagatgttgattaagattgtggtaagtgttcatgttaaaatagagaaagttgttgacttgtctgaggctttagcaggctttgtaccaagagtctgccactgggggatatttttctgcttagatcccctcagatggtgtggcttggagttcaggatgatgtgctcagaaagagagagtaattggaagtgaaaatgacaggaatggcctcaaagtcaccaatcctgagctttttccattaggctgttatgttcccaatgtcagggcctgtcagcgtataccctgagctgaagattgtgctgtgcaaggaattagcttgaggctgattgaaaacacagtaatctgagctcaagaaaaagttttgcagagtatcgcagtgcctggttcatggttatccgaggaaaacaagtctcagccctggcacaggagcacacatgaaaccattgcagtgagtcgcctgctgcccactttggaatctgtccctcagttggacaccgtgtccccacccctgactcaccttcatgacccaacccgcgagccctgagggtggtactccacatcccccacgctgggctgcgggtgcctgtttctttctaagaaatagaatgcctcactgccgtggctgtccctcctagttgccagcggttctttctcttgagtaattttacctgttgaggggctgtttgtaccacaaaaagagtgacagacctggttatatgagccttaatttttacactgagtgttaatttctgtgcctatatgttaacatctaattcataaaactattttgagagttaaaagcacccattaagtccctgacagtaagttctcaataaatgttactttaacaacagcaacaacaaaagtagctgctagaagagtaaactcaaagagcaaatttccaaaagaggaaaataaaataagaaaataaaacctgaaaaggacaaataggaaaaagacgaaacaagtaatgacataataagccataaaaatgaataaaaatatattactaatcagtaaattcattaaattttctagataaaaagcaacagttgtcaaatatttttaagaatctgtctcagccaggcgcagtggctcatgcctataatcccagcactttaggtggccgaagtgggcagatcacttgaggtcaggagttcctgaccagcctggccaacatggtgaaacctgtctctattaaaaatacaaaaattagctgggcgtggtggcgcgcacctctaatcccagttactcgggaagctaaggcagagaatcacttgaacccgggaggcagaggttgcagtgagtcgagatcgtgccactgcactccagcctgggcgacagagcaagactgtgtctcaaaaaaaaaacaaaaaacaaaacaaaaaaaacctgtctctatgctgtttacaagagacagccaaaaaataaggacacagagaacttgtaagttaagaataaaaaagacataccaggccaagtactaatcaaaacaaatttgttgaaagtatattagtcttagaaaaaggattttaaggcaaaaatctttaccagagaggttagaatggtaaactttagactttgtatatttttatcatatttaaaaagtctttaccagagatggtttatcaaagataaaaagacaaaattaacaattctacagatatataaattaaaagttaacaggaacacagtgagattgagaaatacattttcaaactggataattttaacatatccagcaatgaatgattgcacatttttttttcaaatacacaaaaattgaccacataaaggaagcctcaaaaaagaattagtataatatcatatagactgtattctctgggaaatcaaggataaaaagataagaaaagaactgtacatttggttattaaaagctaagttgaaattaacaaatttctaaaacagcgttgcttaccaaaaccgattcaagatggaatagaacacccaaataataacataattattaaagaaattgaatttgctcaatatatttacacaaaggaaacaaccaggcctgagtgactttttgtgaatttcagcaaacattcaaataaaagaataattgcagtattatacaaaatttcccagattctgtaggaagtaatgagcatgcccagtttcatttttgaggctagagggaataacattggtaccaaagtcttaaaaatcagcaagaaaaggaaaattacaagccattctcttcttacaaatataaatgaaaacatgaagaagatagtagaaaactcaattcagcagtggttaggaaaaataatatatcatgaccacactggttttattcagcaattaagggtgtattcttataatttaccacattcatagattgatggattaaatccttataattatctcaaaagactcatataaaatatttactaaacccaacatctaagctgggcacggtgaggctgaggcagaagaactggttgaacccaggaggtggaggttgcagcgagccaagatcgcgccactgcactccagcctgggtgacagagtgagactcagtctcaaaacaaaaaccaaaaaacccaacatctattgactaaacacacacagaacaacaacaaaaaccttagtaatccatgggtaggagaaactcccttaacctaatgtaaagtatttgtaaaatctgatagcatctcttacatttactggcaaaatgttgaaaaggtttaagattgaaaacaaaacgagaaggcttgttatctccacttttattcaacattttattggcgaccctaagaaatcgtaaccattgtgaactattggtggaattcaaaatggtgcaacttttgtggaaagtagtatggtggttcctcaaaaagttaaaagcaaaactaccatataatccagcaattccacttatgggtatataaccaaaagaattgaaagcagggtctcaaagagatgtttgtacactcatgttcatagcaacgctattcatgataaccaagggacagaagcatcctacatgtccattggcagttttcaggggctggagggagggggcaaagggcatttttcaaatacttccggctctatgagatgaagcgttcctgagattggttgcgcaacaacatgaatatacgtgaatatacttcaccctactgaactgtacttgtttatttatttatttttatttatgtatttatttatttttttgagacggagtcttgccgtcacccaggctggagtgcggtggtgtgatctcagctcactgcaacttccgtctcccgggttcaagtgattctcctgcctcagcctcccaagtagctgggattacaggtgcgcccaccaccacgcccagctaattttttgtatttttagtagagacagcgtttcaccatgttgaccaggctggtcttggactcctgacctcaggtgatccacccacctctgcctcccaaagtgctggggttacaggcgtgagccactgtgcctggcctgaactgtatatatatatatttttatgacaataaaagcagtgaactttattcttgctgtagaacttgcctcaaccttgttagtacctacattattttctataccatgaatattctatatcatctagcttttcttttttttttttgttttctttttttttttaattgatcattcttgggtgtttctcgcagagggagatttggcagggtcataggacaatagtggagggaaggtcagcagacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcatatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcagtcttttccccacctttcccccttttctattctacaaaaccgccattgtcatcatggccctgaactgtacatttttaaatgattgagcgttgcactccagcctgggcaacagcgagaccctgtctctaaaataataataataataataaaatgattgcgatggtgaattttatgctatgtatgttttatcacaacttataaaaaaagagcagggctgctgtatacaaaatatgtttataaaataactaggaataagaacagacatataaatcctttatggagaagaatatgaaactttattgaaagacattaaagaagatttaaatacatggggaaatgaacgcagttatggaaaggaatggtcagtatgcaaagatgtcacttctctccagaattatctatagatttgatcagttcccatgaaaatcccaacaggattttttgggtggtaaatgacaaactgattctaaaacttaagtggaaagtgcaaagggccgaagatagtgaacacaaccctaaagaagaatgtaggtctggggcacttgcacttcctgaaaagacaggaggaagctgtagtcataaaatcactggtgttgttataggagcaaaaatagaatatatatccagcaggaatatatgtaataatagtccatttattaaataatggactattaaatgataaatgtaagtagtaaatgtaggacaaaattggattatttcctgatgcctatcaagacattatttctaagtagattcagatttaaatatgaaaagtgaagagtataaaacgttttagacggtaatttggaagtataccttatggcctcaggaagggaaatatttcttaaggtacaaaaagaacagaatataaaggaaaaaattactacattgggaccactgatatttaaagatgttcatcaaaaacatagcagagtgagaaacaagcctcataataggagttgtttgtaagatacaactttcctagggttaaaatacaaaaagtataaagaactcttacaaatgagttaaaaaaaaaaaaaaaaaaggcaatccagtgcaaccctatgacaaagacaggaacaggcatttcacagaagaagaaacacaaatggcccataaacataggaaaagaggctcaatctttttaataaccagggaattgcaaattaaaaccacagtaccattcatcacccaccagcttggcaaatgttaacatgtctggcaataacagttggccagaatgtgaagtttaaggaactctcacacagctgatgagagtggaaattaatgttaccactttgtaaaaacaaattggcagtgcttagtaaaattgaatgcgcgtaacactatgagccagtaattccactcttacaaaattcttatacatggccactaagagacacggacaggaaagttacaacagcattgtgaatgaatggaaaacatggaaacaccccaaatgtttgtcagcagtggaatggatatataaattacagtgtaattaaccaatgaaataccatcaagcagtgaaaaaaatgaatgaattgcaattacatccatcagaatggataaattgtaacataactgagtgaaagaagcaagtcgcagaagactatatagagaactatacaggttttatacatatctaaacaatgtattatgcataattgctaaaataataaagtcaaagaaatgattaatacaaaatccaggatagtgattatcaggagaggaggaggcagagtgggagtggggtatagtgttaggatgagggtctgtaaggagtcttcagagtgactaatgttctatttcacaggcagaatagtgggtaggtaggtatttgttttataacttttaaaactgtactgtacagttgggtgtggtggctcatgcctgtaatcccagcactttgggaggctgaggtgggtggttcaactgaggtcaggagtttgagaccagcctgaccaacatggtgaaaccccgtctctactaaaaatacaaaaattagccaggtgtggtggcatatgcctgtagtcccagctgctagggaggctgaggcaggaaaatcacttgaacccaggaggcagaggatgcagtgagccgagatcacgccattgcactccagactgggcagcaagagcaaaactctgtctaaaaaaaagaaaactgtacaaacacattttatactctttggtgtgtgtatatatatgtagatttagagacagggtctcactctgtcacctaggctggaatacagtggcactattgtagttcactgcaacctcaaactcctggactcaagcgatcctctcacctcagcctcctgagtggctaggactacaggcatgtgtcatcacacctggctaatgtttggatatatatatattttttgttgttgttgtttttgagatggagtcttgctgtgttgcccaggctgatcacgaactcctggcctcaagtgatcctcccaccttgacctcccaaagtgctggcattataggcatgagccaccatgcccagcctgatatattttaaaaatataacctgtagtatttttaagagaggataggaaatgttttgaaattaggtaaaggggattacggtatttaaaatcattgcctaagagtatttagagaatatttcactttctacgttaagacctctccattaaatcagttttagagtgcaagttgggagaaagtacagagaccttaaagagcatctctgatataggagcttaaatgaagtgaaggagactctgggtcccgcacctgtagtgttcttcttctgtcctcgctccctctttgcttccttaaatttttagtcatccactctcaagtctggggccttgtcctaggggctgactggacagaagagctaatgcccctgtcatgacacagcatttttcaaactcttgcttagagactttgttatagtagcctcctaaactaactcattatcaaaattcacttcaggtccaagtcataatctgagatcttttaaggaaatcccttattcatgtgtttagacaacctaattggatacatagttttaaaatttttagggtaatctcttttttggtttctcctaggccttagttaatactctaattacatgtctttatttcagtcttttttccttcccatacataccaagctgcccttgatgtgccttaattatttggaattcatcttgatgtattgattttacctttctatttcatggctattatttttaggatggagctaaagtagtctgtgtgataatgcatttcacatacattgcatgaattaatggcagatatagcaaaaaatcatgaaattaatacatggatgacagatgcagtgtttcattataaaggtaaaagtaaggtgttctctttgatgtcctctgattgcatctacttgtaatcctcaaaaaaaaaaagatttatatggttttactaggtaggtaaaagcaatctggaaaattcatctaggtaaataatttgttcaaatacaaagatgaataagatgtagatcctacccctcagaagcagcagtataacagagatggacaaacaaattaaaaattgcagtatggggccaggcacggtggctcatgcctgtaatcccagcactttgggaggctgaggcaggtggttcacgaggtcaggagattgagaccatcctggccaaccaggtgaaaccccgtatctactaaaaatacaaaaattagccaggcatggtggcacgcgcctgtagtcccagcaactcaggaggctgaggcaggagaattgcttgaacccgggaggcgctggttgcagtgagccgagatcaccccactgcactccagcctggtgacagataaataaataaaagctctccctctcccctctcccgtctcccatctcccctctcgctctcgctctctgtctccctctttctaccgtctccctctcttgcggagcctggactgtactgccatgatctcggctcgctgcaacctccctgcctcgggctccggtgattctcttgcctcggcctgctgagtgcctgggattccaggcacacgccgccactccttaggggtttttgtgtttttggtggagacggggtttcgccgtgttgaccgggctggtctccagctcctggcctcgggtgatctgcccgcctcggcctcccgaggtgctgggattgcagacggagtttcactcactcattgctcaatgttgcccaggctggagtgcagtggcgtgatctcggctcgctacaacctccacctcccagctgcctgccttggcctcccaaggtgctaagattacagcctctgcccgcccgccaccccgtgtaggaagtgagcagcatctctgcctggccgcccattgtctgggatgtgaggagcccctctgcccggccgccccgtctgggaggtgaggagtgcctctgcccggccgccaccccatctaggaagtgaggagcatctctgcgtggccgcccatcgtctgggatgtgaggagtgcctctgcccggccgccccgtctgggaagtgaggagcgcctcggcccagccgccccgtctgggaggaagtggggagcacctctgcccggctgccccgaatgggaggtgaggagcgcctctgcctggccgccccctctgggaggtgaggagcgcctctgcccggctgccccatctgggaggaagtgagaagcgcctctgcctggctgtcccgaatgggaggtgaggagcacctctgcctggccgccccctctgggaggtgaggagcgcctctgcccggccgccccgtttgggaggaagtgaggagcacctctgcccggctgccctgaatgggaagtgaggagtgcctctgcctggccacccccgtctgggaagtgaggagcgcctctgcccggcagccaccccgtctaggaagtgaggagcgcctctgcctggccgcccattgtctgggatgtgaggagcccctctgcccggccgccctgtctgggaggtgaggagcgcctctgcccagctgccaccccgtctaggaagtgaggagcatctctgcgtggccgcccatcgtctgggatgtgaggagcgcctctgcccggccgccccgtctgggaagtgaagagcgcctctgcccagcaaccctgtctgggaggaagtggggagcgcctctgcctggctgccccgaatgggaggtgaggagcgcctctgcctggccgccccctctgggaggtgaggagcacctctgcgcggcctccccgtctgggaggaagtgaggagcgcctctgcccggctgccccgaatgggaggtgaggagcacctctgcctggccacccccgtctgggaagtgaggagcgcctctgcctggctgccactccgtctaggaagtgaggagcgtctctgcctggccacccatagtctgggatgtgaggagtgcctctgcccggctgccccgtctgggaggaagtgaggagtacctctgcccggttgccccgaatgggaagtgaggagcacctctgcccggctgccccgtctgggaagtgaggagcacctctgcacggccaccccgtctgggaggtgaggagcgcctctgcccggccgctcttcgtctgggaggtgaggagcgcctctgcccggccgctcttcgtctgggaggtgaggagcacctcattgtctgggcggtaaggagcgcctctgcccacccgctcttcatctgggaggtggggagtgcctctgcccggccgccccgtctgggaagtgaggagcgcctctgcccagccgccccatctgggaagtggagggcacctctgcccggccgctcttcgtctgggaggtggggagtacctctgcccggccaccctgtctgggaggtgaggagcgcctctgcccggccgcccatcgtctggaatgtgaggaacgcctctgcccacccgccaccctgtctgggaggtgaggagtgcctctgtccggccgccaccccgtctgggaggtgaggagcacctctgcccggccgccccgactgggaagtgaggagtgcctctgcccagccgccccgtctgggaagtgaaggagcgcctctgccaggccgccccatctgggaagtgtacccagcagctccgaagagacagcgaccactgagaacaggccatgacgacgatggcggttttgtcgaaaagaaaagggggaaatgtggggaaaagaaacagaaatcagattgttactgtgtctgtgtagaaagagatagacataggagactccattttgttctgtactaagaaaaattcttctgccttgggatgcgttaatctataaccttacccccaaccccctgctctctgaaacatgtgctgtgtccactcagggttaaatggattaagggcggtgcaagatgtgctttgttaaacagatgcttgaaggcagcatgctccttaagagtcatcaccactccctaatctcaagtacccagggacacaaacagggccgaaggccaaaggccgcagggacctctgcctaggaaaaccagagacctttgttctcgtgtttatctgctgacctctccactattatcctatgaccctgccacatccccctctctgagaaacacccaagaatgatcaataaatacttaaaaaaaaattaaaaaaaaaataaacgctgcatttccaaaaaataaataaataaataaataaataaataaaaataaaaataaaaattgcagtgtagcagcagtatagcatggtgagtgcaacagtggaaacaggtacaggtaaatgggtagcctggaaaggcacttgctgtcgtatggagcagtgaggaaagtcttcacagaggaaaggatgctgaccagcaggcttgagagatgagaaaaaaatgtacagaaagatagattgggaaagggagacctgggaaaggcacatgccaagatacagagacctaaaagaacacagtgtattttgagtcaactgtgagcagcttatcacttaacgtgagtgggaagtagaaagagagagaggcaggagtcaggtgtgaaagcttttgtatggaaaatgaaggcatttatttagatctcattctgtaagtgactatcagcctttgatggatgttaagcagaagagtgacatgatctctgggggcagtgcagaaacggttttaataggggaagaatcagcgtcacatcacgacttgttgggcaaaaggaaaatggaaagaagttaggggagaagttgagaatttctatgtttcgctttatatactttcaggaaattaggttacatctagacttttcccagaatgtttttcttttcttttcttttctgtcgcccagggtggggtgtagttggcacaatctcagctcactgcagcctcgtcggcccgggctgaagcgatcctcccacctcagcttcccgagtcactgggattataggcacatgccaccgcaccagctaatttttttgatactttttgtagagaccgggtttcgccacgttgcttaggctgatctcaaactcctgggctcaagagatgcacccgcctctgcctcccaaagtgctgggattataggagtgtgccactgtgcctgaccaagttttcccagaatttagtatgttgacgggaatagtagaaggtgatttggagccaatatacgaagtttctgaagaaattgtattatttagtctttattataaagtattcattaactgtgcctatatggtctttcaggcaaacagatttttactttgtgttaaaatactacaacaagcagcatatagaagtctattggggacgtggcattgatgaggcagacagctgcagccatgttttattttccaattaaagtggcacatatgataataaactgcagaggcagcagaatgaaatatttaaacttttttacagttaatatcctgccaagaaaatctcagataacagtgttattttaggggaattgggtggacggtataatctgtataaaaggagcctcctttaaatatgagttttagaagtgaatgttctgtgtaacctaattgtggcatgttgcttacttttgtgcttatttatgattaaatcttagacttggtagtctttggtggatattattctaccttccagaagaatgtattggtatgccaacttatttttgtaatatagagtcctgggtctggtgctgcctgtgtattgtgaatgtactctgtatctgtatctgactgcataaccagacccctaatatcaaatgttctgcctcatgtttatttgggaatatcctaacatcttggggatgtgacttacttagctaatttgctaacatccataagctgtgtgctcttagccttttagtatcgtagcccatcaaaaagttctttttttttttttttttttttgagacagagttttgctcttgttgcctaggctgaagtgcaatggcgtgatcttggctcactgcaacctccgcctcccaggttcaagcaattcttctgcctcagttcccatgtagcacggattacaggcatgcaccaccatgcctggttaattttgtatttttagtagagacatggtttcaacatgttggttgggctagtctcaaactcccaacctcaggtgatccacctaccttggccttccaaagagctgggattataggtatgagccaccgtgcctggcctccatcaaaaagttccgactctgatcaggaaattaatgttaacatcttagcaaaaaggatccagaagcatcaaaggagggagttcttgccaagagtacatagagatgtccagaaggaaagttgacattacttgatagtgtgactttatagtaaacatgagggaggaactgcagaaatgaaggaccacagatgaccttggaacaactggaggttcctttctgaaaggcccaatgatattgatgtaatgaaacttgatttgtatttgaaaagatgtttttacactcttgtcacaaagtttttttcttttttgaagttcctttcattcttttgaagggttaattccttactattttctgctttgacacagaaatctcctgcaaagaagctgagccatgcaattagtaaatctttggggtgtgtacccacgagagaacccccgcatcctgtttttcctgagcaaccagagaaaccacttgaccttgcacatatagtgtaagtatacccctggatgtgcatgtggatcacactgaaatgggggccttgtgaaattcctgtggatcaaaaccagggatcacttaacatgaccattcaacttctcaggtttttactttcttttgtgggaacttaagacttcaagctttcttctctgtaaatcaccgttaagtgtccacatggaaatctagctcctgattgctgaagcctgagtaatatggcagcctccagaaacatgagcccattgaagagccattattgttctggttttagctgggctgccttttgtgattttgggttcattccttaaatcagtggcagagatctttttctctatagcagtaatgcccatagggacttaaattaatgtagacaacatggaaatgaaaatcaacttaatttgctgttttttgtattgagggaaaattaggaaacataagactatattctacaaataaaactggtattttgtatgtatttatttatatgtatttagttgaatattcatgctagtaaagcaaagctagaggagaacaataaagttgagaaatagagaaagaacaaagtagggaggaagagaaacagtgaagggtaagattcagcctgtaaactgctttcttcactctgaattaaatgatgatactatgcttccctgatgaataaatttggtagagttttggatcacgaatctttatcaggtgtcagaagtttttctgttggagtgggcattcattttctttcacctccctgatggaaggtagtttgactaaatgagctctagagaatcttgatcttttttccttttttctttcaattatttagatacctgtttatatttattaaaataatccatgcatgtgaattacaaattcattcatccataagagcttataatgaatgcaacataccctcccacacttcgctgtcctttgggttttaaatctactaatagttatctctgtatttctaaataatatgtttggagcaccatttcttgacttatcagttttagacattattatcattattattttttgagacagggtctcgctttgtcacctagtctggagtgcagtggtgtgatctcggctcactgcagcctccacctcccaggttcaagtgatcctcccacttcagcctcacaagtagctgggactataggtgcaggccaccatgctcagctaattttttttaatttttagtagagacggtgttttgccatgttgcctaggttggtcttgaactctgggttcaagtgatccacctgcctcagcctcccaaagtgctgcgattacaggcatgagccactgcgcccagccagttttagacattattgacttacttttgtggtgtaatgaatcagcctcatctctaactctacataccaacccatccctgtttttcataattatatcaccatttttaagttggttacctttttaattttaaataatattttaaaaactctatttcttaataacttctttttgacttccactttgtaaacagaaaattagcaccttctgtctacttttcctttgcctcctaacgtctgccatctgtgcccttatttttatgttgtcaaagctgagaatgtttctattctcttcgataaccataactaagtcttctgagattgatcaagggttaaatctaataaagccaaataatggcatttacagttagtatccttcattacacagtcacatagtgtgctgcaattctgtggatccttttgtgcagttactgtctcattggagttcactgggctcttctttcttacctaccattgattaccgaaaatcattcctattgaatttttaactggattgattttcttgtacagttgttgtttttcctgcggtttctcattgctttcttcttcttgggaaaaaagatgtctcccacccctacacagtgttccatagcacagtttatctgttccccataatgcaatttttttttttgttaaatctgttaacctttttcccttttgggtcgtgtttttccttgcctgcctctcaacattatagtggttttctccttacttttttctttaggttttaaagatggccctttcacatatgtctttaattcatttggaatggatttttgtgtgtgatgtgatgtagaatatccagttctcttccccagccgctcgctttctgcatttgaataataacttgtctcagggtcattcattagataattcaacatttccccactgactacaatgccaccattgtcaaaaatgaagtttccaaatacgcacaggctggcttctggtttctttattctgctcctttggtcaaattgtccatccctatgccaatatctcactgtcttaattaccataaggaactaagtaatctactttttctggagtgtcttgtctattattagctctttgctctttcatataaagtttagactcatcttattgagttcctcataacattttgttgagatttttgatcagagattcactgaatctaaagatcaaattggggagaattgacatccttctggtattaaagctttcattccatgaatgtgtctttgcatttatttaaatatctttttatacctttaagtaaagttttataattgttccccaggaaagtctttatatattaggttaactctcatgtcacttgacatttgtaattgctgttacaaaaagtatcagtagtgtcctttttcctacagctatttaagatatactttacatgcaataaaatacacctactttaagtgtacaattcgatgtgttttggtaagcgtatgctgttatgcaaatggaatattttctgaattatatttcttaacagtttgttactagtgtatggaaatgcaaatagtttttgtattttagtccactgtctatgtagttatcttgcttaaattgttcgttaattctggtaccttatactcagattcttttgaattttctataaataattatataatcggcaaataatgactgctttgtgtcttcccttctgtaccttatacttttgaaaattaatcatactttttgcagggctagcagcatactatgctggctagcccctccggtgcaatactgaatagaagtggtttagaaggcatttttgtgttattactaatcccacagagaatgctttcagcattcatttagtatgttatttgatgtaggttttgtagaaactatttatcgggtttaagaggttcccttttatttctagtttgctagaaataaaaatgctttctttttgtcatgaatggatgctgaattttatcaaagagtttttctgtattgagatgattatatgattttctctattgatgatcaaagactttttctttattctgttattgtagtgaattacattaattgttttttagcatcatctttaccttcccagaataaatctgagttggccattgtttgaatacactgctaggttttgtttgctaatattttgtttagattttggctatgtttttgagtgaaactggcctgtaacttccctagatttgggggttatttttattttgttgtttttatcacccagtgtgtgattcttgcaaaatgggggagcattctctcttttcatatttttggaagagcttgttcaagatttggaagggttattttctttgtaaattttttatgaaactcactaatggagccatctaagcctgaagatttctttgtgggaagatttttaactggtaattccatttttaaaaaacaattagactatttttattgtttatttatttttgaagttaccttggagtattttgtattggtaggaatttattaattttctctcaattttaaaggttattgatacaacgttcataatattttattgtctttgtaagtccacagtatgtgtgctaatgggccttttttatttccactctcgtgtatttatggcattttttctttctcttttttttttgagacagagtctcagtctgtcgccaggctggagtgcagtggcaatctcagctcactgcaacctccccctcccgggttcaagtgattcttctgcctcagcctcctgagtagctgggactacaggcatgcgctagcacgcccagctaatttttgtaattttggtagagacggggtttcaccatgttggccagaatagtcttgatctcttgacctcttgatccacccccttttggcctcccaaagtgctgggattacaggcgtgaaccaccgtgcccagactccttttctaatttctttaaaggcatggttagcttactcatttcaggttttttaatttttttattttttccccctagtagaagcatttaaggctgtaaatgtatctgaaccctatctgggtattacccaagttttactgtataatattttttgttgtttacttctaaatatttcccaagttatgttaggattcttctttgagaagtatactttcttaatttccaaacatatagaggttttctagttgcctttttgttattaatttataacttacttttagtctggaaaatggtctgtatttttcagttttttaaaattggttaagacatttgttattaacatcattactatgatatgtggactttttccaccattttatttgtgctatttatcatattttttaaaattcccctttatggaaatgtcccactcgagtcaccttttcccctatagataaccattctaatgtgctcgtcgtgtatgtttttgttagcatacgttcttaaaaagtattgttctgtatgtccctttaagatatttatttatggctgggcatggtggcttacacctgtaatcccagcactttgggaggccaaggtgggtggatcatctgaggtcaggagtttgagaccagcctgaccaacatggtgaaatcctgtctctactgaaaatactaaaattagccaggcgtggcggccagtgcctgtaatcccggctactcgggaggctgaggcagaagactcacttgaacttgagaggcagaggttgcagtgagctgagatcgcgccattgcactccaccctgggtgacaagggtgaaactctgtctcaattaaaaaaaaaaaaatatatatatatatatatatatatatatatatatttatatatatttataagtgctattgtgaacagcattttacctgtccgttctccctgaggtggacacgttggttgcttttagacctctgcctccacatataatgccacagtgtatggcatgtttcccccatggagctgcatgagagtttctatgtattaatatctaggatacagttctggggtcaaaagttctgtgaatcctgaccaggagaagtatgttggagaatccagtagttttagcatagaatttcacttaatctcttcgttttcattcaggctccatacccctgcctccacctggggctcctgagctcaggggctttctgcttagtttgacttgagagtaacctctggtttcctggtgggcctagaaaggagtagtcatctggcaatgtggtgttgggagtgtggctggaggtggtggggattgggtgggaatttgctgcttcttatccattctttcaaccagtcctcttatcttaatgcaacctctcacccctccttcagaggttccaggcctttctgtggctccacttccctgtctttgggtgaacctgacttcacgtttcttctatttaaaaagccctccccatatcgagttttctgttagaaatttaagtaaaaatgcagctgggactgagagctaagaattagaacttggatttttccttattaattcttattttattctatatatttgccttggatttttttttcttttttttttgagacggaatttcgctcttgttgccgaggctggagtgcaatggagcgatcttggctcactgcaacttccacctcctgggttcaagcgattctcctgcctcagcctcccgagtagctgggattacaggcatgtgccaccacccccagctaattttatatttttggtagaggtggggtttcacaatgttggccaggctggtcttgaacttctgacctcaggtgatccacctgcctcagcctcctaggattacaggtgtgagccactgcgcccagcttggatcttttttaaaaaatgaataaaacattgtagataaaactgtggtctcctgtgtccctcttcctcatctaatcacgctttccttttcccaaagggtagccactatcatttgtttggtattcatgattttatactttttaaactacttttattagatatttatacatctataaaaatcagatatgttaaaactgtatataaatggtcatgctctacatgtcgttctgtaagtttattactttattaagtaatatgtttttgaaatttatccaaaatctccaatggtattccattgaatgactttaccacgagtaattcattcttcattgctggacattatttccgatttttcactatagcctacagtgctgctttgagcattcttgtatggagaaatcctgtaaggtaggaggctaactactgggtcctgggatatgaatattacatattcaggatagcacgagtaataatatagtagcagattaaccaccagatctcagtggttcagctcataaatgtttgtttgttactcacacccagtccgttgtggactggaatgactggagcagccaacctgggcagtggttcgatggtgtaggctgctttactcttgtggctccaccatcttcacacgagccctcctcattgctgcagcaggggaagaaagcgtagggacagctcagagccattcttctgtgctttggttcagaaatgacacataccacctgcctcacagccccacctaatttcaagcctgaatagccttctgtgtacctagggaggagaggagaaccagatactggtcagctgtagtaacttgttctacaaatgtcttcaactctacaagatactacctagaattcagattttatagtttaactatttatcagtccgaattactcccaagccaagaatatagtcagcagaccaccccccccaccaaaaaaaaaaaaaaaaaagctctggtagattctctttcagatttagatgagatgttgagcagttaatcctatttagtttgactagataacttttgaggatcctttcaactttgagtttctatgtcttacagatttttttttctgtattcaatacgtgttaatggttcccaaacttggctgataccaagatcaatcagaaggccttaaaaagtacagaagggccgggcacggtggctcatgcctgtgatcccagcactttgggaggctgaggcaggcggatcacctgaggtccggagctcaagaccagcctggccaacatggagaaacctcatctctactaaaaatacaaaattagctgggtgtggtggtgcatgcctgtaatcccagctactcgggaggctgaggcaggagaattgcttgaacctgggaggtggaggttgcggtgagccaagatcacgccattgcactccagcttgggcaagaagagggaaactctgtctcaaaaaaaaaaaaaaaaaaaaagtacagatgaccaagttacttccattctaggtcaacttaaccataattctggaagtggcctaagaatccaccttttgaaaaagttccctaatacatctgatcagtttacagaaccactgcattaggaggacataaagagttttagttatatgaaagcaaactaaaaattcaacactaagtattaagaaatgttcagagtgcaatgcagagtacaaatacaaacatatgagtagcagttctttttttttttttttttggagacagagtcttgctctgtcgcccaggctggagtgcactggtgtgatctcagctcactgcaacctccgcttcccaggctcatgcaattctcatgcctcagcctcctgagtagctaggactacaagtgcgtgccaccatgcctggctaactttttgtattttttgtagagatggggtttcgccgtgttggcctagctggtctcgaactcctgacctcaagcaatctgcctgccttggccacccaaagtgctgagataacaggcgtgagccactggcacccagccatgaatagcaattcttaacgcttgctaagattcttaattattcattaattcagcaaatacttattgaggaccttctagctactctgcaaggtgctaacagtgttcacatagtactttgtgcatttgcaaataggtttgagtgtttgcaaataggtttgagtgagagtgaagaagccagttttatatagttgcagtaggctaaccagaatttagttcatgagatccttttaattgaaggttaatgctgttgatagacttttctgataggctcaccaatatttccttttgtgtgtagccagcaaaataataaattagtacaaatcgaagtctgactctttagaaaatgtgtggactccaggcctggtgcggtggctcatgtctgtaatcccagcactttgggaggccaaggtgggtggatcacctgaggtcaggagttcaagactaacttaaccaatatggtgaaaccccgtctctactaaaaatacaaaaattaactgggcgtcgtggtaggcccctgtaatcccagctacttgggaggctgaggcaggagaattgcttgaacccaggaggtagaggttgcagcgagccgagattgcaccactgcactctatcctgggcgacagagcaagactccatctcaaaaaaaaaaaaaaaaagacctcagtttgcctttctgtaaaatggtgttaataaaacctgtcttaattgtctcaggatttttttaagataatgtatgagaaagtgcttttaagtggctagaaggctataaacttttaaagtcttttccttcaaataaagttaatcatgtcacaaaaatgtaaactccacaaaggctggactttatcttgttctccgccgaattcctattacctgaaatactgcttggtgcgtggtaggcacctaaaatgtattgagtgaatgaattatacccaacacaatttatatacacaggcatctgactcctccccaccatttatgtttttgcgttttgttttggttttggttttctttcagaaagtaatacaagtcatgtacctacagtttcccaaagccaccactagatgtcaggcatatttctttgtgttcctttctggggggtggtgagaatattgagtaaacaaggtttttcaaataaattgcaagacgtgtattcaaaacaaagccaattcacgtatcagcactctagcaacttctcttacttccaggtctctgagagaaatgagttgcttcttttggcaaaaacatatttataccacgtctacctctggatgcctctaacaggcttcctgtgatccgaattcaagcaatttgctcttgctaattttctaaccacagagttcttaagcctaatctctttaattagtggttagtcaccattgcatttcagtttgtgtagatttatttctgaggggaagcaaaacttcacgtgttggcttagtgtgtctattaccctgaattctagcgagaaagagcccagtgtcttccgctgcacacacctgggattcatcttaataggggtgggcaaactatagcctgcaggctaaggccaacctgtccctcatgatctaacaagacctttacatttttaaatgtttgaagagaaataagaatattttgtaaagtgaaacttacatgaaaatcacgtcagtgtccgtaagtaaagttttattgggactggcctcagtggctcacccagcattttgggaggccaaggggagtggatcacttgagttgggagtggatcacaggagttcaagaccaccatggccaacatagcgaaaccccgtctctcctaaaaaaataaaaattaggcgggtacagttgcatgcacctgtaatctcagctactcaggaggctgaggcacgaggattgcttgagcctgggaggcagaggttgcagtgagccgagattgtgcctttccatcctgggtgacatagcaagactctgtcttaaaaaaaaaaaaaaaaaaaattattgggacacagccatactcactcatttttatgttgtttatggatgctttcgagctccagtggcagaattgagtcattaacgactgagaccaaatggcccttagagcttatattatttactatctggccctgaaaaagtttgccaacccctgctctcaaagaagggtgtctaaaaactgcaaatttagggcactttgtgcttctttagactcttttttctgaatgatcatcatctttggtttgatggcccaagttgttttttcacgcagcggtgaagataacaccttttgctgaaggactcagataaaatttgttacctagaaaccagactgcctcttactgacagaaagtcttttatttgtttcttgcatcctttgcatacataaatatatagcatgtttgaacagctaagccaaccaattttctccgcacattgcatcaaaacagaattaacctagataattaaaaaatactgttatactgttatttaaattatactgtaattataaaactgtaattacagtaatactttaatgtggctctaatttgttctattttaactgctcttctgtttaatactgacttagactctgtgtatacattactttgatatgaacttaaaaaatctgttctctttgttgtttttttcctatacctcataaatcttctttttgaactttagacaattatgctttaagtatcggtgctatcagtgcttatgaactttttggtaaaacacaaatatgcttgttttctacttattcataacaactttaaatatatcagcagaattcaccagaccaggaataatataagaccatttgtaaccctgtgaaagaacaagtctaacttcttgtttatgttgtttaattattaaagcacatttttgtgacacttcttttaaaatgatggatgagtctggagttaaaaatggcttttgtgacaagggcacttatggtgaattgccttgctgtttacagccatttttaattgttttgtttgtttgtttgtttgagacggagtcttgctctgtcgcccaggctggagtacggtggcagaatctcggctcactgcaacttccacctcccggattcaaacagttctcctgcctcagtcacccaagtagctgggtcacacaccacgcctggctaatttttgtatgtttagtagagacggggtttcaccatgttgtccgggctggtctcaaactcctgacctcgtcatccacccgcctcggtctcccaaagtgctgggattacaggcgagagccactgcccctagcctacaactttaataagccaattttttttttctgaagagagttattaattggttttattgtattctccaattatcgggtgttacagaattcataatattgataagttagtctgggttgaaacactgtcttccacagtatttattgagtgtgtattgtgagttgggctttcttcttttgatgggagactagagtcttatttgaggaaactgacaagatgatacttttttcttagacctctaggtgaatctgatgttccaattgcttgaaaggagtatcagattcattctaggtatcttgatctcctgagactgaacctgtttggaagattgtaatcttgaaccatttctgacaggtaaatatgcaggttgagcatctcaaatctgaaaattcaaaatctggaatgctccaaaatccgaaactttttgagtgccgacgtgacagtccaaggaaatgctcactggtgcatctcagactgtagatttttggaattcgcatggtcaaccagggtaaatagaatgcaaatattccaaaatccaaaatatgaaacactctggtcccaagcattttggataagggattctcaacttgtactttgattcctagatcatagctcatctgatattaattgtcttgcattttgctgtaatgattttttgggttatttgttttttagagacagggtcagcaccataagacagagtgagaaaacaaaagtaaaaaaaaaaaaaaaaaaaagtagaaacagggtcttgatctgtcaccgaggctaaagttcagtgacatgatcacagctcattgtaacctcaaaactcctgggctcaagagatcctcctgtctcagcctcccaagtagctaggactacaggcacatgtcaccacgcctggctaatttttatatttttttgaagtgatggggtcttgctatgttgcccacgctagtcttgaactcctggcctcaagaagtcctcacacctcagcctcccatagcactggattatagacatgagccactgtgcctggcctgctgtaatgattttgaaaaacttaccgttggtgacatgattttgcttaccagtgggccattaggcaccttggggtctattcaatttgtctttttggtaaaagaagagttgctttttgttctcctgtatatatagcctagaatgtgaaggccattaggtcacagctcatctgatactctttctggcttgcattttgctgggatgaatttgaaaacctagaaggtgaggaatacagggttgtcttagggccttgagcttcactatgtcctggtatgaatgttacctgttttgctccgtttcaggctgaaagtcccagaatcattcttctgagcttaaggttgcttactagccctggaattatacctctccaaaaaggaaagaaagagcaaagagggctatgcatcatctaagacagtcctagaaataggataacgtttttgcctgaacctcagtatgtatgtgtgtgtgcatgtgtgtgtgtacgtgagtgtgagtgtgtgtgtgttggggtgagggagacgggaacttgcactcacaaactcacacatgtgcatatatatgtgtggtacctctgtgtgtgtgtgtgagagacagagggatgcttatgtgaacagtaaatgtgatgagtatggtgcagtgaggagaaacagcattatgtaatacaacaaaactcagaaccatcaagctttagtccaaggagggtgattatttacaagtggctatgactttgttctgctgagtttcactctgcccttgagattttctcaccctgtttgccattatcctactataaagctctctgcttttaaactcaaaatctcacaaaacttcacaaatcatcatcccttagtattctttttttttattgtggataaaaaaataatataaaattaactatcttaattcttttaagtgtacggtttttaagcgtacagttcagtaatggcaagtgtaatcgtgttgttgttaaacagatcttcagaactttttccatacccgttaaacagcaatgccctttccctccaccccctgtgaccaccgttctactttatgtttctattaatttgactgctttacatacctcatgtgagtggaatcatatggtatttgtctttttgtgactggcttatttcacttagtataatgccctcaaggttctgtgttgcagtatctgtgttgcagcgtgtgacaggatttccttcctttctaaggctgaatgatattcattgtatgtagataccatattttgctcatccattcatccaccgttggtaagatgtggtacctacatacaatggaatattattttgggtggctttcacctctgggctattgtgaatagtgctgttatgaacatggatctcttggaaaccctgctttcagttcttttgtatgtattcctggtagtgggattgctggatcatatgttcaatttttaattgtttgaggattcgaggaaccctcatattgttttttacagagattgcaccattttataatctcactagtactgcaaaagagttccaactttgcacatccttgccaacacttgttattctatgttgatttgtttttatagtagccatcgtaatgggtatggagtaatatctcattgtgattttgatttgtctttttttttgaggtgtaatttatgttctgtaaatttcacccactgtgacagttaaattattttcagttaatttatacaattttgcaaccattgccaccatcctgtttaagaatatttccatcatccaaaaagttccctcctatccatttgtagtcaatcccagctcccacttccagccctaaggcaatcaccaaactacttcctgctttttctagaaattacacataaacagaatcgtacaatatgtagtcttttgtttctgacttatttcatttagcataatatttttggggtttatccatttgtttcaagaataaataggtcattctttttaatgttgaaaatatcctttgcatgaatagatcacattttgttatccattcaccagttgatgaacattggtctcatttttagtttttgactcttatgaataacgctgctatgaacattcatgtctttctgtagacatatgttttcatttgtctttagtacatatctgggagtagaactgctgagtcatgcagtgcaagcatatgtttaacttttttattttttttttggatacagggttttgctgttgttgcccaggctggagtgcaatggcacggtctttggctcattgtaacttctgtctcctgggttcaagtgattctccttcctcagcctaccagatagctgggattacaggcgcccaccaccacgcccagctaatttttgtatttttagtagagacggggtttcaccatgttggccaggctggtctcgaactcctgacctcaggtgatctgcttgcctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaacacaaaaccgtctctacttaaaaaagatacaaaaaaattagcggggtggggtgatgcatgcctgtggtcccagctactcaggtggctgaggtagaaggatgacttgagcctgggaggttgaggctgcagtgagccaggattataccactgcactccagcctggatgacagagtgaaaccctgtctcaacaaagaaagaaagaaagtgacaggactattttacagtcccaccagcaatacttaagagttccagtctctccacattctcatcagcacttggtatattgtcattctttggactatagccatcctagttagtgagtggtaggatcttactgtagttttaattcgtatttccctaatgactaatgatattgagtaccttatcatgtacatattaaccatccacatatcttctttggtacaattgtctatttagatattttgcctacttaaaaatatttacataaactttttattttagttttagatttacagaagtttcataaataggacagagtttctgtacaccctgcacttagtttcccctgttgttaacatcttagaaatgaagcagccaggcgcagtggctcatgcctgtaatcccagcactttgggaggccgaggcaggtggatcagctgaggtcaggagttcgagaccagcctggccaacatggtgaaaccccatctctactaaaaatacaaaaaattagccgggcatggtggcgggctcctgtaatcccagctactcaggaggcttaggcaggagaattgctcgggaggttgtagtgagccgagattgcgccattgcactctagcctgagcaagaagaacaagactcagtcttaaataaataaataaataaataaataaataaatgcatggatatccacttgtctaagcaccagttgttgaaaagaccattccttgcaccattgagttgtcttgccatctttgtcaaaatcaaccgactataaatatgagtttatttctcaattctgtcccattgacctatgtgtgtatctgtccttatagctgtaccatatgatcttggttactataacttaacagtaagttttgaaattgggtagtgtaagttctcttctttttcaaaattgttttgggtattttaatcctttgcatttccacacacattttagtctatacctgtcaattttaacaaaagattttgatagggattctattaaatctgttgagcaattctcctcttcttccttctcatactctacctttcttctcccttgttttttttcggtgtgtttgttctgctttttgtttttcttgccttctgtgtttgcattgagtcctgtatagggcacagtcatcttctatgtataacaaatccttagcagtagccacaactgtggatatattccctttgattcaacccacttttatatcctgcttaatgataataatgtcaatgaaaaatccttttaagatttttcagctgggcgcggtgactcacgcctgtaatcccagcactttgggaggccaaggcaggcggatcagtttaggtcaggagttggagaccagcctggccaacacggtgaaacctcatctctactaaaaatacaaaaattagccaggcgtggaggtggggcctgcaatcccagctactcaggaggctgaggcacaagaatcgcttgaattcgggaggtggaggtttcagtagccgagagccactgcactccagcgtgggtgacagagcaagactctgtccccaccaaaaaaaaaaaaaaaaaaaaagatttttttcaaagatgtttctttttatgtgaacttacaatacaaatcatctgttcctaaaagggtgttagatgtatgcaaagaaaattcagagatgaaaattcagatctagtaaattcgtttagcactacaatatatttgtcctatgacataacccagcacatgtctttttttgtttttgtggggggtgggggggcttttatcccttcagtgacttccccttacacttaaaagccgaagtctatacaatggtctacaaggccccataaaatctggttcctggcaacctctctaactttatttcctgccactttcccattgctctatcctcctttgttattctggttttgttccttgcaaataccaagtgtgcgtccacctcagggcctttgcaactactggttcctttgcctgatgtgcccctcatcctcatactcacatggcttatttgtttatgttattcagatctctccttaaatgttagcttctcagagatactttctgtaacttttttatctaaaatagcaccatcagtcactctgtttcctcttaccttgtttcagtttctgcatgacacttgccattatatgacattttaaaaattcatttttgtatttgtttataatctctaccctattagactgtaagttctttgaaagcaaggctttttttttttttttccccaccaaactcattttactgccagagacaaggactttattttacttcctgctctatctccctatctggcgtgggtctggcagatagtagatcttaaatacttacagaatgcataactgcatgtgtatctatatgtgttcatgacttactaatagtagtgatattcatgaggcattcaggttattaaatgatatcagtgtgtcagaatgaggcaggctttatttcttgtggggttttttttttttttttggttgttttgttttgttttttctttgagatggagttttgctctgtcacccaggctggatgaagtgcagtggtgtgatctcgggttactgcaacctccacctcctgggttcaagcagttctcctgcctcagccttccaagtagctaggactacggacacccgcagccatgcccagctaatttttttgtatttttagtagagacggggtttcaccatgttggccggctagtttcaaactgccgaccccaagtgatcgcctgcctcggcctcccaaagtgctaggattacaggcgtgagccaccaagcccgacctatttcctgtgtttttacagtgctagaccaataattcaaaaattgaagttgaaagcaatggttctctagttcattatgattgttttaaaaatccttaaaaagtaatcattcatagtattggagaaatttgcttctctttgacatttatttcttccctatctaaacctaagttatacctgtaatataatttcatgcagacattgagcctcaggattgtatttcatttgaatggaatttcttaataggatttgtatactgactgcaatttagaataatttgaatatttctccgcacctttgcaagtcttcacattgcccacttttgactggtgcctgagtttagaacctgctgtgttagctctctttcattcttctcaaaactctgatctgtctacatatttctaacaaattaatcttcttgagtcactgcctttgtcatattacttccctatttaaaaatctacaaaacctcactgcctgtagaatgaaggaggcactcctcgtgctggaattcaaggcctgtgtaatcgggacccaccttacttttggaatcttatcttctactactaatttatggaggacaaagcctctgctctgccagacctgctgccttcctaccctttaaaactttattgccctttccaccaagctagctcatgatgtcccagcccggctacctgctttcctgaatgtcctacttgtctctttcagatttacaggttttctatatcctggagtccagtttaaatcctggtatgtccatgcaaccttccttaaaccctccaagtagctaactcatatggatctcttctttgcattcctaaattccttgagctcttattgttttatcagtcatttgatcatccaataaaatgctatctctttccttaaggatttcttgagtatgtattaaaccaggacttcttgaagattgtaagcactttctttgcaccttcaactttttaagggctgggattgtacatctttagtgcctggcagattccatgtgtttgtgggactgaactttatactgatttgtgtttctagaggatggagcacaattgtaaattctagttgaattaggttaaattcagcaactttcttgtagtccctctgttcaaggtcacattataggaccttgcttgttgatttggtatgcttttgctggtcctactgacgctttggaaggcaaccaaagagtagttactcaaactgtaaaaatctgtattttttatgagtttttggagagaagtttgtcttttactaccagaaataatcctggaagtcaagataaggttggaataaggcatctcctttggtgtaaagtggcccttttcttttgtctcgctttttcccctttggatcatgttaatggaataatcctaagggtaaaactggagactttggctccaagcatgaatttaaagaaatgttcagttaaattgtattgaataatctacatccttggtttttcacttttttaaatagaattgttttggaatttaagggacttcttttttccctttagttatttcttctaagctgtgaccacctcatgtttaattctatataaatccagctgttatttttcactcatttcctgtgtccagtttatcacaaggaaaacattcttgtgaagagcttctccatagagtttattgagatgaatttttaaagtcttcattttgagaaattgattaaactgctactgatgttatctgagtgagctcagccctattgaaagcttaaaatctaaaactgatactgtatgaagtatcagttccatatggaagcattaaaaaagtaacccgattgggcgcggtggctcacgcctctaatcccagcactttgggaggccgaggcaggtggatcacctgaggtcaggagttcgagaccagcctgaccaatatgatgaaaccccatctctactaaaaatagaaaaattagctgggcatggtggtaggcgcctgtaatcccagctacttgggaggctgatataggagtatcgttttaacccaggaggtggaggttgcagtgagtcaagatcgcgcattgcactccagcctggccagcaagaacgaaactccatctcaaaaaaaaagtaaccttaaatttgaaccaacgtgaatttagggtatgaaactgatttatattgacataatctatgcatttctcacataaatgaagtgaataaatacaaataaatggtacgatgctgaacaaaagaataccttttaagaaaatcttttgtgtttccatataggtttaggacattaatatgtattgttcatctggttgtgtgggcactctaatttataagctgatcacctcaaattccctctcacatttaccaagttgtcaggtaggaaacataaacattttattcctgcccctttgagaaaatcagcgtagaagcatgttataatttataattacaaagaacaaaggcctaaaagagaaattcctaaccacaggcccactttcacatgggtttgaaaccagaatttataccatatttttagcccccaaatcccaactcaggaatttaattaaatttaaagcttctctatttgggtggtgctcccagaaacctgtcagaagcaaacataaattctctttgtagaaaggcacttaagctgggcgtggtggctcacgcctgtaatcccagcactttgggaggccaaggcaggcagatcacttgaggtcaggagttcgagaccagcctggccaacatggtgaaaccctgtctttactaaaaatacaaaaattagctgggtgtggtggcgggtgcctgtaatcccagctacatgggaggctgaggcaggagaattgcttgaatctgggaggtggaggttgcagtgagccgagatcgcatcactgtactccattctgggcaatagagcgagactccatctcaaaaaaaaaaaagaagaagaaaggcacttaaaaacctcagccttgagtaatctccacagataagttccaaggaacttgaactcacgtaagaaaaaaataagctggcctgtgtaagaattaacaggaacaatacattaaagtcctacaaagagtgtgaactatcaaatacagcatataaagtaaatatttttttaaaaaaggagtatgttaaaagtataaagtatggagaaacaaaagaatataaaaattaccagaaaatctgaaaaggaatcaaataaaactaggaattaaaaaaaaaatagaaacctcaattagataaggtaaatatcagattagatttagagattataaacctacagataattggaattccagaaggacaaaataaaaaaaattcttggtaaggccaaaagataatgaatggaaattgtcccaagttcatagcagtggtcaacaaatcttaattaagaatctaggccgggcatggtggctcatgcctgtaatcccagcactttgagaggtcaaggtgggcagatcacttgaggtcaggcgttcgagaccaggctggccaacatggtgaagccccatctctactaaaaatacaaaaattagccaggtgtggtgatgcgtgcctgtagtcccagctacttgggagactgaagcacaagaatcacttgaacccaagagatggaggttgcaattgagctgagatcgcaccactgcactccagcctaggcgacagagcaacactctgtctcaaaaaaaaaaaaaaaaaaaaagaatctaaaagaaaattcatacctacacacatcatagtaaagctagaggaccccagagacaaagaaaagatactaaaaacaaatagaagattatttacaaagaattgacaatttcacagagagctgacttctgaagagcaacattagaaaccaaaggagagtggaatacgatcttccaagaactgagaggaaaataataatcctaaaattgtatacccagtgagaaaatacctgtcaagaaaggcaaagacaaaaacatttgcagatgaataaaaatgctcactactaaaggaacctcgctaaaggaatttgtaaagggtatgtttcgaggagaaggaaaatgatcttaggcatttgacaaaattcaaccctcaattcacatttttaaaaactctcagaaagttaggaatagagggtaccttctcaatctgaaaatgcacatctatgaaaaacctacctagctaccatcatacttaatgttaaaagactgaacattttaccttaatattgggaacaatgcaagaatgtcactcttagtgcatctattcagcattttactagtgatcctagctagtgcagtaatacgagaaaaagaaattaaaggcattcagatcgaaaaggaaatattaaaattttctttattcatagatgacgtgattgtgtacatagaaaatgctaaggaatctacaaagcaaagtactagaactaacaaagttagcagtattgcaggacatagatcactttaaaaaaatcagtggcatttctgtatattagcagcaattaggaaatgaaattttaaaaagcaataccatttataatagcattgagaaacataacgtaggaatacatataatgaaatatgtgcaagatgtgtaaactaaatactacaaagtattgctgaaagaaattttagggccgggtgcagtggctcacgcctataatcccagcactttgggaggctgaggtgggtggatcacccgaagttgggagtttgagaccagcctgaccaacatggagaaaccctgtctctactaaaaataaaaaattagcccggcgtggtggtgcacacctgtaatcccagtttctcggcaggctgaggtgggagtatcgcttgaacccgggaggcggaggttgtggtgagccaagatcatgacgttgcactccagtgtgggcaacaagagcgaaactccatctcaaaaaaataaacaaccaagagcgaaactccatctcaaaaccaaaaagacaaacaaaacagaaatgttaaaagccctaaataaatgaagaggtataccatatttataaattggaaggccagtggtatacctagcatatttgacattcagaatggatcatatttaacagccctttcctttatatgtcaaaattgttagtaattatcatgaaatgaaacagataattactgattcctgcttttgtcttattattcctttcgttatcttcagattttctctgtttatcagtcattcagcaaatatttattgggcacttaatatgttccaggcctcacttaaagaaaaacagacaaaacaatctttgctctcatgaagcttgttttttagtggtgggaaacaggcaaaaatcttaataaataaataaattatatattagaaggtaataagtgctatatagaacagcaaaatagggaaagagggatgggcagtattggaggtctagtgggttgccatttttaataattgctttaggccttaatgaaaagtgacatttgaacatcagcttgaaggaggtgatggagttacccttttgggtatctggaggaagagcattccttgccaaaggaacaggctgggcaaaggccctgcagccaaagcatacctagcatgtttaaggaacatcaaaaagctggtagagggggagttaaattagcaagagggaaatgaaatcaaagatattatgagggctagatggtagagggtcttatatgccattgtaaggactaagtgacaagaggatgtgtttggattgctttgactgatctgacttccattttaaaaggatgttctttctggccgctgtagagaatagactaaagcagagtcaggatggaaggaaggagtcagcttttgaaaaaggtgagaggaagacttgggtggacgaggtggataacagtagaggtaataagaggtgataagatacacgaacattggatgtacttagggcaacagtatttgctgacaaatactggagagtgagaaggagaggtcagtttggcctgcacagctggaaggatggtgatgaggattactataggtagaacaagcttgggtagggtaagagctccattttggatgtgttgagtcctttttgacatccaaatggaggtgtcagatagggagtttgtatgtctggagtgggggtgtgtaacttgaccatgtaaacctttaggattctaaatacatcaagccacatgtcttattgatgtgggtatactggagaaagttacaaatgaaaaagtactaaagtactgctggatccaaaagtttaccatcttcaaaatgaaaagcattatagactgcttctaacacatcaagtgcactttcagggatatgtgtggtttggaaatacaaatttgggaattgtcaacttacagataatatttagacaagagaaaacatgtaaggatcaaaccatgttactaatttcttatttcttaacatggttattcagttaattctttttttaaaattctttttttctaatatgcatggatccaattgtaaagttaaggcaatttctaaaatttctaaacacatgagacttttttgtattctttgatgctttgtgttaattattgaattttggtgagagatgatattctgtatgataatgattctttggtagagttgagatttcttttagggcctagcatctaaacaattttcctaaaaaattgtgcttaaaaaattcctcaaattgttgggtgcaggtttccccatattctcattttatcaagcttattatgtgtgcagaaaacattaaatttaatttttaacaattcttattgatacataatatttgtacatttttatggaatacatgtgatattttgctaagtgcatagaatgtgcggtgatcaagtcagggtatttcctcatgttctcacttataactgggagctgaatgctgagaacacatggacacatagagggaaacaacacacaccagtgtctgttggagagtggagggtgggaggaaggagaggatcaggaaaaataactaatggataccaagcttaatacctgggtgatgaaatcatctgtacaacaaacccccatgaaacatgtttacctgtatgacaaacccacacatcctgcacgtgtactcatgaacttaaaagttaaaaaaaaaacaactcggtatttagggtatccgtcaccttgaatatttatcattgctgtgtgttgggaacatttcaagttctcttttctattttgaaatatacaatacattattgttaactatagtcacccccctgctctgctgttgaacattggaacttgttcctcccatctaactctgtgtttgtacccattaaccaacctctcttcatccttccccaccctcacacacccttctcagcctctgggtgaccatcattctactctctacctgtatgggatcaacatttttagctcccacctatgactgagaatatgtgatatttgtctgtgtctggcttatttcagttaacatataatcttcagttccatccatgttgcttcaaatgccaggatttcattctttttaccaccaagtagtataccacattgtctttccattgagggcatacagagaaattatttctaaataattgatatagaagtaaagatgatgtcctgtggagaactgtgtgctgactcagaacctttgactcagaacctttagcgatgatgaagacattgacgtcaaagatgcatttaaagactttggatgaaattgagtcatgaaactgaaataaagctgtatttctaaatttttgtgcttttaaattttatcagtagttgtaggaggaaagagagaaataaggtttagtaggagaagtacaagtgacagcaagcttttgatgttttttttaatggagcaagcaaaccccaaatataagttgatctttcccaagaaaggatctctaaaaactaactcaaccatgtaaacctttagaattctaaataaatcaagacatatatcttgttgatgtgggtacaaatgaaaaagtactaaaatgctgctggatgcaaaagtttaccaccttcaaaatgaaaaataccctagactccttctaacacgtcatcaagttagaaggagtttgatgactccttctaacacgtcatcaagttcagctctgtctacagtggcattcttcagcttcctgtgaaggcatccatttatcattgtccccaacctttgtatggacatgtgagagaaatcgtgacagaggaggccttgagtggagaggctggaagagtgtcattgtcagctgtacttccacctggggtactccaatgcagacaggtggggtgtggagtgagctcatagcagtgacgtggatgccagtttggatagttacttagagaggatccatgatctatcagtcaatcattatacagtatttaggcttagaaactttttcaaagccaatcatttcagatatcaattatgaattatttgtcactggagagagtaatgggcaatttatgaatatctctgaacctttggacctgaagcaaactaacccactttgaaagttagtagtaagtttgaaattggaaagtttgtgtctctaaatttgttcttcttttggaagacgctttttgggctatgtctgttgcgtttccatgtgcatttagagtcagctcatcaagttttgcaaaaaggtattttgtgattttgttaggaattgtactgaatcaatagatctatttggggaatattgctatcttagcaatatgaaatctatgaacatgtgaaatctttccatttatttaggtgttctttctttcaatgatgttttataattttcagtatacaagcttcacactttggttaaatttctttctttcttttccttcctttcttccttccttccttccatcttttccttccttcctttccttctttctctttcttttcttttctttctttctttctttctttctgccttgccttctttcttgcctttccttctttccttctttcttgcctttccttctttccttctttcttgtctttccttctttccttccttccttccttcctttctttccttctctctttccttctttctttccttctttcttttctttctttccttccttccttctttccttctttctttccttctctccctccctccttccttcctccttccttccttccttctttctttcttcccttctttctttctttccttctttctttccttccttccatctgtccatccgtccgtccttcctttctctctgtcacccaggctagagtgtagtggtgcgatcttggctcaatgcaaactctgcctgccgggttcaagcaattcttgtgcttcagcctcccaggtagctaggattacaggcatgtgccactgctcccagctaatttttgtatttttagtagagacagggtttcaccatgttggccagactggtctcgaattcccaacctcaggtgatctgcccacttcggcctcccagagtgctgggattacaggcgtgagccactgcgcccagccaggctaaatttatttctacatattttttatgctattgtaaataaaactgtttttttttttcttttttttgagacagagtcttgctgtgtcgcccaggctggagctcagtggtgccatctcagctcactgcaagctccacctccagggttcacgtcattctcctgcctcagcctccccagtagctgggactacaggtgcccgccaccacgcccagctaattttttgtattgtttttagtagagatggggtttcaccgtgttagccaggatggtctcgatctcctgacctcgtgatccgcccacctcagcctcccaaagtgctaggattacaggcgtgagccactgtgcccggcctcttttcttaatttcattttcagatcactgttaatatctagaaatacaattgaattttgtaatattgatcttgtgtcctgcagctttgctgaacttgtctattaactctaatagttttgcttggttggttgttttgtttagagacagggtcttgctctgtcactttggctggagtgcagtgacacaatcataactcactgcagcattgaactcctgggctcaagtgatcctcccacctcagcctcctgagtagtaggaccacaggcacgcactaccacacctgtctaatttttaaaattttttttttggagggagagagtctctctatgttgtccagtgtggtctcaaactctggcttcaagtgatcctcctgtctcaacctaccaaagtgttgggattacaggcgtgagccactgcacctgactctaatagcttcctttgtgtggactctttagagttttctgtgtatgagatcatgtcatcggcaaatagagataatttgacttcttgacttcttccttcgtagcttcacagtctggactttttttttttttttttttttttttttttttttttttggagaaagggtcttgctctgtcactctggctggaatgcagaggcacaatcatggctcactgcagccttgccctcccgggctcaggtgatcttcccacttcagcatcccaagtagctgggaccataggctcatgccaccacaccctgctgattttttttttttttttttttttttagacagttgctctgtcaaccaggctggagtgcagtggtgcaatctcagctcactgcaaactctgcgtcctgggttcatgccattctcctgcctcagcctcccgagtagctgagactacaggcgctggccaccatgtccggctaattttttgggtttttcttagtagagacagggtttcaacgtgttagccaggatggtctccatctcctgacttcatgatccacccaccttggctgcccaaagtgctgggattacaggcatgagccaccgtgcctggctgctctgctgatttttatacttttttagagatggggtttcgccatgttgcccaggctggtcttcacctcctgggctcaagtgatcctcgcgatcttcctgcctcagcctaccaaagtgttaggattacaggagtgagccactgtgccaagccccagtctggacatcttttatttctttttcttgtctaatggttgtggtgcacccacttagtcttaaatgatggtttcactgggtttagagtccagccaaagttgttttctcttcattgcttgaaggtatcgctcctctattataatcagttttgctgatggcaatctgattctccttcctttttgtcgaatgtctcattttgctggtaaacttttaggattttttttgttttttgttttgttgttgttgttgttgttattttgttttgagacaggttctcactcagtcgctcaggttggagtgcagtggtgcaatcacggctcactgcagactccacctccctgggcttaagcaatcctcccacctcagccccacaaatagctgagaccacaggtgtacaccaccatgcccagctaattttttatttttgtagaaacagcatctcactatgttatccagtcttgtcttgaactcctgacctcaagtgatcctcctactttggtctctcaaagtgctgggattacatgcatgagcctctgcatttggccaggattttttttaatactttaataaatctgaagttttactataacctgtctgtatataagctttttgagtttctatttaatttaatttaatactcaggattcttagtttctgaagactcatgccttaaatctgaaaaattttcagccattgtctgtttagatactatcgcctctccttcattctctttagtttgtctgaaccctaaaatatagactttaaaacttttggattgctgggcacagtggctcatgcctgtaatcccagcactttgggaggccaaggctgatctcttgaggtcagaagttcaagagcagcctggccaacatggtgaaactctgtctgaaacccaacaaaaattagctgggcatggtggctcacacctgtaatcccagctactcaggaggctaaggcaggagaatcgtttaagcctgggaggtggagattgcggtgagctgagatctgactactgcatcctagcctgggcgacagagcgagtctccatctcaaacaaacaaaaaattagctgggcatggtggcatgtgtctgtagtcccggctagttggaaagctgagaggcaggaggatcctttgagctgaggagttcgaggttgcagtggcagctatgatcctgccactgcactcaagcctaggtgacagagtgagaccctgtttcaaaagagaaaagaaaaaaaaaaacttctagatctagcttttacatttaacttattttttatgttcatcaatctttagctgtattcagttttgttttgttttttgtctcaataactatggttttcatttttaaagcctctaattggttatttttcagaacatttgatggatgctgttttatcctttaggggcctgaggatcttaggtatttgaagacctttttggatgctctgttttctctgcttttcggggggccccatgggggtcagaacctaggttcttccagcctcctcaaaagtggccagcagtccttgtgtgtgtggctcatggccgctgagaagcagcccttgctcaccactatgattcttcattttcttccttagaggatactttttcattttgtttaggcattaaacagagtttccttttttgttttggtcctagctatacatgcattaattatgcattaatttatgtttatatctttaagtcattttttttttggcacaggagggtgagctctccgcatgtgctcactctactaccttgtactggaagtccctggactacttctgcagctgatttatagttcactggcaaagcactgtctcccaaggtctctgtgtggtcttttcagcagagacttagatacacattttaatgaaatggtaggtggtttttctttcccttggcaaattctctaatgtcttggggcattttacatttcttttaggttcttttggtccagaaatgagatgctaagaatgattgaacagcgtagttggcctgatgtgtttagtacgcatgaggagcgctgctgcctctgttgggtgtgtgcctgtttaggcctcattactcctcccactcacagatttttgctatcccaaatggcttatctaccagccttctttgaattccttgtctggatatcttttccatttaaaattcatgtcagttgagcacccgaccaattgacacttttgggtttcagccaatacattgcttaaggtagattagaatggtaagtagatggcctggcacagtggctcactcctgtagtaccagcactttgggaggctgaggcaggaggattgctgaggccagaagttcaagaccagccctggccacagagtgagatcccatgtctacagaaatataaaaataaaaaaaattaactggatatggtggtgcacctgtaatccaagttacttgggaggctgaggcaagaggatcccttcagctcaggagtttgaggttgtagtgagctataatcatgccagcgtactccagcctgagtgaaagagcaagaccctgtctcaaaacaaaaccaaaaaaaagaatggtaagtagaattataaaagctcagctataagagagtcattcataattgaactaatatttgttgagcaaccagtgtgttccaattgtggttttcagtacacattgtgaatgcaatgaagacagagatgaaacaagtactagggtccctgctctcgcaaagtttacaagctcataagtgaaaccaaccaacaaataaaaactaattacatataatagcaaattatgataagtattatttaaaaagaagaggatactatgagagaatatagcagggacttctaatttaaattttgtagtcaggaaaggggttttcaaactttttaaaaaagcagtagaacattttattcctatgaaatgttatgtggaatagaagtggagctacccttattggaacaagattggggcctaacatccttcgtctgttccccttgctgttcatcatggtcactgaagcaccatgtggcatcctcagatccccagagcacagcatgtgaaaatcagtgctctagaaccagcccctgtcatttcacagaccagttagctgagacacacagggcttcattgtccaaagtcatgcaggtcacataatccacttagtatcagagttggagccagaaccaattttcccaaactttttcccactctccactgcccccctttccttcctgatatggttgtttttgtttttgtttgtttggtttttttttttgcaatgacacgatctcgactgagtgcgtcctccgcctccccggttcaagcgattctcctgcctcagcctcccgagtagctgggattacaggcaccctgccaccatgcctggctaattttcctatttttagtagagacagtgtttcaccatgttggctaggctggtctcaaactcctgacctcaggtgatccacccgccttggcctcctaaagtactgggattacaggagtgagccaccatgcctgaccttgatatgttttcattataaaattatggtatttcaatctcataatctcaaacattctatagatcttttttttttttttttttttttgagacagggtttcattctgttgcacagactggagtgtgatggcatgatcatggctccctgcagcctcaacctcccaggctcaagcaatcctcccacctcagcctcctgaatagctggaaccacaagaatgcaccaccacacctggctaatttttgtatttcttttgtagagatgaggtttcaccatgttgcccaggctggtctcaaactcttgggctcaagcagtccacccgcctcagcctcccagagtgctcccagtgagccactgcactcggtctgtagttttttcctgtaattaattttacccattattgttcacattgcccttcacattctgcactgtgtccctcatctatatccttagagtttgtagccttgaaagatgatatcccactgttattttgtttttattatatttctgatatgaatcagctctttcatcttctgctcagtagtctaacacatgcacccattttattttaggctcttagtttggatatctgagtgtgtgtagtaacagtcacactagttggtttgtctgatttgttggcttggcttttctcacttcttcatttatctaagtaaataatagaattatttcccgggcactgaggtatttagtaagggtttcattttgactacctctacttttagtgtaaatacttgtgtagtttttgtcattttgttttgtttttgttttattgtgccagaaaatttccagacctgtgtttgaacagtgtaggaagggggagaagtggtgacaatgaggaggccctgggagactgaggctgtgctgtctgggcagtgcctgcacagacaaagagttttgttctaatttgggagactagtagagaattgatgatttggggtagaatggtgacatgatgagagcggtgcttaggaaagtgattttagctgtgagaaatcagataagtaacaatagaaaggttccctggacacccatgaaccagtagaaaacctagaatatttaagtaacattagccaaatgagggctgaaatgtgatggtggcagtggggatagaaaccaggaacacagttttaggagctattgactacatgaaataaataagaggccacagaatgactctgactggcagagacaatctcatgatgggactaccctgtcagagacatccatcagagcctgctcagcagctcacactggatagcccttttgtttcaactgccctcgtataagctgcctttatgaattaaggagctgtctgcatcaaagcggtagacagacaccatcgtcctattttttcaccctgcttgcattcccattaactcctcttcagcaaaacaaaaaactcaagccttactggttctccctacctcctgatagctacctacctagactgcttggcagacacagttctgtaggctactttcttatcaagagttggcaattagaagaggcccttggagaggaggtgggagtgctccttaaagtcctcatcggaatggaattgctgaccgggttcattaggctatggatttgcagcaagacttggattctattgcaagtaggtgtgtttcatttttaagcttccaatgagcagtacctacactgtgtgctacctctgtcttcctgtcctgtcatttgactgctttgtggacttgctggtggaaggcagatgtgtgtttgccttctaatgagttgtcctcttgagcctcctctttcccaaaatgctctgtggggaagactaccttgtagagaagacccttcgtcatgtgattgttctgtttccttagagacaacagcagcgtaatgcattagaagccagatctgtagagaaagaagaaggctttgctacagagtgtgaaggtttaatagttattcttcgcctttatatttttgccaccttaagcactgggctaatgatgattgtgtttatttttggcaagatgctagagcccctagaacttcccagggagtttctattaaatgggcagcccactattatcttttttttttttttttttgaaacagagtctcactctgtcacccaggctggagtgcagtggtgcaatctcagctcattgcaacatcggcctcccgggttcaagcgattctccagccttagcctcccaagtagctgggattacaggcacccaccaccatgcctggctaatttttgtatttttagtagagatagggctttacatgttggccacgctcgtcttgaacttttgacctcaggtgatccgcctgcctcagcctcccaaagtgctgagattacaggtgtgagccactgcgcccagccccactatatctcttcttgtttggtaaaaatatgtgagagtcagcctgtcatctatagcagtgaattcatttccatttttgaaaacagatttcagttgatgaccatgtgaacaggtcgggaaatgactttgcatcatgcattttgttgacccctctatgagcagtaacttgttaaagcatttaagatgccatcctttctcatttttcttaaatacaggacttagcatctacataaagtaggaacaacttcctaagtttaatgaacaaggagaacaaggaaggagggattcatcatggaaaggtttttaaaaataaaaaaatacatttctgttgatttgatgatccggtttataagactctcgactgctttttcaacataatgatgataaattgagcaatactgttaaatagttaatttgttatagttaataactattgtctcattttacaattctgtccctttctagagctagagagatatttggcttcctctccatgtctctagacactatctagtggtgaaagtgtaagaatggatttgtggtaaacttttccttcctgagaaatagttcattaaacaagtctgataccacaaatggctatgctaaattgctacgaatataaattgaggcatatatgtctgctgataggggagttttttatattaaccaattggttaattaattgtaaatgatcagtaaacttaaatgcacttcccggaagtcagaaacctcattgtaggtatgtaacatgatatttatgctacacttacagtaccagatgcttatttttttaacatcatggttttccaaaaggtgtttttgcttgtttgtttaacttccttgctttggcagataaccatagaaccccgtgaggtaacaagaaatggttggtccattacatagagatagacaaagagcatgctactcaaggagatcaagaatgatccacactatccacacgagaatcattgcaatgaaagggcttttagaacctgggctccttaatatttcaccagagctgcagcttaccagcattatagatcaatgtaatcccttatgtcctcttcatcataatggaataataagaaaactggttttctttctagacaatatattgttttcacttaagggtccacgaataggtctctaaccacaaatttttgaagagtagtagtaactaaaaagagagagagaaggctgggcacaatggctcatgcctgtaatcctagcactttgggaggccaaagcagatggatcacttgagcccaggagttcgagaccagcctgggcagcatgacacaacccccaactctatgaaaaatacagaaattagctggtgtggtggcatgtgcctgtagtcacagctacttgggaggctgaagcaagagaatcacttgagcctgggaggtggaggttgcagtgggccaagattgcaccgctgcactccagcctgggtgacagaacgagaccctgactcaaaaaaaaaaagagaaataccaccttcattctgacgcattgtgcagcagagatgctgaagtgcctgcaccctgagcactgtcatttgacacttttctttggaagaaagttaatctttaagtaagtgaacatttttttgttgtagatttgttctgcagcctcccttttttttttttctggcaacagtgctctctccttagagatctgttcccctcctagcgctaactgtgatgttccgggaggaataccagtcatagcatggggcctgctgaatgccagagtaggcaagtgactcagggcaggccagaggctttgctggggattttcaaattgggataaaggaagaggttttattctccagtggtaaagctgtgagattctgggcagaaactctttcttcctaagcataaaaagctgtgggccatgtgtaaagcctgactcaaaatgagatctaagcaaaggtaacagtaaacgtcctaatgacattccaacatcctggaagccagctgcacccctgccttcgtgaggttggttatgaatttagttagtatttagttatggtgcccaataagttcctctcccaaccacccccgcactcccccctcctccccccaccccccttaccacttaaactacttcaagttagatttgaggctagtagtcctgaattggggcagtgtttctcaaacttgaaaatttattgttccctgagaactctaatctgaaaaattcatttggataatacagagatgcctgaaataaaagagtgtttgtggatttgatctattcagtggctttagaagcagatacaagtagtgtccaatactgattccatcatgtgaccttgaacccattatcttccttgacttttatttctttatttgcaaaatagaaataccaccatgagtagtagtgagaattcacgtaatgtttctgaggggcctggctcagtgctgatgcatttcacactcagcaaatgcttaggcactgtcttccccccacaacctccccaatgctgcaaaagtaaagaaatgtatgcaaaatacacagcaaatcctgtaactgttaacttcataggattttttcatattattttgttgtactggtttttgtttatatcaaatgaaataattaagttgtctttgttacaaatagtcttacatgtatttggttataaattatcatcatataggatttgatctaaatattgtaatatgttaagctaaagcttaagtatctgttgttgctatgactgatgattatgaggactgattataaacttcttgtgggcagggacagtcttcaacttgttttattttgtcccgaaacccctaacagtgctaggcatgaataggccgtggatttttgtttgtttgcatactatggccaatgtttatttaaatggagcttgtaactagaaaggttttctagagctattgaaatttcaggagctgtttttctgataagagaagtgagaaattgtgtaactttggccaatctatgaaggacattccaggataagtaggtgggaaaagaggtgaaagcaggggcttagaagaagcaaaagaacaacaacttgatggagagagatgggagactgaagtggtttgatagagaaaagaatgaggtagtctatagggtgggttttacatttgttttaaagtatggtgaaatctgctgcatcatctaaaagaagaaaaaggtctgattcaagtgagtagggaagataatttcagaagtaacataggtatctaggattgagggcaaaatagctggctacaaaatattaataagagattaaatgtatttaaaatggttacctcctttgtaaagcattattatggggaatacaaaaaaagaagtcgagcaaatgaaagcattagggcataataaattctttccccctttcacaccaatagtaataaacagacacccaaaaaatctgctcaagattcccaaatgcatggctagcagacagctgtctatgtaaaagagaattgcaggacactgatcttaacctccacagctaaaagaaatgttctgtgggaaagagctaatgcgccaataaatttaaaagtgaagggcaggggtaagtacgtggctgtctgcatgacttcctacagaagaggctctgtcaaagggcctggggaaaagggacagctctgacaggtgccccaaatctcacttgtcctccaggcttcagctgactttattcatttcctccttttttttttggagacaaggtctcactttgtcacccactctggagtgcagtgatgtgatgtcggctcactacagcctcagtctcccaggctcaagcagtcctcccctgagcagcctcctgagtacctgggactacaggtgtgcaccaccaaaaccagctaatgtttgatttttagtagtgatggagtcaggctggtctcaaattcctggatgcaagcgattctcctgcctcggcctcccaaagtggtgggattacaggtgtgagccactgcacccagcctactccttcatctttaaaactttgcaattttaagtagaaattttgtctacacgacatcagtactgtactttcacatccttggttagagactcctatccagacattgtttacccctggatctaagtcaattcagaaagccaaaatgagtcataacactcagtgttgattttaagcccattgttaaactttttttttagtcaacagtctggtttatataatagataatttgctcattaaatgtatgtattttgctaggctgagattaggaacctaaaagatctttgaaatgaagattagattttaaagttaatcctgttaagctctcaagccagatggtttacgttcagagagccatttaggacacagagttctaataatatgatggggaaagggtaaatcactccaaaactatactttgtaactattactatcttatcttcctatagaaacaacaggaactatgatctaacgtcatgctgttggctttttttatatagagtaaatatccttaagtgttttcctgaaagtgcagccgtgaaagatagtagacagtacactcgaatgactgagcacacacactcagagccacactgcctcggttcaaatcctcttgctcccacgatttggctctgtgacctcaaaaacattacttttctccatgcctcagttttttttttttccatctgtaaaataaagataatggtatctacttcattggcttggtgtaaggttaaatgagtgaatccatggaaaatgttcaaacttagtctgccgtataggaagcactcaataaatattgctattattagtaaagacactctccactctgctgattctattcctaagtcatagatggtagaagaaaaaaaataacagaccaagcagtagacattaatagagttaagtagaaaagaatataccactgttcccagtgaaggggaaaaagagtctgctatcgctgcagacgctacaaatatatccaccaaatataacagcgaataatgtcatcccatttttggagaatagtctcaccacatctaaatataatagattacttcttacccactcaccattcctgttatattccgcaacatggtgctgactcatgggcaacaaatatttacggagtacctactctgtgcctcatactatgccagacacttgaaatataatagtaaaaatatcacagatttcttacagtgtagtagaggagatcatctagactggtctaagatgttttctttattctcatttttgaggagtggtggtggtaatgatgttgggaagttgtggaactttggatctactcaaaccatttcacaggttttctactgaaagtctcaaacttctacaccatagtttctcctccctcgttccctccccctgcctcttcctccctctctctctccctctgtgtgtgtgtgtgtgtgtgtgtctgtgtgtgtgtgtgtgtgtgctcatataatactttccttctcagtttgctttcttaataacaaaaataatataggttcactttagaaatttgattctttttttttttacattaagcatctttttctcttagaatcaggaaaaattaaactgaaaaggttggagaagtgttggaaagtatactttcccataattcccataattcccataattccacttatcttaacatttgaccatattgcctccagatgtttcattttatgcttatgatgtagttgagtgtgctgtgtgtatgtataaataattgtatacgactattgtgaagacagcataaataatgtatttaaagctctaaagtgtctgatagatatcaaacactcagtagttgttagctatcatcatcatcttgcccttctttgttatcttctatatgctgagcatttttccaagtaatcaaaaagtcttcataagcattattatttaatgacagcataatatcctataattatggatataccatggtttacttttcctttccttatatttgaacacttaggataatttcaaaattatcctaccataaataacacttcctgaatatttgttaatataaatctctttgtgcatttctaattagtcttttgaattgattcctagaaggagaactactgagccacagtgtttgaatgttttctaagatctttgatggacatattgccaaatcactttctagaaatttggcttaactttttactttcactcttgactagtagtaaattaaggacctgtgtcagaaaaccgtctccactcttaaggattgcctttttaaaaagatcattatttttcccagagaaagtggtctataattccccctgcccgccaccgagacaggatctcactctgtcacccaggctgaagtgcagtggtttgatcttggctgactacaacctttaactcctaggctcaagcagtcctctcacctcagcctcctgagtagctgagaccataggcatatgccaccacacctagctgattttttaattttttgtagagatggggtcttgccatgttgctcaggctggtctcgaactcctgggctcaagcgatcctcctgccttggcttcccagagtgctgggattacaggcatgagccactgtgcacagcctgtaatttttaattaaatttcttttgagtcatttgtatttcttctttttaaacatgtatttttactttacccatttatctaattggaatccctatagttttcttttaagtttgtgtgaatcctttatgtattaaggcatttaatttttgctgtgtcacatttgttcaggtagttcctcaaatttttttttcttttctgatggttttaacaattcaaattaactggtgtttttctaatttttccattgcttttgagctaagaaaatcctctctattcatagacctatattttttctcttaatttatataaacatttatatttaactcttcttttttctttaagagacggagtcttggctgtgttacccaggctggcctcaaaatactgggctcgaatgatcctcccacctcagcctcctgcataactgggactgtaggtgggttccatcatgcctggcttatatttaactctttaacaccctagaaatatgtttttctttatgggatgagataatctcagtattttcccatgcatatagcagtttttcttacttctattaagtatttgctacattataattattttttctaaatttttcttctttgtaagacttcagttttcatctttttaatttttattcccagaagctagcacagtgcctgtcacattataggcaaatatctgataaatgaaagaaatatacagttgtatataatctgtcctgaaacatttttaaaggtacaagttatttatctattcctacagatgattttaaaacccttaagagagattttgtaggaattttaatttctagttagtctgtatttcagagcatcaccagaatgaactggagtggtctggccgcaagggaactgcatgaaaattatttctaccagtaagctcaatttgtgctttgtaataggagatgtgtctccccaataaccagaacctctgttcctgttatctaagccaccctcttactgcataggtccccaaacctctcctaccccgcctaaaaacaataaatataaatgtacgttttcggccagacttggtggctcacgcctgtaaccccagcactttgggaggctgtggcagatggatcacctgaggtcaggagttcaagaccagcctggccaacatggcgaaaccccgtctctacaaaaaatacaaaaattagccgggcatgatggcggatgcctgtaatcccagctactcgggagggtgaggggggaatcgcttgaacctgggaggtggaggttacagtgagctgagattgccccattgcacttcagcctgggcaacagagtgagagactccatctcaaaacaataaataaataagtaaatgcacgtttttagtgttcagaatactgaaatgaccaggtactgtttaatgacactcatgtattttcaaacttgacatttcatctgagttctgttctcctattttcaactgctttctagacatccacttacctgtacttcaatggtatcaatggtacttcaaacccaacaatttcaaaactcaaatcctattcactcttatcttcctgctcattctgtctacccatccctcctcctttccaacctcagatcttgtttcctactctgtgttttctagtttggatattttaccacccagtagtcaaggtaaaaatctcttattctttattccctaaccctgcgtacttaatcagtcaccctctcttactggttttgtcttcacaatagctttccttttctcttgcccccatcttgactaccactgtccatcttcatagtcactgatctgggcaactgccataacctcttacctggcctcctagcttccattcccctgcttcccaatatatcctacatgatatatttatatattatgtggggcaaagattcccctcacccctagaagttcagagtcactgaactgagggtagggcttgggtatcttatcttacagaaagcttttcagaggattcccatgcacgcttttgataaaagaccagcatctgcaagattctggagtgagcttttaaaatgatgtgatggtcacattggtgtttgtcttacattcagtgcttctcctgctgcctgcaatataaagttcagatctctcaccttgtgctaggacaagctcctttcacatcctgcctctcctctacctttccacatgcgtttccagctactccctttcagatgcctttggtcaaacaaataaattagacccagtttctcatgtatttttggatttctatgccattttacatactatttctatctagggttctcttaattctttttctgtatctggaaaactgttctcaacgatgcctcctctctgaggccttccatgacgattcttgccccttgttcctccaggcagaagtacctccaggcagaagtacctgatcttcatctgtgactctcagcacttggtctgtcagttgtctctcagtatccctgggggttggttccaggagcccccacagatatggaaacccaaggatgctcaagtccctgaaataaaacagaatagtatttgcatataacctatgcgcatactcccatatactttaagtcctctctagagtacttgtaatacctaacacaatgcctacacatcacgtcctttgcaaggattcagtgtattactcagcatatggtgaattcaagttttactttttggaactttgtggaactttttctctgaatagtttccatctgcagttggttgaacccacagacatggaggactgaccatacttcattgctgcactcattacatggcattgtgatgatttgcttgcatgtttgtctccatctatatacagttaggtcattgaaataaagataatcttttatcagtaggtacccagtaacagtgatgctttccctttaattaagaagtaccaaattcttgccaagtctttaaaaactacctctactgactaccagatactttctacctatatcatcatcttattctatcccatcgaaaaaatggtatatcttattaacaaagaaggaacctcccaaatttctggaccaagcgatagatggtggccatttcagtatcatgaaactcaatagtgcctataccttgctgagatctgtaccaaaggaagatacagaacatctggtgctcaaggtattcaactggttttacatgttaaagatcaacaaaaccaatctaatgttgtgccaattctgtttttttaagtttctataatttgtagcattaatgtctgctttacacctggaaatactcttttcagttatgtcttacaagaaccatgaaggttttgtatgtttgtttgagccagaagtcatttttagtgtattacctttttttttttttttttgagacagggtcttgctctgtcgcccaagctggagtgcagtggtgcaatcacagctcactgcagccttaacctcctaggctcaaatgatcctcccacctctgcctcctgagtagctaggactacagcacgtgcaaccatgccagactcatttttattttttatttttttgagacaggatctcacttgtcacccagcctgaagtgcagtggcacaatgtcagtttcactgaaacctcaacctccctgtgctcaggtgatcctcccaccccagcctcctgagtagctgggactgcgagcatgcgccgccacacccagctaatctttgtatttttttgtagagacggggtttcgctatgttgcccaggctggtctcaaactcccaggctcaagccatctgcctgccttggcctcccaaagtgctagttttatagacgtgagccactgtgcccagccagcaggctaatcttttttatttttttattttattttattttattttatttttttgagatggagtcttgctctatcacccaggctagagtgcagtggcgtgatcttggctcactgcaacctccgcctcccgggttcaagctattctcctgcctcaacctcccaagtagctgggattacaggcacccgccaccacacccagctaatttttatatttttagtagagatggggtttcaacatcttggccaggctggtcttgaactcctgaccttgtgatccacccacctcagcttcccaaagtgctgagattacaggcatgagccactgcgcctggccagcaggctaattttttttttttaatttttgtgaagacagggtctcactacgttccccaggccatgttatgccttctaagaatgcatctgagctgttggctttcatggtgagtcgtggctctagtgaaggttctgtagtaaagacctcctttaagtttgcaagtgcttctttcattttaaactgcagacatatacctgtctttctagcaaagcatgttaggagttcagaaaggctatgacatttgggggtcagttatgattagtttatagtttacaatatagccattactgtctggttttgaatattagagaagaagctttgatatttgtgctataatggttgaacatgatatataccaagagatattgattataaagatgtttgtggtatcagaccaaattgttacaaatcatgaaattttattgcatggatttatgttctaggaatttgaattttttattctcatttttcctctgagaataccaaaaaggaaattgaatgcagtgatatctttaatattgaaatatagcaggtggccgggaatggtggctcacacctgtaatcctagcattttgggaggtggaggtgggaggatacctgaactcaggagttcaagaccagcctaggcaacatagtgagaccttgtctctattatttattaaaaattaaaaaatatatatatagcaggtaactgtattagttctgaaagcaatgtgaaaatgtctttatcttcttttggaaatagattgctaataataatacattaaagaatagcccattctatttccaggaccagaaagctgttgtgctggatttggttctttcatagggattgtctccttgtttcagttggacaattgatataagagaactagaggcaaaaatataaatttaggactaaatacaagctaatctctgtgttcacttcgatcattagtcaacctaaaacaactgattaattgactataactcagcacagccactagcattaatagtcttgaaagtttgggacataattggatatctgtctgaagacaggtagtcagataaataacttggaattgacttctagcctagagaggcatatttcaattctaaatgtcttacttagagacatgtcacacaaagggaggaatgtagaacaataagcatagtactatggcttaaaaatcaagagaccaaaatcagttccctgcaaattactttccatctcggatcctctccattaaatggaaaaatcatttttaaaaatccctatacagaaatgcagttggtttaagaagaaaaaaaagtgcatagatagatggagaaagagatccttctttaacatctgggttccttggccctccctgaaatatttccccttgagcttttatttgagtgtactatgaaacctgcaaaacaataaagcctgtgatcccttaatattcacaaagaattgctaagtataacctctccagaaacattttacataattaactctgtccttaaacggaaggagaaaccagaaggtagttagttcccaagcacctaaatatgagagaaggactttcagcttcagttttatgcttttgatagacaaatatgagaagtataatcatgcataacttaacaatgggggatgcattctgagaaatgctttgttagacaattttgtgttgtgttaacatcagagagtgtacttacacaaacctaggtggtttcgcctgcttcatacctaggccatatggtgtagcctaggccgtatggtgtagcctaggctatatggtgtagcctaggtttgcagcaggcaaaaccatccaagtatgtgtaagtacactctatgtatgtagcctccaagctacaaacctgtacaacatgggactgtactaaatactggaggcaactgttacacaagggtatttatgtatctaaacatagaaaaggtacagtaaaaatacagtattataatctgttataatgtatgtggtttgtcattgacctaaacatcattgtgtggcacatgactgtacttcttccagtttaaaagaggaagtgagaaattttccagtttaagtatttagcaatagtcatgtggttccagatgcaagacagaacccttttgtagctgaacctggtagggagggagaggggttgaagaatggctggaaggcaagatacctggcacctttttgagaagcttgaattcattccttcaggactttcacaagaaggagaaatggacctgagtctagaaaacctgcagctaaagacaagttaccaaaaatgctaaccttgaagtttaaatttggattaggggttatcaaagacaacattctaattagggtataggtgtaaaatttggatttgttgttcagattctagtagagaattaatcaaagtttgttccagagtctttatttttgaacgtggtatttaacagtctgttctggttaaaagtttacaaactaagtctgagggaaaccagtgagctctaaccaaatctcaggaacagcatgcacctcgatgttgtgacctttgtaatatacaatgaatgccagacacctagtaatcttgtacgtaaaatgtagagaaattcactaaggggcagaatttaaattcttatgtactaaaactacaaagcaaaagccaccaaagttacgtcctgcagtagtgtgcttataatcagttgcatctctggtacccacagctcagtggccctgtggctttgtgagggagaacctcttgctgaatttacttaggcttgaagtatcgatttctacccccctccccaagggttccccccctccatgggtccccacctccccatgggcctccccttccccatgggtcccccccctccccatgggtccgtctgtgcttaccgcgaatgatgattggtccctttgctcttaccatgcttatcgtcgtttcccttgtttcccctagttggtcattattaatataaggtaaatgtcttttctttcagtcctcctcgccctctgactaatatgaatgacaccatggttagccacatgtcctctggagtgcccactcccaccaagaggtacgtatgtcttgtgccttcgacttgggtgttggcctctgctactgatttgcgatgcccctgccagaaatgaggcctgaaaagcaggttgttccacagggcagaaaggactggtttgctttctcttcctttgaccgtcttttagtcttaatttctactttttattttccttttttcccccaccgactcacaaatatagcaactgaagtttggctttcagtggtgcctcaggtggaaacttcatttgtgacaagcagtggtggcagtgtcagagcagattaggcacgtttcagatccgtttttttaaccttaaacaatattttggtagtcgtgagtttcaacagttttgcctttgaattctttgtcaaagatcatttttgctctttgattagactgtgtaaattgaattaatcccttataaaattttctcctgaatcattctgtgtatgatttataaacatttaagttggaaagcctgagtctctctcttttggttatgcaaggagtttgctttaggggccttcaaggaatgagaactgtgtacttctttctcctctttatttaatttgctcttctccaaaaattctctcaggcaggacttaaaagaactatataaaatggctttctatttggtataagctgttccatgacccagagcaatgcaaaaactccctcaagggcatggccattaaagaattctttctaacagtcatcactcagaaacaagaaaaccacaaagacattccagcccaccccctagtccttcctggaaaaaaatacattttgtgccatatgtaccgattgctttggattaattcagctatagaaatgctatagaaattttgactatataatacatagtgcttaagacaatgatgtttgttcccattggctaaaactcctacgtcagtgtttatcaaacctgactgatgagaagaatcacctgggtcacttgttgaaaacagatttctgggacaacatcagacccagtgaactggaatttctgaagataggatcttgagaagctacatttttattccagctgattcttatcatcaagcaagtttgggcaatagcctgacaaggaagctaacgagtaaagtgtaggactaccctgaagagagaagttagggacttaataaatcagagtggcctgataacacattacccgcatggagactcaggacctgaccaggtaagagtacttgcctttagccttgctagggcactttccagcagcaagagagtcaggccactgcttctggacagagctgagtggtacagggcaccagagcatggactcttgagccagactctttctgagttggaatctggctctttgcttaccttgaaatgttcttgtcttcatttttttttttttttttaaatttggagacactgtctctgtctgtcacccaggctggagtgcagtggcccaatcttagctcactgcaacctccacctcccaggttcaagcgattctcctgcctcagcctcccgactagctggaattacaggcacctgccaccatacctagctaatttttgtatttttttttttcagtagagattgggtttcaccatgttggccaagctggtctcaaactcctgatctcaagtgatccaactgcctcagactcccaaagtgctggattacgggcacgagccaccatacctggccttgttttcaattttttatctctaaaatggggacaaaaataatatctaccttttggggtttatgtgagaatttaatgtattatttttatgacttaggaaataaactggaatgtgagaataagtgaggaagagacagaataatttaccagcaatgccctctcaagcaggaaaggaatttttatggacgaatacaaagcaattaagcctgtcccacctacctagatattacaataacccttgctgtccttggacttcagttttttatgtttaacacccatagcattcaaacccagactccagatcaaagatgtttccgtttcaaaaccaggcagataaggtggccgattcaaagaattcaggtcatagttttcctgttaattataagaataccatctcattcagtagcatttcccatctgaattcttctcatcatttactagttctgtcacgctaagtcacccgagtacatgagggcgaccacagctgaatgtggctgctagaggctattagaaggagcatggctttctggacagtgttttattgcttgaaaaaactaaaagaagggagcagtaataatcatagccacctctgtagaggcctacccctcaggcttgctgtgttacacctgcaggctttattgtaagtagccagctgtgattgccagtcacaaaatgatacctgtcatttttgaaagctgcttcagataatctatagcctggattaagatttcatcttaaagtcagtgtttagccactctttctggtggaattagcccaccctagaggtggttatcgtaaactttgcaagggctgaccagcagaccaaaggcagccagagggcagaccagagaagaaggttgagctccgattgattaagaagcacaattacttgagtagcggctccataggaacaaaatgctcctaccctaccattacagcccccaggattttaggggattccatttatattcagtatgagattgtgatataccatgtggatactaattacctaattcatagacttggcttttcatggccccagtaatcaaatagtataaatttccaggtagtattctacttgtttccttaatgactcctcagcttttcttccctcctctgaatgtggacagacctgtgtggccagagagtctaacggaagccaggagcccagcacgtcttgccagccacagagccttactctgcccagacaggaatgctcgcggagatagagcagctactctccagaataagaggtttcttttagaactcatcctaagacgtcaatcactgaatgagacaacaacatgcacagtgataaaaatgcaggaaaaattttaagtgctctagttcctacctttttaataggcagtgcatataaaaatagtgataatcacagtggccaaaagtaatgctgttagtccaaataaaagatgatctgaatgtaagctttacttttcacagaagaccttataaatggcagagatgatgactgtcatgtgagataaccataaattatgttcccgagaggttctactgtagggatttgccctccctaataatcttttaatatccctaaattgatatcttataactgaaaagaaattttgtctgccttaggctaaatacttccttgaaatttactttcttttaaaagcgtccacatagtacatttaaaagcaaacaagaaaaaacttttcaaggctttaaaacataggcttaaaatacccctcccctgtccaatttcctaggaggcccgcgtctagacctctttttccccaaggttcagaatgtgaattgtgttcttatgctgcgtactgttctgttattttaagtcaacttatattcagacaaatatggaaaatgatgctaattttttttatttttaaatgtcttctaaagctttagctgtgtttatggatacttaaagcttaacaattctgtgggaatttcatagaactgtggaagtaacaaaagccttcagtatgcaactttgtgctttgtgcgttcagttggtatattaatattatgtctcctttagttccaagtattaaaatcgaaccttaaaaggcaaaacctacaaagcaaaggcaaaaagcagaaagggaagggcagaagagtacacagatcacaaaagcagctggaatgcccccaggcggccctccttctccgagctgcctctctccgtgtgccatcttcgctccccgccactgcagaacagctgctcccaagctgccgatggttgcagacacacacctccctacagccttgcccctccaggggttgtgcttttcctcctttggattagaaaaacgcaaggaaggattcttgtgtcctggattgcgttgctgtccatccttgtgtgtatgtgagggaccatgcccgttagacctatggcatcagagcagaggaagaagcatttcccccaaagaagagtatactgccaagaaaagaagagagagaggaggctgaggtaggaggatcgcttgatcccaggaatttgaggctgcagtgagctatgatcatgccgtgaatagccactgcactccagcctcagcaacatagcgagactctgtctctaaaaaaaaaagaagaagaagaagagagagagatcctgggaaagaaaaataactgagactgttagcagaccatggttttcctacctagcacatagctgtgtgcacacatgcacacacacaagccttcccgtacacatttccacgtccagaattttccttcttcacataaggcagccatccatgtacaactgccgacgctctcgcacttttcccaggagtcttagccacctcctgtgaaagggacgaggtccagggtatccaatttatacccagtcatctggaccaggcctgggtatctccttttgtgattcattaacccattaaaccatgaaccaaatgatgcattttaaacactcacacacacagtatacaaaagtaaagatctccaaataggataattgcaatttagagacttagggaaaaggaaagtaacagatagcatggcatattaagtcacatttgcctgtttcgtcctgaaacaccactaaaatgacagccaagaggtttcttttttttttttttttaaagtaaaaactcacaagaacaaagaaaaagaagagaaacaatagcaacaaaattttggtagcagccaagcaaatggatgagtggtaacgaacttaacagagaaaaactaaaacgtaggctaaaagtaagacaagcccagaagaaagccaaccctaggaattagaacgctctggaaacgcagattcagaatgattggctcatagtccctggaaaaggtagaggtactcaggaattacagctatgggcttctcttttgggtggcttctgaaaaaaactgtgttatgtattatatcacacctccttttgcatagatgtgttttagaagaggtcttttttccctaacacttcacttttatttctcccaacaaataatattctctcaaaaatagaaataattatttctattctgttttgttcagttgttgatgatgtattgacttgggacataatatcatctttggatgggaaatggtaaatattagagcctataatcctgagtagtcctaattgctagcacttttaggtaaaggcgagattttatcatagcatatttactttaatttatacttcataaaaaagaaaagcagtttttgaagatcagaagatgccacagtataaatattatttctgaactgtaaaaacatggccaaattaagagatgagttaatataatagtacacgcatacctcagagacacggcaggtttggtcccagaccaccgcaataaagtgaatattgtaatcaagtgacttatacaaacttttaaatttcccagtacatataaaagttttgcttacactatactatagcctcataagtgtgcaatagcagtatatattttaaaagtatgtaccttaattttaaaattatctaattgctaaaaaatgctaatgatcatctgagacttcagcaagttctagtctttttgctggtagagagtcttgcctcaatgctgatggctgctgactaagcaggatggtggttgctgaagactgggatagctgtagcaaattcttaaaataagacaacaatgaagtttgcccccttaatggactctcccatttgtggaagatttctctgtggcatgtgatgctgtttgatagcattttacccacagtagaacttctttcaaaactgtagtcagtcctctcataccctgccactgctttgtcaactaagtttatataatattctaaatccttgtcatttcagtgatgttcacagcatcttaaccagtagattccatctcaagaaacccctttctttgcttatccgtaagaagcaactccttaccttttcaagttttattatgagattgcagcaattcagtcacaccttcaggcttcacacctaattctagttctcttgtttttttctaccacatcttcagttacttcctctactgaagtcttgaacccctagaattccatgagggttggaatcaatttcttccaaactcccattaatgtttgttttaacctcctcccatgaatcacaaatgtttttaatagcatctagaatgatgaatccattacagaggttttcaatttactttgtccagactccatcagaggaaccactctatctatggcagctatagtcttacaaaatgtatttcttacataataagacttgaaagtcaaaattatttcttggctgggtgtggtggcctataaccccagcactttgggaggccgaggcaggtggatcacctgaggtcaggagttccagaccagcctggccaacatggtgaaaccctgcctctactaaaactacaaaaattagcttggcatggtggcacctgcctgtaatcccagccacttgggaggctgaggcaggagaattacttgaacccgggaggtggaggttgcagtgagccgagattgtgccattgcactccagcctaggtgacaagagcgaaactacttctcaaaaaaaaaaaaaaaaaattacttcttgatccaggggctgcaggatggatgttgtgttagcaggtgtgaaagcaacattcatctccttgtacatcttcttcagagctcttaggagccacatgcattgtcaatgaatgagcagtactgttttgaaagcaatctttttttctgaacagtaggtctcaacagtaggcttaaaatattcattaaaccgtgctgtaaacagatgtgctgtcatccgggctttattcttccttttatggagtgcaggcaaggtaaatttagcataattctgaaaggccctaaaattttcagaatggtaaatgagcattggcttcaagttaaagtcaccagctgcattagccccagcaagagaatcagcctgtccttttgaagctttaaagccaggcattgacttcttctctctagctatgaaagccctagatggcatcttcttccgatagaagccggtttcatctcatcaaaaatctgcagtttttgtgtagctgctttcgtcaatgatctgagctagatcttctggacaacttgctgcagcttctccatcagcacttgctgcttcacctcacacctgcatgttatggagatggttctttccttaaacctcatgaaccaacctctgttagcttccagctcttcttctgcaacttgctcacctctctcagccttcatagaattgaagagagttagggccttcctggatgagactttggcttaagggaatgttgcggctgatttgatcttctatccagaccactaaaactacatcagcaatgaggctgttttgctttcttctcatttctgtgtacagtggagtaccacttttaatttccttcaagagctttcctttgcattcatagcttgactgtttggcacaagaggccttgctgtcagcctgtgttggctttcgacatgctttcctcactaagcttaatcatttgtagcttttgatttaaaataagagatatgcaactcttcctttcacttgagcacttagacatcataatagggttatgaactggcctaatttcaatatttttatgtcttagggaatagggaggcctgagaagagagagagagagatggtcagtgaaacggtcagaacacatattgattgattaagttggctatcttatgtgggcatggtttgtggcactccaaaacaattacaatagtaacaccaaagatgactgatcacagatcaccataaccgatatgatgataataatggagaagtttgaagcattgccagaattaccaaaatgtggcacagagacaccaagtgagcacatgctgttggaaaaaatggcaccagtggccttgctcaactcagggttgccacaaatgttcaatttgtaaaaagcacagtatctgtgaagcatgataaagcaaagcacaataaaacaatgtgtgcctgtattaaaatggctttctgactgggtgacaaggtaaagagtttatcttattatctatagaatatagcagaatgacaaaaatcactatgtttttgtttttttaagaccaaggacaacagagatgttgggggaaactaagaaaaggaataaaacaaaagtgatcaagtcagaaactatccatatgtggactcagtgcatggattctcttcccacctgtgaaatgagaaaaatagagtttgtttgaaaagcaagaattaatgatagtttcaggaaacaactagcatgtatgaagtctttgtgagaatttcaccaagtcaacacaagaatagttttttctccagcgttttttttttttttaagacagaaaagcagagtaattgaaaattaacacataatcttagagaactgcagggtccttagtgttggcaggtgtccagagcctgtctgacagcctgggcagaccgccagttttcagctgcttctgggttgggattagattccatttccactcaagcatttaaggtaagcctttcaccagttctaactcagattagtacaaacagaaagtttgagtatttccaagtccatacttaaataccttagtttgaaaaatagaagctgacagaagcataataactaatagtttgtttcttcttcgcgttggactgaggcttgaggtcctgagcgtgaccaagcgtcacatccgtcatagaccatcggcagagccgactggaaggagcaagtttggggaaaaagatctcaagtgcaatgttgtcgtgttcagattgagatgcttgtgggatgctgggagtgaagacaagctttgtaaattttggatgtgggtggggcgaggaaaagtgaggatcgttttcagatttctccctggcttgaattaaggtccctttggtcaaaacactggaggaagatttgtgccagaagaacaaggttgggaaccagaccatcgtttttgtcatccagattcttccagcgaatctcacaccagcaaaggagatacaaatacttagagccaacaaatgaccagtagaacctgacatgcatacatgcgcacacaccccttttctctctagcagcccccacacatactctcttcctctcttactatgtaatgtctctgtctgtctctctttctgatacacacatgaacacacacatgcttttaaaaaacacatttttacacacacatgctttggggcttttcactgaaatatgttttgaccttatctcctaagaagctgactcattgtagttgcttccatcaagtgatggtgatgggccatagcctggcacacagaacaaacatttccaaatgctgaaattcccgtgctgatccagcctagacctactatgtttaaccagagattttttttcactcctcttaataccaaactagtaaaatatttcagctcacttcagctagtaaagcaaacacttaaagcaaatcagtgctgtggtacagttctcaactttttcatggatcttattggggaatctccagtctactccccactttacccccaatttagtcttttctttgcagctgcaggggtttttctgaaatgcgaatctgattatgttattcttccgattgaaacttgccagtggatcttctttgctgcagcactgtctggtagcgtggaagtgttctgtgctaaccagtatgggagccaactagccacatgtgtctgtcgagtacttgagatgtgacagagaaaatgaattgttaattatttatttatttatttagggatggagtttcactcttgtcacccaggcgctagggtgcagtggcacaatcttggctcactgcaacctctgcttcctgggttcaagcaattctcctgcctcatcctcctgagtagctgtgactacaggcgtgtgccaccacacccagctaatttttctatttttagtagagatggggttttaccatgttggccagggtggtcttgaactcctgacctcaggtgatctacctacctcggcctccaaaagtgctgggattacaggcatgagccactgcacccggcctaattttatttaattggagtgaattggaatttaaaatagccataggtagctgatggccacacagttctacaagctaaaacccccattcttcagtgtggcttacaaggcccttgtttctgagctgacccttgccagcccttccagccctacctcgtcccactctctcttctcagcatccatactcagaagcacttggacctctcacaatgccccaggcaggtggctgcatatgccacttctccctgaaggacctccccatccttttcacctttgttctctcttctttgtcatctaattcttccttctcatcttagctttgactcctccaataagccttccgtaacaccctaaaactatattatgtgatcttctgtgagccgcagcgtctggtacatatcatagtatcgtagtagctgtgtgttcgatgcctttctagactacaagctctttgagggtgtagactccccaggcttgggccaaaaacaaattccgtctctcaaaatcttcttgctgctgcttgccccttaattagtacttcctctgctaggaaagggattttctttttcagttatttcaaataaatcacatagtactgcctgcttattccattcagagcagggaaattaaaaagaaaggtattattcctctattttatacatattatgtgtaaatataatattacattgcgtttcacatgactaactagtaggaaggttaaccgattactagaattttatgtacattaaacccaagcattgattgatagcgggtccttaacctcattgagcttatttactcaggagaaaacataaatgggggggtggggagggaagaaagtggaaggactagatatgttttcttgttcaatatgacatttatttggtaaagatttttgatgcaggccagatgcggtggctcacgcctgtaatcccagcactttgggaggtcgaggcaggtggatctggattgcttgaggccagaagtttgagaccaacctggccaacatagcgaaaccctgtctcaacgaaaaatacaaaaattagccgggctttgtggtgcacacctgtagtcccagctactcaggaggctgaggtaggagaattgcttgaacctgggagacggaggtttcagtgagcaattgagattgggccgctgcactccagcctgagcaacagagtgagtgagactccgtctcgggaaaaaaaaaaaaaaaagatttttcatgcacttcgtgttgggaaagaggtcatttgacaaatttagatagcatcacgactgctacttcatcaagacgagaccccgctgggtagataagcacaggaaaggtgagtagtggtgaacagttcttagagagccccatgtcactccaggtccttcattctgtccataacctggctgtgccagagaacctatagagcctggcatgtcattgggcttgtttgtctctctcacacgccctcatgggacagtactattttttctcattagcttgtaatacagcgaaggcacacactattttctttcccctaaacagagttgattgcatcaagccacaacctatgagacagtgagctgttggaaggatgttgtacttccttgccctttgtggctaaagtcctttgaggagagataatccagatggggagtgtccttacattctataaatccatctcttccacgctagtgccttgacattgtgtatttttttttagtgacagaggagaaaaggaacttaatttgctgagaattatttatggtgtgctgaaggatcacattagagaagagtaacattgcttgccccatggatctgagagtctcagtcaggcatttagagtactgttatactgatataacagcaggcatgtgtttacattgctataacaggacacagctttacatactgtgatccaaaattgttgtcttcaggccgggtgcagtggctcacacctgtaatcctggcactttgggaggccaaggcgggtggatcacctgaggtcaggagttcaagactggcctgtccaaaatggtgaaaccccatctctactaaaaatacaaaaaattagctgggtgtggtggtggatgcctgtaatcccagctacttgggagaccgaggcaggagaattgcctgaacctgggaggcagaggttgcagtgagctgagatcacaccactgcactccagcctgggcacaacagagcaagactctgtctcaaaaaaaaaaaaaaaaaaaaaattgtcgtgtaagaatctactctgaaatgtgctactttcagtgctaatccctagcctgcatccacttacctagggtttccttactaaagtcactgattattctgggtgttcgggttttcactggaatatttttttgtacgtcttcctcctgctttggtggttcctacagatttctcccatcatgacagaactactgatatttcttcacacttcaggactttccagagtcagagaattgtcttacaatttactgttagaatcagctggccttgtgcatttattgtggaggacacagaaatgcttttctgagcttctcactcagcatttctcatagagcttccatgtaggatctttcttggggcgatctggtctctttgaagttgtggaggccaggctatgtgaaaggtgacagtggtcgtttcttctcctagccttaaattttagcagatgatattgcacggcctcctcactgagtttcttgccttctcttttgcctcactctggtctgctttttacactgcaggtagtcatttctccaaagcactgtctaatcatgacagtcccctgcttaaaactcaggagcatctcattgtgccttagagaaacaccagttctttaacatggcttgggactgggcgcagtggctcacacctgtaatgccagcactttgggaggccagacagatcacttgaggtcaggagtttgagaccagcctggccaacatgatgaaagcccatctgtactaaaaataggaaaaatcagctgggcgtggtggtaagtgcctatagtcccagctcctcaggatgctgaggcacaagaatcacttgaacccaggaggcggaggttgcagtgagctgagatcacaccactgcactccagcctgtgtgacaagagtgagactccatctcaaataagtaagtgaatgaatgaatgaatgaataggcttgggcaacccttcatggtgcccagcctgtctccccagcctcattttccaatgctctcccctactcttcaagctgggactcttcagtacctggagtatgctgtaaattctctcacctgcacttttgcacatacccttccctctgcccggcaccctctttatccaacatcttcacctagccaaccctgtttatcacccaagtttcaactttgatgtcactttctgagggaggacttttctgatctcctggactaggtcaaatattctatatatgatctccgcaaacatccttttataacattccctacccttataaatacttgattaatgtcagtatttcagtattcctctcaaggctgggcacttcacaaggatggagctacatttgtttatcaccgtagttccagtactgatgtagatctggcacatagatactcggtaaatatattgaaaactcagtacaactaaatatttactatttggccactctgtgtcatgcaattcagttttgtcccccaatcacaattccaactgtgactacattgaacttgatgcatttatagcttatatttgtaggataagtcattatcctattttctgaccttataggtaaacactttagagtttatatctgttttctaaaataaccacatattagggaccctgtcattgaccaagaacacacaaaaagtgctttcatgagccccgaagacagaaggcaaggcaagagcattgttccgaaacagatttctagtgttcatgtctagcagcttctttattttgcacttgaccctgatttaacttgttactcctggcttatttcttaaacttggctttataaactcgtgttgaccccttgtcagactccaaaggggccagtttcttgctgtggttctctttggactcccgtccttgcgctttggccctcggtcgttttgtagacttacatactaccttcaaactcagacccagtggaggagcagctgaaatccatgtggccactgttccaacatggacagttcagacaagcatattgcagcctggaatggtcctgttagattaggagcaccctggagttgatcctgggctggaaggtttgccaggaagcaaagtatgtttgttccagagttgcttttcctgggagcttcatcctgttatgacaacttggaatggtgcagctatcttccttagtttctcaccttcatagcaatgaatccctaggctacctaaaacttacctaaggcatagtagggttcgagagccactttggaatcaaaacagacttatggttgtaagccactttagttcctaacatccaactaaattcaagaatataagacaaagactcccgaactcctctcagatattggcatgtgcacaggtatataactgacctcagaacacttcccagccaccacatggtacacacaagggcagcggttggcaaactacagcttgtgccaactcctgcccttgtgtataccatgtgtatacttgttttgtaaataaagttttattggaacatacttgtttatatattggctatagctgcttcccctaccatggcagactgagtagctgcaacagaaaccttatggcctacaaagcctaaaatatttactatcggaccctttgagaacaataagcatttcatcttgtcttggatttagaataaggatgttaaaaagaagagatgcagctctatatacaatttttttttattacttagactcagaatttcagagctgataaaaggtactttataagtcagcatgttgtggtccattactggactcaacataggtaatgaaatatgattacaaggctgggcgctagtggctcacacctctaatcccagcactttgggaggtcagggtgggaggatcacttgaggctaggagttcaagaccagtatgggcaacacagcaagaccacatatttacaaagaatttttttctttacctgtctgggcctgatgttacccgcctgtagtcccagctactctagagactgaggtgcaaggattgcttgagcccaggagtttgaggctgcagtgagttgtgatcataccactgcactccagcctaggtgacagagtgagactctgtctcaaaaaaaaaaaaaaaaagaaagaaagaaaacaaagattacatcaaatttagtaggcctttacatcttcttcattcgtagtatagtagcagtagtcaaaggtacaaatgttggcccctttgaaatttagaataacaaatatggagatgaatctctattctctcacttcaacttgcccaagggcttgattattgggaagatgaatgtggcttagtgtttgagttcccatgaaattaaaagagtataatacacttattcagagaggagctggtaattagtaactggtagaaggactatctccatcaaggaagataatattagtaaataattgtcctaccaacactcaaccagtacattagagatcactttgacggaactctttcacgcttttaaccttcttcagagatgacttccttaaaggtctaacactttgaaacatggtcgccagaattactctcattgtttgaggagaaacaacagcgttcggaaaaaaattatcttaaaatccattataacaactctttgtaatattccccaaattctgtattttcacctacgttacatatataaaaatttaggtgccataagaaaatgtcactgaactctgcctgtcaattcaagaacagaaattcaatctaaacttctgccccaaattgtgtatttcccaaatgtggatcaactccctggtcacaaacacactgtaactgctcttgcaatgacagccacctcagcgcagcactcgcctggctgagtgactcggccacaggagctcccctgcgttctctaacacggcacttggtgtttactcctgccctttgctgctgtcaactccatttcactttaagcttggtgtggcagagagagtatgagctctgaagtcacctaggcctgggttcagggtcaagctttgtcacttacctgttgacagaattattgagttaactctttacacttaagtacttctttctttttgtttgtttgtttgagacatagtcttgctctgttgcccaggctggagtacagtggcacaatctcgcctcactgcaaactctgcctcccaggttcaagcgattctctgcctcagcttcccaagtagctgggattacaggcacgcaccactacgcccagctaatttttgtattttttagtagagacagggtttcactatatgttggccaggctgatctcgaactcctgacctcaggtggtctactccttagcctcccaaagtgctgggattacaagcgtgagccaccacacccggccttaagtacttctttagaagtaactgattatttcatctttaggctaattcattagttcagcaaatatttgctgagcacctgatatgtgcgaggcactgtttcaggaggtgcctggtgatttagctgtgtaaaaataggtctctgcttttatgtagctgctgttctagcaaagaagacagaaaaatattgttttataatataataaagaatagtggtaaatgctgtgcagaaaaatagagagtgaatggggcagagagtttcaggttttagattggatgatcagggaaggaccctccggagagacgactttgatcaggaatctgaatgatgtgaggaggaaagagggccatgccggcatctcagggaagattgttccaggcagagggaatggggaggataaaggtcccatggtgggaaggtactgggtgttttctggaatagtggaaaggtcagcacggctgaagcgcggtgagcagagggccgagcgtagaaaaccagctggagaggcagcaaggggccagatcacacaggggagatgggatttgatttttaaaaagcatttttaataagatttattatagaatagttttaggcttaaagaaaagttgcaaaagtagtacagtaagttcccatatacataccccttcctttgtttcttttctttctttttttttttttgagacggagtctcgctctgtcgcccaggctggaatgcagtggctcgatctcagctcactgcaagctctgcctcccaggttcaccccattctcctgcctcagcctcctgagtagctgggactacaggcgcccgccaccacgcccggctaattttttgtgtttttagtagagacagggtttcactgtgttagccaggatggtctcaaactcctgacctcaggtgatccacctgcctgggtctcccaaagtgctgggattacaggtatgagccaccgcacccggccctgtttcttctaatattgctaacttatgttgcctgggtgcatgtgtcacaactaagaaataatacccatacactactgtgaattaagttccagactttattcctgtttcactagtttatccactcatgccctttctctgttctgggatgccacatctcatttagtcatcctgtctccctggctccttctgttctgtgagtttcttagtcttcccttatttttcatgaccttggcagttttgaggagtactggtcagatattttgcagaatgtccttcatggttttctcatgattacactgtgattatgggtttaggggaagaagaacacagaggcaagtgcccttctcactgcatcatagagaacctgctgtcagcatgacttctcgctgctgatgggaatcttggtctcctgtccaaagcatcattgacaaggtttctcactcttttcctactctgttctttggaaatccctaagcatggttcatactcaagggcaggggtgaggaattaagctctactcgcctggagagggaagtatctacaccctctgtatatctcccatttgttgatttaatcatttatttatatcagtgtggactcatggatgtttattttatgctttgggttataacccaatactgtttaatacattatttattttgttgctcaaattgttccaactctggctagtgggagctctttctggttgggtcctgtgtccctttgacatgctgccttttgttttttaagcacttacttaggttgtggcattacaacatgctccaggctcatcttgtattccctgccccagccctagaattgcattttcctagggagccctggctcctttattagagaatggtattagaaatcagtgtgtacaggctgggcacgatagctcatgcctgtaatcccaacactttgggaggccaaggcgggcagatcacctgaggtcaggagttcgagaccagcctggccaacatggcgaaaccccaactctactaaaaattatttaaaaattagctgggcttggtggtgcgcacctgtagtcccagctacttgggaggctgaggcacgagaatcgttttaaccgaggaggcagaggttgcagtgagccgagattgcgccactgcactccagtgcagcctgggcaacagagcccaggctctgttgaggaggaaaaaataaaagaaatcagtatgcgtatatgcacatgcctgtaattatttctctatccatctgtatctgcattaaggtatttgtgagttacgctgaagtatctgactctaatccagtaccacggggtttcctctagctgtccccaccttggttgtctgtaacttccctctccaggggtgagacacctggctcccatcatctaccatccattgacttattcgttccgtgcctgcagcacgtgtagcagtttcagaattattagttaggacccttgatttgttttttaaacagatttattgagatataactcacacactgtacaattcatccattcaagatgtacaattcggtggtttttagtgtatgcactgagttgtgcagccactactgaaatcagttttagaacattttcatcaccccaaactgacaaggccactcattgcagcgtggagaatcaactgtagagtgtatgagcagaagagtgcacagtcaagaggctattggggcagtgtaagcgagaactcctaagaagttgctcaggagaagtcatggcggcagtggaggtgatgagaaaataagagccatcaggacttgcagtggattggatgtgtgttcaaggaaaagagagaaattaaaaagacccctctggttttggcctgatggctgggtatagtgatgccatttatttaagctggtcagtctggggaagagcaggtgaggaggtggggtggaaagaatcaagagttctattttgagcatattaggtttgaaatgcccattgggcacccaaggggaggtgttgagtagaccatcaattacatgattctggagctcgagggagaggtcagggctggaaatgtaaaatcatgagtgttaccataatccctttcttgtaagagtgttctgagtaggccgggcgcggtggctcacgcctgtaatcccagcactttgggaggccgaggcgggtggatcacgaggtcagcagatcgagaccatcccggctaaaatggtgaaaccccgtctctactaaaaatacaaaaaattagccgggcgtggtggcgggcgcctgtagtcccagctacttgggaggctgaggcaggagaatggcgtgaacccgggaggcggagcttgcagtgagccgagatcccgccactgcactccagtctgggcgacagagcgagactccgtctcaaaaaaaaaaaaagagtgttctgagtataaacaagagaagatatataagagtatctgataggtcacaagtaccttgttgctaatgactatgacaacatatgtgccagatgctttttgacattattttatccaatcttcccaacagtctacaaaataaatatcttatgaggtagattttatattattattattttacagatgaggggactaagcatagagaagttattgtccaactggattaaaaaccaaagcccatgctctcaattgctgtattccactgcctcctgcttggtacataattgttaccattggctccaggctgctcctctacacccagcctcaggacaaggtcaggggcttgtcctgcctctgaccttgtcccgctattgctcactcttcatccccacttcccccatttcagtcccgtccccttgctccctgtccctacagatgtgcctcctgatggcttgcctgctaccactagaaattctgctgacatcacgagatattatcaccatctcttagagagcagttctcacactggaatgcagctagcgcacctgcaaacttgttctaaatgcagattcccaggctgcgttccccgattgattgagcagaagcctgggagttctaaaggaggtagtcaggggaaacatatctttagaaatgctgctttagactctaccagtcccattcaagaccctctgtcctcagctctggtcatcattagcattggcttagagctaggggatgccttgggaatgtgccgatcacggagcctcacggagtgttcatcttattgtcactcctcattttagctctgtggtcgttgtactgacctttgcttttgctgatctccctgattggataaaattgtattgtgtcctctcagaggaggacagtgtccccgctcatcaaaacacttactacatttgcaagtttacgtttattggtgtggtcatttcttttcctactggagtgttgttagcagcagccatgtctgggttttgtttactgtggtgtcttcatcactggatacctagtaggtgctccgtacattgtttcaggtgctcaatttccatcagtaatgctgttagaactattgggtatttaggcatcacctcgttttatggattgaattgacatttgacagtttaggaattcttgtttttataggaaaaaaatctgaattgtaaactattgactctgctttggaaaaacaaatttctgaaacaaaccttgtttgttagttgggggttatatatatgttgcatatttatgtatatatgtatatttatattttatcaaaaaggaaagagtttaaattttcttaatctggtaaactaggtacaactttgaatgggggaagaacattacaccccacaccccaaacaaaattatcagaaaattcatggtcatttaacttccttatctaactactaagaatgcttttcattgtgttccagatctctaattatatgacaaacaatactggttctgaatagaagtcttcctataggccaggcctggtggctcacgcctgtaatcccaacactttgggagaccaaggcgggcggatcacctaaggtcgggagtacaagaccagcctggccaacatggcaaaaccccatctctactaaaaatacaaaaattagctgggcgtggtggcacacacctgtagtcccagctgctcaggaggctgaggcaagagaattgcttgaacccaggaggcagaggttgtagtgagcctctgcagtgatcacaccactgcaatgcagcctgggtgacagagtgagactccgtctcaaaaaaaaaaaaacaaaaaacctttcttggcctcagttccctttctaggtaccctctatatctctccttcccatttcaaaaaaacttctttaaagggttatctgtagaaagaaacttcaatttctgttctgccatttcctttcaaacacacccagtcagactttcacctcctgttattttgccaaaactatttatgtcaagcacactggtgacttctaaaccacagaatccagtggtcagttttcagtagttaaccttacttgatctgtcagtagcgtttgacatagatctctcctttctacttgaaacgcctgttgcacgtggcctccggatatcatgctctcctagtttttctcatttcttcttggcctcctttgcaagtttttccacactcctttgaaatccgaatggtagtgtgtgacagggaccacttctcttttctgtcttcactcactggtagtaggcagctgtagccagactcatactttttataacactgataatattggtgacttctaaatgtatttttctggccacagcttttccctgagcccttacctcgtatatccacctcctgatgagtaccttcgcttggatatttaatacatatctcataattagcatgttccaaactgagttctctatcatcccccaccagacctacttctcccttagccttccccatcagttcatgacaatcccattttcccagttgctcattcagaacccttgattcctctcattcccttacatccatctccacttcctgactatgagatcaactgtatacaaaaacaccatggaaatttgttcaagattctgttatttcttacgacctctgttaaatgctgttttcctagcccactcttgtctctcacctggaagattgcagttgttttctaattgactgcatcttcccctgttctctagcagtttactttctagagaggaaatatcttttaattttttttagaaacgagggtcttgctatgttgcccaagctgttctcttaactcctgggctcaagtgatcctcccacctcgtcctcccaacgtgctgggattacagacataagccaccacacccggcctaatgatcttattaaaatataaataatatcagggccgggtgcggtgattcacacctgtaatcccagcactttgggaggcctaggtgggtggatcacttgaagtcaggagttcaagaccatcctggccaccatggcaaaaccctgtctctactaaaaatacaaaaattagctgggcatggtggtacacgcctgtaatcccagttactcaggaggctgaggcaggagaatcacttgaacccaggaggctgaggttgcagtgagccaaggtcacgccactgcgctccagcctgggcaacagagcgagactccatctcaagaaataaaataaataaaataaaaccatatgtcacctctcaatagcttctcatatcagagtaaaagctaaaatacttataatggcctacaagagagttgaaagggataacgtccgaaatgaaaaattcaatggatggacttacactgaacttaaagacacggtaatactaattacccagagtggagcaccgagaggaaaatgactgaaaacgaactgagcctctgggacctgtgggataatgtcaggcagtctaacagacgagagggagaaaaaatatttaagaaacattttttcccaacttttcaaagaaatttttacatattcattaaaaactataaacctacaaatacttataaacacaacaaactgtatgccaggataaacaaagagaaaactataccaaggcacatcagaatcaaattgctgaaaatcagtgatgaataaaacatttaaaaagcagctagagaaaaaaaaaaaagacatattacatacctgaacccaagagttcaagaacagcctgggcaacaaagtgagaccctgtctctacaaaagatttaaaaattagagctgggcatggtggctcatgcctgtaatcccagcactttgggaggccgaggcaggcggatcacgaggtcgggagatcgagaccatcctggctaacacggtgaaaccccgtctctactaaaaatacaaaaaagttggccagccttggtggcgggcacctgtagtcccagttaatcaggaggctgaggcaggagaatggcgtgaacccgggaggtagagcttgcagtgaacagagattgcaccactgcactccagcctgggcgacagagcaagactccatctcaaaaataaataaataaataaataaatattagccgggtgtgggggtacacacctgtagccccagctactctggagactgaggcaggaggattgcttcagcccaggaggttgaggctgcattgatccatgattgcaccatggcactccagcctgggtgacagagcaagaccctgcctaaaaaaaagacatgttacgtaccaggaaacaaagataagaacaactgttgatttctctctctctttttttttttttaactgttgatttctcattaacccttttcccatttagaaaaaaagtacggctcgctgccagtgctcctttaattttacataaacacgctctttaaggctgaagcaaagctgactgattttcaatgtgaaaataaaatacacaaactgtttttgtagttatttctaaacagaactaacatcagaatcatctgagtcatcagaatcatctatttcggaaaaaattgattcattaaatgaatcttcagccagccgtttgagaacgatgttaataattaacatcagccaggcatggtggctcacacctgtaatcccagcactttgggaggcagaggtgggtggatcacaaggtcaagagatcgagaccatcctggccaacatggtgaaacctcatctctactaaaaatacaaaaaattagctgagcatggtggcgtgcacctgtagttccagctacttgggaggctgaggcaggaggatggcttgaacccgggaggcagaggttgcagtgagctgagatcacgccactgcactctagcctggtgacagagtaatactctgtctcaaaaaataataataataattaacatcatgcacaggaatgctacgctttctaagctttggcattttcagcaatcaagaattacagtattttgtaaatggaaataccactactaagaatagaatgctataaatagaatgatgtcttttctttccaaagtccgtgtactagagtgatgagagaataataataaaagcgagatatttcatgggaaagttatctcagggtaaatgctgtatctgcaagcgctgccagtgagtattctcgggacaaatgggaaaaggattaaaagcaatgcaagccagaagaaaatggaacggtaccttgaaagcactgagaggacttatttttcttcattctaaaatatacagattttctagctttttccactgagaaggcctagaatcggtgagcctagaacagtgggcaccctagcatcctgactgcagtctctaaatactctttgccagtaaacggaacgagggatccttagaaggatggttcattccaagtctgggacaggatatataacaaacaaaactacagggccaggcacagtggctcacacctgtattctcagcacactgggaggccaaggtgggtggatcacctgaggtcaggagttcgagaccatcctggccaacatggtgaaaccccgtctctactaaaaatacaaaaattagctgggcgtggtggcgcacgcctataatcccagctacacaggagactgaggcaggagaatcacttgaacttgggaggcggaggtttcagtgagctgagattgcaccactgcactccagcctgggtgacagagtgatactccgtctcaaaaaaagaaaaaaaagaaaaaaaactagagcattttattgtgctagaaagcaggaaagctaataaggtctaatggttatatcaaaagaacacaagagcctattacaggagctcccactggccaaaggtaggagagtttgagcttcagaaaggtgactggggccgggcgcagtggctcacacctgtaatcccagcactttgagaagctgaggcagggagatcacttgaggtcaggagttcaagaccagcctggccaacagaggcgaaaacccgtctctactaaaaatacaaaaattagcttgtggtgcacgcctgtaatcccagctacttgggaggctgagacaggagaatcgcttgaacccaggaggcagaggttgcagtgacccgagatcatgccattgcactctagcctgggagacaaagcgagactctgtctcaaaaaaacaaaaaaacaaaaacaaaaaaaaacccagaaatgtatcagtcacatacaaacataaaagaaacctaccagccatttgcaaagtggggactttgtttggatcttgactttaattgtaaatggacattttttaagatttgaggaaattggcagatggactgggatactaaaatatttttgtctgtgtttttaggtgtgataatggtgttaggttgtgtgaaatgtttttactatctgatagatgtacaggctcaagtattcccaggtgaaataattgcctggggtttgcttttagccactcgtccctgcacaaaatgttggaggaatgaaaattcgattagataacattgacaaaatgttgacattcattcaagttttgctatgggtacctgaggggtagtcattagattactctattttatgcaagttttaatatttctgtagtaaaaagttagaagaccatgtgcttaaggacctttcatgtatctataagagagagcctcactcagagtatatagtgttgccttataattaggcgcagttctaatgagtttgggatgggtaccagttttatgggagaaatagactgatgctaaaggcagtatccttatagaaataaaaatgtttaactggcaacatgaagtaacactgaaaattcttagatgtacacaaaagcttataaaagcatagcgctagggggtcatgtagtgatatttagtagattggctgtgcctcagttgtcttgccagaaggcatcttctaaaaagtgcatcatcacagagcgcagcacccgaacaaaagtggtacatgcggctcccctgccgactcaacaggttcttcccaagggctgtcatgtcagtgggccagcgccactcctgaaggactgcttttgtttaaaggatttgagagatggattcctgaggatctaacaccatattccattatgcattgtgggttttttattgttttccttatcatgatttattattttttaaatttttctttgaagtttgctcattttaatccatgttcatttctccctctgtatgtgtttgtgtcacgcttgctgtctttgcctccattgttcctaggttacagtatagccaggatatacccagtcacttggccgatgagcatgcgctgatagcctcctatgtggcccgtctgcagcactgtgcacggtcagtggtggtgcagcagcagtgggtagccacgggtgatcagagggagggagagctttgctacctggggttgtcagctggaaaaaaaactgcatgtcaggtttttcttgagcagctaccagctatgtttggcagagttaaaatagttgctaagcattagcttctacaagagagggaggcttgccaagcctgggcgctgacctaaacatggagtcagacattctcctttaaagtggggttcacttccttcagcttacactcaaaaaatatataaacctatgagggatcgcagtactcacagaggtatctgatgcaacctcttcctgttcattcttacctaactaatgaaatctttctattgacattccaagtttagagttgatcaacccacagatatcccactttgtcttatctggggactttgatactgtcaccctattacatctttaccaccctttatctgttagcaggaatctgtcagtgttgattatttaaaccggtgattcccaacaatggtattgggtcactgtcacctgagggtctttttccaaattatgtagaccctctcatattataatagttacatgtattataatagctccacattccccttaccctgaaaactactgcggtagtgactcactgttaataagagaatgtgtctgattcttcagtggtttgggatggaaaaacgtttgataactgctaactatagcaaagttaatcctttttttaaaagatttaataccgaaaaaagtggtattactttcaggtaggtccaaagtctcctgctcactccatgcccacacccaccaccattcttcaagtaggatgacaggtaaagtttaagcaatctaaagccatccttcccctacataacagcaaagaagaatcacagtgccaaacaacttggaaagccatgctttgagattcttgttcttagagagaaaaccataatttataagctgtacacataacagaggctgaagctttaaattttgatcttagttttgcttatagcatgccatggctccttgggagggtcatctgaccttgctgctacttcccctaataacagaagaataaattaatagtcagttgggaaatatacatatgaaaaagacttttaaatattatactttataccgttttccatagttttcctgatatgactaaatagcatcactattctggggtatttatgtatctctaaagcttggagaagtagagttttcttttctttttttttttttttgagacagagtctcactgtgtcgtccaggctggagcgcagtggtgccatctcagctcactgcaagctctgcctcccggcttcatgccattctcctgcctcaacctcccgagtagctgggaccacaggcgctcatcaccacacccagctaatttttttgtatatttttagtagagacggggtctcactgtgttagccaggatggtcccgatctcctgacctcgtgatccgccggcctcagcctcccaaagtgctgggattacaggcatgagccaccacgcccggctgagaagtagggttttctaagcttctaaatatgtttaataggcttaccctctaggagggaaggaagggcctgataattgtgtgcactgcatcacagagtgtctcctcatccaacagatgatttctttgcacactgtcccagcctcttggtctctaggaacagagttgtttcaccctaggcaagacaaattctttattatcactaaaggcaattgtccagagtgagcaaaagtttccatggtaaaaatagcagcagaatgtttgacaagagactgttacctagtaatttagcccaataagatttatggtaggtttagctaaggccctgaagtctcaccttggctccctgaacaaaaattggtggctggtagccctgggagaacatgatgagtgagtgagtactacatgacttcttgattagtaatctaagaagctgagcttcatacttcttccgagaagtcagaacttttctggctaactaattctgaaaatgaaagtcaattcaaacagaagaataaggatcctttctaatcattgaccttaaaacctctcatcaacacaagcttctagtttctggctagaaaacatagccaattaaagcagtctgtcatccacactcatgtataaatgacaaataggatcaaccttcctaaggagatagaatgtgattgagaaaaaggagctcttttgcacagaagaacctattgtatcccttgccagataacagaggtcagccactttaggccccacttcttcggctaccaatccctccataatatgatccacttgtatcgttaagcattcatttttattgttttttttttaatttaaaagatagttctcttatttcagacaaatacctttaaagcacaaatattatagtttatctctcaccttggggccttgaccctaaaatattaaagccgcctaatagtagtctgttcttattacaagatcatttttgagagggtgatcatcctgaagatggatatttgcatgcttaaaattataaagtgttgacaaacgtcataggcgaagactcgaagcacttaaaaaaaaatcccagaagaaagactaagttaagcttaaagacttagccaaagagatagaaagattaaaaaaaaaaaaactagaaaaaatatagttgattctacacatgaaaagttcagacaggtctttattgatttagccacacccttcccagattcccctcagtaattataacaaacttcgatgagtattgaagtcatgtctttaaatttttctgtatgacttgtcatactgccaaactctgatcaagggtttttggaaacccaagaacatagggccaaagtggaggtaagccacaacagccacctctggtcatttagtcaacatcatcactgtcgtcttaaagcatctgccagtcctaaacagagaattatatagccacagtccctattaatctaggactgtcttgataaggataaatagcatttggtatactaaagaagtcatgtatttcagaatcagaagttccatatcagcatcccatatgcagagccagcctattactcaagaacccttccctcatccagataccacattgtctgatagcctgtctgaatgggtccttagatttttagagtattggtactcttgttgaaaagtaatgcattaaactaattaactccaagatggggctatagatgtagaatgagcatagtaaaggaagagaaaggggcatgaaaaggggaatatttgatgtcatggaatctttccagctttacagtgtgtttggcctgccctggcaaggccaaacttttgcttagccagtgttaagtatattttttctcagccctctgtttttcatgatgctttagttttctcttggtctttttgaatttgagatcaaggtctaaaaagtcatcagttttaaacatttggttagaaatccctgcctcagactttgtgggtgccctgtgttttctcaggccttgcattcaaaatgaagtgcccctttgatggtggaggagcagcggggatgtgctgccagtgaggaatgacaaatgtggcctcctcatttctctaaatcccctttttttcagaagaccattagtatctatgacccaggcctctagttcttttattaccattcttttatgagcttttcttccatctgttctttctgagaatggaacaagaataagggatgtttaatagacacttgttgcatttttatttccttggcagtgttctggacagtcctagccgactggatgaggaacaccgtcttatagctcgctatgctgcccggctggctgcagaagcaggaaacgtggtaagttaatggaggatcccaggagagtagcagaaattagcattactttaatatgcaaatggaaagggaatagtagacatgaaatttaggagaacaggtacctcggggacactttccacttttccacatgctaagagtagaaggaaacttcctcaccctgataaagaacacctacaaaaacctacagttaagatcacacctacagtttaaattttgaaatatttccccctaatattgggaacaattcagagatatccactttcaccacctctattctaaattatactggaggacctaattaatgcaacaagacaagaagaaaggggtataaatattggaaagacagaagtaaagcagtctttatttgaagatgacatgattgtgcatatgaagtcctaagaaatctaaaaaaacactagtagaacagataagtaaattttatagtattgctacaagatataaagtgtatatcccagcaccttgggaggctgaggcgggcagatcacttgagctcaggagtttgagaccaccctctggcagcatagtgaaatgctgtctctataaaaaatacaaaaattagccaggtgtggtagcacgcacctgtagtcccagatgctgggaaggctgaggtgggaagattagttgagcccggggaggtcaaggctgcagtgagccatgattgttccactgcactccagcctgggcaacagagcaagaccctgtctcacaaaaagaaaaatactatttactgtagcattaaaaataccaaatacttatggataaatttaatggaagatgttcaagtctgaaaactgtaaaacattgctaaaagaaattaaagaaaacctaaataaatgaagaggtatgccatattgatggattaaaagatttaatattgttaggatggcagattttcctaaattgatctatagatttaataccaattcaaatctcaacaggcttttttatagaaattagcaaactgtttttaaaatgtatttggagaaccaaaggacctagaataaccataacagtcttgaaaaagaaaaacaaagttggcagacttaatcctacttgacattaagacttactataaagctatagtaatcaagaaagtaagatactggcaaaaggatgaacaaataaatcaaaggaacagaatagagtatccataaaagacactcatgtgtaaggtcaaatgactttcaacaaaggtaagaagcaaatcagtcagaaaaggaaactctttctatttttaacaaatgctgttggaacaactggatatctacacagggaagaaaagaatctcaacccctgcctcataccatacaaataaatcaatttgaaatgtatcataaacttaaacataaaagctaaaaccataaagctactaaaagtataggagaataattcttcattctcttaggaagaataaaaattcattagagtttatagggatcacaaaccattttaaaaattgataaattagaccctatcaaatgtaaaatcttttgctcattagaagatactattcaaggcaggcgggtcacaaggtcaggagatcgagactatcctggctaacacggtgaaaccccatatctactaaaaatacaaaaaattagccgggcgtggcagtgtgcgcctgtagtcccagctacttgggaggctaaggcaggaggatggcatgaacctgggaggtggagcttgcagtgagccaagatcacgccactgtactccaccctgggtgacagagcgagactctgtcaaaaaaaaaaaaaagaaaaagaaaaacagacaaaccactatctgaaagaaaatatttgcaaaacatgtctgacaaaggacagaatatataaagaattcctgcacctcagcaataaaaagacaagccttttttaaaaaatgagcaaaagacttgaacagatattccacaaagaagatatgccagtggccaataagcacatgaaaatgtgcttgatatcattaatcatcaggaaaatgccaatgataccactgtatacccaccagaatggctacaatgaaaaagttggatgataccaaatgttggagaggatgtggagcaaccagaaatctcaccctgttgttggcgggcctataaaatcatacagctactttggaaaactatttggcagtttcttaaagaagcaaaatttatactatgacccagcaattctactcttagatatttatccaagagaaatgaaaacatgttcacaaaaagcgttgtacaagaatgttcatagcagttcaattcataatagctggaatagcccacgtagttatcaacagaatagataaacaagatgtgttatattcatacaatagaattgtctcaacacaaaaaggaataacattgatacatgcaacgacattggtgaatatcaaaaatattatgagtagtaaaagaagccagacaaaaaaagtacgtactgtttttttctatgtgaaattctagaataggcaaactaacttatcctttgccataagttaatcatcaactcctaatcataatcagataagaggctgtttctagaaatggaaatattgaagagagacgaggaaactttctgacttgatagaaatattccacatttcaataggggtgtgggttgcaggagtgtacatttgtcaaaacggattaaatgaaatacttttttttttttttttttttgagatggaatcttgctctgtcgcccaggttggagtgcaatgtggcacgatctcagctcactgcaagctctgcctcctgggttcacaccattctcctgcctcagcctcctgagtagctgggactacaggtgcccgccaccacgcccggctaattttttgtatttttagtaaagatggggtttcaccgtgttagccaggatggtctcgatctcctgacctcatgatccgcctgcctcggcctcccaaagtgctgggattacaggcgtgagccaccgcgcccgtcaatggaatacttaagatctaagtattatatctcaattaaaacaaaaaggaaccaagaatgttgaataagggtttgattgaaataggaagtggctccccagggatttgcagtgtgtttcctgcaattttgaaatattcataataaaatgttttctcttttccttctcctttttcaattctttactttctttgaggagttatgttcacattaatattcacccacccccaaccagccacacacactcattttattcattcagcaaatacttcttttgttgctgtactgtgccagattggatactatggtggacaaatgattcctgccctcatggaactaacagtgtagtgacagagacaaacattaaacaaataatcacactactaaacataactacaaattattatgtgcagtggaggaaaaatgcagggagctgtggaagtgtagagcaggtgcctgatctattctggagagtaagggatagcttctgtgagaaagtgttacttgagttgggatctgaaaataagtagaagagaattcaatttcctaggaattgaaaagtaactgaaaaccaaagcaggccaagagctactgttgctgtcactactactgccacccctgccctgtgcttggatgtcaattgtcaggaatttgtgtggcaaaacctcggttacgtgcaaagtgaagagttggaaatgaggttctcacattaaggtaggcccttgaagcattatacccttggtgaatatgttgtataaaagataactaggccgggcatggtggctcactcctgtaatcccaggactttgggaggccgaggtgggtggatcacctgaggtaaggagttcaagaccagcctgggcaacatggtgaaaccccgtctctactaaaaatacaaaaaaaaattagccaggtgtggtggcatacgcctgtaatcccagcttcttgggaaactgaggcaggagaatcacttgagcccaggaggcagaggttgcagtgagctgagatcgcaccactgtactccagcctgggcaacagagcaagactcttgtctcaaaaaaaaaaaaaaaaaaaaaagataactagctgccagcacacagaaaaagaaagcttataggtctcctgttgcagtggaagaagtcgtctcctctggaaattcaaaaccttaggcctgtctatacttactttgggtacatttacattacgttatagtttgagaatcaccaaggtgaaattttaacattaaaactaaccccaaggcacctggtagaagcagcacagtataaatttctgcttacattctcaattgagacctaacagtgctcccactgaaagagtccaactaaacttgaacccctgtgctgactttgcaaaatgagaccctcaatggctttagatattagagttattggctataaaatagctatgtttaagatttctaaagacctaaaagaaggaattaaaaacctgacaaaatactgtcttaaaagaacaaagttgaaaacaaatcacatagaaattacagatttttaaaacaaaagttattgaaatttaaaacttggtggatgggttaaatgtcagattagacacatgaatagagaattagtgaactagaaaatatatttaagaaaattttccaaaacacaacacagaaagatgaaaaatctgaaacaaggtcttcagatatgggagatagagaaccaacagtcatgtaactggaattccaaaaaagaaaatagaattagggttaaaaaatgtttgaagaattaatggctaagtttccaaaatgtgttcaagacattcattctcagatgaatatatcgcaatgagtccccagatacataaataaaaataattctacaactagacatatcatagtgaaactacagaatacaaagatagaatcctcagaaagcaaacacataagatgttactttatctacaagggattcactactagatttctccccagaaacaatacaacaatttataaaggaaaaaaaaaatccctttaaaaacaaagccagatacagtggctcacacctgtaatcccagcactttgggaggccaaggtgggcagattgcttgagcccaggagttcaagaccagtctcagcaacatagtgagacctcgtctctactaaaagatgaaaagttagaaaaaaaaaacaaaaatagccaggtgtggtggcatgtgcctgtagtcacagctgcttgggaggctgacgtgggagaattgcttgagcccagaagttcaaggttgcagtgaactgtgatcatgccactacactccaggctgggcaacacagcaagaccctgtctcaaaaattaaataaaacagtcgattacatccaatgttaccagtgtttgtgaaaaaaccttaagaattttccttataaaaacagacggttgaatagtataccaaaaggaactagatgaactgtcaaaaggagaaataaagaccctttctcacaaggacagagaggtcacagtaagattcatcctaaaagagtaatactaatagctagtatttattgaatatttactttgtgccagtcattattctaagtgctttgcatgtattagctagtttattattcaaaacgttcttgttgaggaaactaagcttcagagagattaaaaaaaaaaaaaaaaaaactacccagggtcacatggtgtgctaagtggccaagctgggacagggatactgtcctgtctcctaactactaagatttaactaccggaggttataatttgggagataaggaattaaacctagatgcaaagagtgagatggaaggaggaatgagctgaagccaaaacaacagagtgtccaagcattaaccaggtaaagagaatgaagtgtatgcccagcggggtatttcagcatatgtaaaggccctgaggctggaggtcgcatgacctgaaagttgacattgtggctagaatgcagagaacaatgctggaatgaagtcagacaggcgggctcatgcaggaccatattaaacaaaccagtacgtccattttggaaatgcgtaccaatttatgttttatcttcatagggaaatagagttacgaaagctgcaaatgggaattcttgctttgtttctcccccaaaaagtaacttatccctttgagtttgtttagatttcaaaatcctttccttgaaaatctaatgtcagctcacgtatctgactctaacattacaactctaaaggttagttagtgaaatggaacagaatagaagaaaaagcctgagaaagaaacagaaaagtgctatttggttagttaaacctcagacatgccctcagtcagtcacaactgctctaggtattttagacattaaaatgtataaataaacttgttgagatgggccgtgctatggttggattttaaaaattaagtatattttatgccgttatatagtcttactgagtttacatagtacttttaaaatgttgtcaataaaagctccaaagccatttgaccttgaaaagatttcagtactcccttactgcaaacaagataagtctctttacacctgatagtttctgatgccaattctttaattcttctggaaatgatcgttgttagaatgaatactgatatgtttgggccctttcatcttgggtttattttgcagagtgtagttatcttataactattgagccactcaggaaggattcttcttgactagagttctgttatacagaaactcctaatcctctaatctcacattgatacaagtgctttgcataaagtgggtgtagtgctcgaaagaatttatttataacctgccagataggtttgtattgatttttttcaaagaccttcttccacattgttaaataatttgagcagccagcagtgcgccctgtagcatgcttcagcgtccgtgccataacttctccctagatggggagcggggctgcagaaacctctgtgggctgacctttgaagaaagacatttcacgttgcttatatgagccaggagagagaatttgttttcctgaagtgcctacatttcttttttttttttttttgagatggagtctcactctgttgcccaggctggagtgcagtggcccaatctcggcttactgcaacctcctcctcccaggttcaagaaattctcctgcctcagcttcctcccaagtagctgggattacaggcacctgccaccacacccggctaattttttgtatgtttttaatagagacagggtttcaccatgttggccaggctggtcttgaactcctgacgtcaggtgatccacctgcctcagcctcccaaagtgctgggattacaggtgtgagccaccgcgcccggtcctaaattccttttttaaaaacaaaactataatgtgtggtaaattgtagtcgtaatagcaaattcttaaagtgtcatcacaaacgtcaccaagatgtaatcagatgttttgtttacctttaagggttttttttcccttataaaaaaatttaaaattcattatggaaaacttggaagaaaggtgaaagaaaggggaaactatcacccattgtcatgctacctcacacttaaaatatttctgagcagctttctttcagatcccaggctgcacagcccccatctccttgtcagctgctccaggcatgcagcattcagaaataccctcatggcccattataattaaagatcgacagtctcctatgatgtttcgcacacatgtaatggctccaaacctccctacatgttgtaatcatgtatgaagtattttaaaaatatatagatccttggctttgcctcagaccttctgaatcagaatctctggatttagggcccatccatttttattggaaaaaagaaaactcccagccttctgatttacggtgagcttgggaatcactgccttcaacagcagattggatttttgagagagggtgacaatccacagccctctgggtagtctagggcagcttaggtgatgggcaggctgcccctggaatataaagaaagcctagctgataccaggtgcatctctttggaactcatcttgccacattcatacagataggagtctccgagctctttttaggaggctccagaaatgcatgctactggattaccgtttgctgactgtgtcggcatcccttggttttataacatttgcccagtttgactcaaaggggtcttatttattatcctgtatttttcagatgtgtctcctctcattaagatgatggagctctgtgagtccacctgaacctgagagaatgctcctgtgacaggaagttagaggcaccttgtccttccaaggactaaagggacctcaacaccttatttgcatgtaatagtaaatggatcccagtctggagccttcattcttaaatacagagctttaacttttataatatgatcctctgatcccttttttgcctttcattgctctggccttaacgcctccatccattcaacctaacagttgcattcattgttaggtctttgattattgtttaatttttagatgatctctcaccttttgtctcctaaactcattcagcttatatgtttgtggcatttgagaagtctttttcctccagatgttaccctgcctgactgctttgacctaataacagaatgagaaataacagctaccatttcgagagccatctgtatttataaccctgtgctggatattttagaactattacctctggttctaacagcaactctgaaggatagttgattcccaatgtgactttacaaaaaaggaaaccgaggcagaacaaggttaaatcatcttgcccaaggttcctcagctagatttgagattcaaacacagggttatgtgactttagttgtgaatgtggtaccctttaaatacccttctgggatcactttccattcttacagtcagatatacactaccagtgttttttacttacataaccaatgtttttggtatttggtgctaagtaaattggtttttttcttaaaacaacaaaaatgtgcaggagttgttctacaatgacccagttctgtctgttttgacaagaactctgattcttagagcagcgcatcgaccttggatgcacattgaaatcacccgagaagtttttgaaactactgctgcctaagcccagttccagacatcaatttaattggtcttggatgatacaacctgagcactgggggtttaaaaatccctctaggtgactggagtgcatggccaagtttgataaccactgaccaagagaaacgtttctggactagggataagccagagtcacctgccatgttagatgtgacccttagttgaaaaccattagttttggatagagtgcacaaggcaataattttagtttctctgttaatctatcagattcctctctgtaatctgcctcttggcaaaggaccagtactttactctttcaggccatgttttgcactttattaggccctaattagctcaacgttgaactagaaaagactagatgttgttgacactttaggcgaacttgccaaatatgagccaaatctctgggcttattaaaagttcaaaaatctgaaccctgaagttttcttgttttttgaaacctgtttggtctggaataagttaagaggaaaaaaaaaatctgtttagggaaaagttgaaaaggtgcatgtcatcatcttcctagccagaatgcagattaaataccatctctatcctaactttctaggaaaccttcttttcatttcacaacttaggaatgcctatgatgcctgagtgtctttgaaaaaaaaatttctggttcttccttaggattcaggtttccctgattgaaaacaaccctggctttgaatttgatacagatttggaacttttcagtttgtaagtttttgttaagaccctgttaagtgttttgtttattacttcagaggtgatcaagaaacttcttgaaagagcaaattctgcttaatggcatgagagctccatgaaggaatttattagatacaccctgattctccactgccctaacacacgatactgagttgctaatgtccacattcagcaccaggggaaattcgtgcatcacatgacatcgcctcattaaagctgtcagcataactttaccaaacaagttatataacaaccaagaagccactggtacaggataatattcagaatgtgacatgtaaaaattgcaataagtagaatatattttttatgttgttgaacaaaagaaaattgaaagaattaaagcaatccaagggcctagaagcaagtgaattctctgatacctgtgagtaaggctactttaggacagcccatgaatccattcctcgggttgttctgagctccttgagaaatggccccaactgggtttttggagtgaacctggttcaatacagattgccttaggatgttcactgaaagtttcggcttgctctggactcccagaaaacgttcaaagaatcgggttgttacacaggtggtttcattgtaaggatgaaaggaataggtttggggaagtaaatcactgagttgaagcttcagagatgtccttccacgtgaaccaggaaccactcaggatccaggaatcagtttatttgccttgaggtcttctgggttgaagcaaagagaggggaaaggtaggcctgtaggtgaatgacttggtacccagtaggagtcctgttacctgtaccacaggttggtcagcaatcaaaagctggcttaaaatatttctgcagatgtctgctgacgtctgtaggggtgattgttttcaagaatttgcattaaaatacttgagagagaaataaaatatgggatagatgaagcaaatgtgtcaaaaatctttgtaactgtttaacctagtttgagtatatggaaatacattattttctctccttttgcctatgttaaaaatactgttactacatttttaaataagttaaaatagggaaccacaaaaatgatacctatatacttgaacatttctctgcatgtcctcatgtatatttggatgtaggaccaagcccattcactgagtgtaggtcctctggagctccaggttgtctcctttgcacaaaatgttctcacatgttgcaagttcagcttcctttttcagtcctttacaatgaaatgagaacttactaacttacgatgcaagagtacaaaatttctctttataatttttccaaatctttacagctgtcttaccttcagctaagtcagtgccattttattctagaagcccatctctatggagtctccaactcattcaacttggttttcctagaaatagaaaccctcttttcatcctcgtatctcactggtttatttgttatttaattagatgacataattgcaagtgcatttgttccagtgaggaacagacgagtcttgttaagcacgcaagctgtgttttccacaggaagccgagacccttccagtatacctgctatgctcactaagtagagatcaattaagaggccttcagctttagttttttttctgggcatcttttgctctagatgctacaacccccgagttgctcactggacctgggaacttccttgagttttagtggtgtgaacataatgctttgactaccaagattctagaattttattaaaccccagaaccatgtgtcctccttatgagtaagctttgcagtgtttatcttcagtttaagagttctgcctttgctacttgctggatttacacataagaggtgtataataagtttattagatacaattttattttgagttataattatcagcatttgtagagcattgtgctgcctcctacattatatcattaaatcctctccacatcactttcactaaatattcccattttatagacaagaaaataaaggtatagtaaaataactcaatgttgcacagccagaaagtagcaaagctaggattactaattcgtctccctactttcattcctctcctactacactaaattctccaccgagtagccaaagcaatgtttattttttaaaccttattttaaaagttttagatttacagaaaaatttcaaagatagtacagagagttctctataatctacacccagtttcccctattattattttgagacggggtctcactctgtcactcagactggagtgcagtggtgtgatctcagctcactgcagcctcaacctcccaggcttaagcaatcctcccacctcagccccctagtagctgggactacaggcacgcgccaccaagcctggttaattttttttgtattttttgtagagtaggggttttgccgtgttgaccaggctggtctcgaactcctggcctcaaatgacctcccacctctgtctcccagagtgctgggattacaggagtgagcaacccagccaagtttcccctgttattaacatcttgaattagtatggtacattcattgcaattagtgaagcaatattgatacattattattaactaaagtccatactttattcatattttctaagtttttacctaatgtccttcttctgttccatccaggatacattacatttagttgtcatgtcatcttaggctcctcttagctgtgacagtttctctgactttccttgtttttgatgaccatgacaatttttaggagtactagtcagatatagactgtctaataactgtaatttgtccgatgtttatctcttgattagaactggggttatgggtttgggaaaggaaaaggtaaagtgccattttcatcatggcgtatcaagaggtacctactatcaacatgagttgtcactgttgatgctgaccttgatcacctggctgtggcagtgttcgtcaggtttctccaacataaagttattccttttcctttccacacagactcttcggaaggaagtcactatgcacaggcttctcttaaggaatggggagttaggcttcacctccttgagggcagagtatgtccataccttatttggaattcttctgtatgggaaatttgtctgttcttccccatgtattaaattactcagccacttatttatgtaaatgtagaacagtgtttttaacacatataatcaaatttcatattcccctgcccagaatcctacagtggcttcacaccacattcagaatgaaatggaaactcctctccatggctcagaggccctgtatggtctagaccaagcttgtccaacccatggcctgtgggctgcatgcagcccaggatggctttgaatgtggcccaacaaaaattcatacattttcttaaaacattatgagatttttttgtgatttgtgtatttatttatttatttatttttagctcatcagctatcattagtttttttgtgtgtggcccaagacacagttcttccagtgtggcccagggaagccaaaagattggatacccctggtctagacccttcatctccccgtgcctcgctcttaccacagcttccttccctccgtcagcactgatctgaacaccccaagcccaagcagctgcagggccttgcatttgcccttctttctgcccagcaggccttccctcagaccttcacctggttggcttcctcacttcattgagtctctgagagccctttcatcaccacctcatttaaaaagaattttctgtcccggttcactgtttccttaccctgcatttctttattgcattatccctgctgatgtctatatttattttttgggtttcttatttttctcccagtgtaatctgagctccatgggggtggggctattcaccagaacatccctaactggtagagcagtgcctggcacatagtaggagctcaggaagtatctgttgaataaatgtgtgaactacttattttttgaaagaaatcatcttcatgtctctctggccaaagcatcctatgtctttatgaactggatcaacaaagtctcctatgttgttatgaaatcattcccgtctttttcccttcagtgtcctgaaggcattttaggaagagacttggcttttttcttcttcttcttcttaatgagcactatggtgtttaagattgtaaataaaagctgagtgcggtggctcatgcctgtaaccccagcactcgggaaggccgaggtgagcagatcacttgaggtcaggagttcgagaccagcctagccaacatggtgaaaccctgtccctacttaaaacacaaaaattagccaggcatggtggcacatgctgataatcccagctactcaggaggctgaggcaggaaaatcgcttgaacccaggaggcggaggctgcagtgaaccgagatcatgccactgcactccagcttgggcgacacagcaagattctgtctcaaaaaaaaaaaaaagtacatagataaaagttctaagtttctgttatttgatgtatacttgactgtatttaaagtttgattgagtgagataagccatcactggacactcatcactgaggagtcctaccgggacaccagctgcccctaggggaactgctgcctcaggattggaaccttcctccacccctacttctttatatttgcattacagtgcttcttggagccaaccagtcttacctgattaggaatctctgttgataatgacttgattcctatattaacctcctctgtggaagatcccttggctttgcagttactcaaaaccagaaagcttctctagatacttccagagaagtgccacagggcttcttttcatcatcatatgaagcaaatttctttcagagcttacctcctgacccataattttccctcgtctcactctattaagcagctgttacttttagctccagttttcaggaattgcaaacctgttcttcacagccagcctcagtctcaagcaagctacttttctgagactcaactcaggctctcacaagactgactacaatatagaaaatttactcagtaggctgccagtccatgcttctctggaggaagaaaaatcatcttggttttttttttcttttaaaaaagaaaaacacttgataatttggtaaaaagcctcttacccagatttgctatgctgttttgcccttgtttatttagaaactgccacatgaaaagacttactgaatcttcatgctctagacaggaaacaaggtcttcatggtacaacatgtttcaggcagagccaagagtgtacagagtgaagcagggtcatcgtggagccctcagtgagagctgcctttctggttaatcaataaaagggagccaccacctactcatgttcattggctaccatattcttttttttttcttttttccccagatggagtctcgctctgtcacccaggctggagtgcagtggcacaatctcagctcactataaccaccacctcccaggttcaagcaattcttctgcctcagcctcccaagtagctgagattacaggcgcccaccaccacacctggctaatttttgtatttttactagagacaaggtttcaccatgttggccatgctggtcttgaactcctgacctcatgatcctcctgcctcggcttcccgaagtgctggattacaagtgtgagccaccgcacctgctggctaccatattcttaaaggagttaacaagggtcagaaatatcagtggatatgcaaatcacaatcacataatttctccacaaaacatatacaaatggccagtaagcacatgaaagtatgctcaacatactagtcattggggaaatacgaattgccttacaatgagataccacttcacacccattaggatgatgtggaaaaaatagaaccttgatacattgctggcaggaatgtaaaataatacagtcacttttgaaaacagtttggcagtttctcaaaaggcagttaccatatgacccagtaattccattcctaggtacgtacccaagagaaataataacataactcaacatacatgctcaaagcagcactattcaaaacagctgaaaagtggtaacaacccaaatgttcatcagctgatgaatgggtaaacaaatagtggtatatccatgtaatggaatattattcagctgtaaaagggaatgaagtactgatatgtggtacaacatgggtgaactttaaaaacattttgctaagtgaaagaagatagacataaaaggtcaatattgtatggctccatttatatgaaatatccagaataggcaaattcatagagatggataatggaggtcaagggcgagggaagggggatggggaatgactacttaatgggtatgctgtttctttttggggtggtggcttcacaacctcatgaatacattaaaactactgaattcggccaagcctgatggctcacacctgtaatcccaggactttgggaggccaaggtgggtggattatttgaggtcaggagtttgagaccagcctggccaatatggtgaaaccctgtctctactaaaaatacaaacaatgagctgagcatggtggtgcacacctgtagtcccagctacccgggaggctgaggcaggagaattgcttgaactcgggaggcagaggttgcagtgaactaagatcatgccgttgcagtccagcctggtgacagagtgagactctgtttcaaaaaggaaaaaaaattactgaattatatgctttttaaaagtggattttatggtaggaaaattatatcttaatttttaaaaaatttactattgagaacttgatacctactaggatggttaaaagaaaaaagtagtaagtaaataaaaaataaaaagtaaataaaacaacaggtgttggtgaagatgtagagaaattggaaatctcatttattattaatgcaattgtaaaatggtacagccactttagaaagcagtttgggagttcctcagatgttaattatagttatcatataattcagcaattttactcctaggtgtctacccaagagaaatgaaaacatacatagacaaatacttgtgaatgaaagttcatagcatcttcatttgtaataaccaaaagctggaaacaatagataataaccaaaagctggaaacaatagaatactatacagcaataaaaaagaagggactactaggccaggcacggtggcatgtgcctttagtcccatctactcagaggccaaggtgagagcccaggagttcaagagtgcagtgagctgtgatcatgccactgcatcctgcataccagcctgtgtgatagagcaagaccttatctcaaaaaaaaaaaaaaaaaaaaaagactagttcatggaaaaacatgaattaaccccaaaaacattatgccaagtggaagccagaaaccaaagactatgtgtttatatgaagtttctagaaaaggcagaactatagacagaaagcagacgcatggctgcctgaggttgggggtgggagtggcgactggtgacaaactggcatgagggaattttttgcggtgatggaaaatgttctaaaactggactgtggtgattggttgcacaactgtttaaatttactaagactcattgaattgtatacttaaaacgggtggatttatgatatgtaaattatatgtcaaaaatcttttttaaaaatcagtcaatctagaactctgggtatatttggatcagaaaaaaaaaaactttctccccacttccccactttagactcgtcctcccactgacttgagctttaactttgatgccaacaaacaacaaagacagcttattgcagaactggaaaacaaaaacaggtaagaacgcagaggctgagcccacttccagagtccaggattatcacgtgcgtatctgattctcattttccttggatactaggtggcttttgaccgccaaggaagaccttgcctcagtgaacctaggctagcccaagtccagggaatgccctggacgctgatttgtgtctgtctgcatgctgttgattctggtagtccacagctctgctcacctgccctcgggggattccttttagcagggcctcctcccacccatccgtgtgaccccctctcacaattgcgttttccactctgcttcccagcaacattttgctgtatctagtcatcttgtcctgacccattatgctatgtaggactgtctggtctctccttaaaaaaaaaaaaaaattaatgccatttaacggcacagagagcagacagcacaccattatgtactgaaaggtagaagccaggatgtggagacccgacctaaggtaacaggcatagatagaagcaacatagctgtctactggggcatcggggacagagggaaggaaggggcagggaaggattaagggaagtcagcacaggacctgcattaggaggttgcaaggagttcccttttcctcctgcctgagtggaacggagtaaataaagtattctggctgtaattttcctttcttggagatttttcaggtccttgagaagagtatttttatgactttttccaccacaaaggattgctttgttgaggaaatgtcaggtgaagcagtattgagaaggtgtccatttcacctcttggccatttggaagcaatcaaaacaagattggtagaggaggcactgctagagttgaaaagttgtaatagggaaagagggagcgtgagtgagaagcactgtgcagcccctttccgttcacccatcctctctagagagatcctgcaggagattcagcgtctccgcctggaacacgagcaggcctcccagcccacccctgagaaggcacagcagaaccccacgctgctggcagagctgcggctgctgaggtgagtagggacactctaccacttgccacatgtaatctactatggatggaacttatctgaggaaaccaaaggagtggggtagaatctgttgttcagtataaacaatcctgtgagcgcagaccactgaagagttcacccattctgttgctgcttcagatgtctgggttccattagagatcactctaagaatgtcagccattatcacagaacttggtaaataccagtctcccagctccaggaccagcagggcactgtttatacttctgtgattgctttaagaagaccactgtgctgcagtctgtctcttaacttgctaatttgtctgactttagagacacttggcgggaagaatgctttgcctttgctgtgagtatattctcctggcactttacagtcaatgcagggctctgccgaaggagaaggatgcttcctgtgcgcatctctgagacatgaaacccttgcaccatggcttctaaacaaagtgtctcaagaatcaggaaactaaggacataggatgagaatgggaatagagagcagcgtcaccaccatgtttgatggtgttttggagggaatggggaagtcttcacagaagtgatctgatccattgttagggtcttattgcctatgagccttagaaaggggtgtgtgtgtgtgtgtgtgtgtgtgtgtgtgtgtgtacgcactcttctgtaagttaagacattatggaaactacatttagtgacttctcaccagatttctagattttcaaatagtggattctttctgtttaggttgatttttaatttgctatcatctaggattctgtgtagcctcttgtttcttttcccagagaatggagattattgttttctgtagatgttctactgtttagatttatatcatcaataaaagttgtcatagtagagtcataaagaatttaaactgtgcaggtgaaaaaaaatcattagatgtatagagattttcgttctcttaaaaacttattttagtttctcaatgtagttaggctgagatttgggtggctctgtggtttactgctgcaagtctgtggtgttagtacagctggtgtcgtactagggaggatgggaacacaaatgctgctgacttgggcagagtgtaagtctaggctgttggcgtaagatgcacctgttgtctagtgcctggttttatatctagaaaagcaaaaaggcctgtcatcctgagtctaactgttgctgaaactggattgctgaaagtgctcagttaagccggaaggatctgaaaaatatcttagatgtagtagcagggctgagtccaggaatgtcacataggatagcaagaagcagaaatgtaaatctgagaccaatgagggtctgaagttggagtaatcagaaagtatttaacctcaaaagcagttcctatatcactgaagaaaggagggactattttaaagtgtgctgggacagttttctatgcctatgtacaaaacatactggtcttctacttcacactaattacaaaaaccgacaccagatggattcaacatgaatacagaactttaaaacttctagaagactcgggaggctgaggcaggagaattgcttgaacctgggaggcggaggttgcggtgagccaagatcatgccattgcactccagcctgggcaacaagagcaaaactccatctcaaaaaaaaaaaaattctagaagaaagtaggagaatgtcctcaggattttggaatagaaagtagtatctcagaattaccatgaaagaagaagttggtaaatccatttatattaatattaagaacttttgcttatcaaaagacacataaagggctggattcacttgtaggtatctgacatctgtctggttttgatcagtatatatgaggccagggactgccagcacccagctagtataataaaacaaggtagacaacttcacccatagggtgagtggctatgagccttgaccaccagggatgccttttcttcctttattattatttttaatggtacgttgcttacaataaaatgtatgacgaatgtgtgtgcgacaaacgtatatgaagcgtaatagtcaaatgaatacttataaacccacatcctatttgagaactcataatatgactaaaacaatgccatccatagaagtacctctcccttaccccatttccttgcctccaccttccccactgggtgaacgcctatccagaatttggtttatcattaccttgtgtttaaaacaatattgtcgcattatcactatcctatgtaataagctgtttagttttgctttttgttttctaagcttaatagaaatattatactaatatggtggggatagtcccagaggacttccctctccaccccctacccccaccatattagcctttaggatcgttctctgtggttggatgtagctgtagctcattcatgttcagcttataccgtaattgtttggtcacacacagtacagataaagaatatcacacccaggctcaggagttcagaggaagaagtcttcctagaacattgaatgagtagatccttcttatcgagggtctactgcactggaaatgtagagagtatgaagactagaagacaatgagtccttcctaaaaacttataatctggttttggaacaaaacataaaataatttgatagttaaaaaatattgtgcaatgtcaataaacagtatggataagaaatctgtgtagggaaatatatataatataatgtatgtatacacacaagattttacatatataatacctatataatataggtattatatctatatttattccctaccacctttgtgtgtctaattttcctctggaagcatttggaaccatggaggtggtagaagttgagctagaccatgaaaagtagataatgatttggatggagtgtaggacaaaacatttcagattggaagtgcacttggggttcagcatgattccccccaaataattatggcacatttcagaaaagggaaagagtcttggaactaagaatttcttttcaatcattcattacatcaatcttcagagtgccagtgataggagatataattagccaggcaattgagatcagattctagaaagtcttaattgttaggtcattggaaacccttggagagtttcaaatcatgattttggtaagttcagtagatgttaattaggtgatactggatgcatgatattttcttaatccttcaatacatgcaaggatgagtaaggcccatcccctgacctcaaggattttgcatcatggtaggaatggcagcagtaaagtaaattaagtaccactgaggagcactaattactgtagtgcttaatcaagcagtccctgctgaagtgatcaggagcagcttcccgacagtgatgttgggtcagacattacggaatgaataagatttggaagagaggtgagttataaaatgatggagcccacttaggaaaaatgaaccgtaagctggaggtccagacacaaagggcataagataggaggtgtggtactaaggacaggaatgtagatgggatctagagccgcactcgccgatagaaatgcaggccacgcacataatcaaaacatttctaacagcctcattgaaaaaccaaaaagtaataggcgtcattaattttaatagtatatcttacttaacctgatattttcaaaatattgtcctttcaacatgtaatcagtattaaaacatgatccagatactttgctgtttcctgcactaagtctttgaattccagtgtgtatgttacaattgccgtgcatctcagttcagcctagccctgtttcaggggctcggtagtcacgcgtggctagcggctgctgtgatagacagcgtaggtctcgattgcacaggcaagggtcagtgatgctagaaagtctgttgagatcattatgggatgatgaaatgaacatagctttgttttgagcggcagtttaaagttcgtagaacactctcatatttattaccttatatgatcctcagaatattgttgctgttactagtccccttttagaagagagaaaactgaggctaagtgacttgtctaaggttgcatatttggtaaatactggtgctgatactcaactttgaggccattgacttctatttcactgctttttcctcaccataaaagatgaaagagccaggtgcggtggctcacgactgtaatcccagcactttgggaggctgaggcaggtggatcacttgaggtcaggagttcgagaccagcctggccaacatggtgaaactccatctctactaaaaatacaaaaattaactgggcatggtggcgatgcctgtaatcccagctatttaggaggctgaggcaggagaatcacttgaactggggaagcggaggttgcagttgagacaagatggcaccactgcactccagcctgggcgacagagtgagactccgtcacaaaaaaaaaaaaaaagaaagcaggattaatcacataaggagactgtttcatgcttgaggtaaggagtgcttagataaagtgagagaaatgggaatagaaagataggcacatacattttccaagaaagaatgatctgaattgagttattgattgaatacaggatataaagaagaaagtaacaaagaggactgagtttttcaaccatgacacctggaaggaaaaatagcagagacagggaaaagagacagagacaaggaaaaaaaaagagacagagacaagaaaaccatttagggaataaagtcttaagtctggttttggacatattgagctggagtagatggcataaaatctatcctcaaggaaaagtgactgttcttgaacacagggagccgtcctgatctgtcatccttcttgaatctgtctagtgctgaaagtacttactactggaccctgttttctctgagcagtttaatatggtttctttactattaatctaaatttgggctaattttatatatttttcaaaaggcattgattttctaaagagttttttaatcattaattcactctggtaatataagtaatacctttatatagtcatctaaactttccaaagcacttttacctattattctcagaacagtccaggaagtaggcaaaacagacattatcaccattttatgaggtattggatgctaaatgacttgctcagcgtctcataactggtaagtagcaggatcaggtctgaaatccatttcacctggccttagatccatctttgagggtctctttatctgataggcttctcgtcttggataggcaaaggaaggatgaactggagcagaggatgtcggccctgcaggagagcaggcgggagctgatggtccagctggaagagctgatgaagttgctgaaggtaagagcccgtggcccacgctcagttcttgtcattcttctcccaccacagcctcagctgctgcctccctgtgatgtcagaataggatgaggccaaaggcttgactttagcctagaatcagttttcagataaatttagcctaattgggtataaaagtcatctaaattagtgcaaagccagattattaaaaaattagtaactggaaataggataatgtctcgagcagttgcttttatgaataaataagaatgtttataaataggatattagctatgtaaaaatgaataatatttctcaactacttaaagtagtgtgtgtgtgtgtgtgtgtgtgtgtgtgtgtgtgtgtgttttgagatggagtctcgctgtgtcacccaggctggagtgcagtggcacaatgtatggctcactggagcctccgcctcccaggttcaagtgattatcctgcctcaacatccagagaaggtgggattccaggcgcccatccaccacggcccaggttaatttttttgtatttttggtagagatggggttttgccatgttggccaggctggtctcaaactcctgacctcaggtgatccacccacttcagcctcccaaattgctgggattacaggcatgagccattgctcctggccttaaagtttctgttaagacaagttttcaaatattccacttaaatacttaacaaatattaagtgtcctatttcaataagtagtacagagacaactgtattagggttctgcagaaaaattggaccagtagaatgtatataaagatatctaagaggggatttattatggaaattgtctcacacagtcatggaggtaaaggagtctcatgttaatgccatctgcatcctggagaaccaagaaagctggtggtgtaattcagtctgtctctgaagggttgagaaccaggagaactgacggtgtgattccgaatctgggaggtgggttgggagatgggtggtgttgggttgctggtttaagtcccagagtccaaaggcccaagaacctggggagctcacatgtctgagggcattgactattcacaacagtcaaacattggaactaatccaaatgatcatcagcagtagaatggattatgaagttatagcctatttataccatgaaattgtataataattaaattgtacaaactagagctacacccaagcgatttcttctatccaagtcctcagtggattggatgatgctgctcatgttggtgaaggcagatcttttttcagtctaatgattcaaatgccaatctcttttggaaacaccctcacagacacacccagaaattatgttttaccagctatctgactatcctttaatctggtaaagttgacacataaaaataaccatcacacaaaccaacctaattaaaccattctaatcagtaacttcactatattaagagtaagatagcatattagctgtaggtttgggatactggggaactaaatacatgcataataagtcaggtctatcttgtggcgtgatcatagctcactgtaaccttgcttgagctgggtccaagggatcctccttcctcagcctcctgagtggctaggactacaggcatatgaagtctatctattgttgttgaaagttatattacaacccctgtacccctgagcaaagaaaggcatggttggcatttgaatgccctccccctggacaattttattggcatcgaacagaaatatctacctggttacatagcagcaataccaggatacttgctcctgctattactttctcaggtcctgcccagcgatgctgagaactccctgcattttgtagtatgatatcgagttaacagccagagaaaatcacaaagtgtggagtgcccccaaagccagatgacaggagtgaatttaatcttgtgataaagtggagtcattggaggttttaaaaataacagtttaggaaaatgcgcagggcaagttagagtgggaagaaactaaaggataataggagactaatttcatcctccaggcccgaagtgacaaggatcttaaccccaggagtggtagcccaggagaatatcagtttagagactttctccaacttctgcattctaagtcagtctcttagtaatgaagctagtgggcattagcaacttggataaatgtagcatttgtgttttaaactgaattttgacttgctcaagacaattactgttttgttatgagctgagttgttggtggtgttggtggtggtggtggttgttgttttttccccctagctttggccctgagtatttgggttgttttgcatagatatgtttctacattaaccctgttagcaggatttttcctcagaaatattttatgtctaaatgggtcttatttaaagaaaatcttatgtaaaaatgtggcctaaatccctcttaatagttgtcagatacccagctaagcaacctagcccctcatctaaacagcagggatgtacttaaacatacatggcctgtgtaacatctgcagcctcgtggggctttaaaagccctgctgccatggagttagtacacctgtgggatgggagataatagggtatccagtcgggcgcagtggctaacacctgtaataccagcactttgggaggccaagatgggtggatcacttgaggccaggagttcagcctggctgacatggcaaaaccccatctctactaaaaacacaaaaattagccgggcacggtggcacgtgcctgtaatcccagctactcaggaggctgaggtgggaggatcgcttaagcccaggaggtggaggctgcagtgagcagagattacaccactgcactccagccagggtcagagagtaagactcagtctcaaaaaaaaaaaaaataggggatccactcacctcttccctgtgtcacatctcccttttcagaaagatgttctcaaatattacccaagcatagatgggaaagtcccagtgccccagtgtgatttttgtaaaaggcaaaaggtttatgtaaactgcagggaagccagagtgtatctcccctaagtaaccttgtaccattgcctttcagttggattgtcttagtgatccccagaactactgaccccaagccccatgcatgccactgtggccttctagtgtaccgctgatgcttgtattcaagggctaagcagaacgagctaatgcccgcaactctgatcccaaaccctgagtttctttatatttgcagcagtaatttcagaaaaataagcaggacactgctgcccctgtaggatcccctgccaggttcttaaatatcatttacccgtctgacaggctaaggctgttcagactgggaggaagaatttgcaaacacaaatctaggaatgttgcctttctatccattggctagaattcacagtcgaaaatctcatgcctttagtgtccagcttcctaaaagaattaccacgtaatcttaatttttgtattatatgcatacctgaaaggtcatacacaggaattactgacttctgttaaaatttcagtgttttcctactattagaaatatatattcatcaacccataaaagtaccctttagaatcctaattttaggccaggtacagtgactcacacctgcaatcccagcactttggaaggccaaggtgggtggatcacctgaggtcaggagtttgagaccagcctggccaaagtggtgaagccccatctctaccaaaaatacaaaagttacctgagcgtggtggtgcgcgcctgtaatcccagctacttgggaggctgagacaggagaatcgcttgaacccaggaggtggaggttgcagtgagccgagatcacaccactgcaccccagcctgggcaacagagcaagaaaaaaaaaaaagaaaagaaaatcctaattttaatttaaaaggggttgtctgcttttattgatgttcagtatgctagcatttaattctctcataaaatagtcggaagcagttagtcagatggacaatcaagccacatggtctgagatactcataaattaaaatacatctcacagtaaattttcatgccacagagagttctttcattctgctgcttcaggaaactattatgtactttatcttctatctgaaatgataatttaaagaagcatacataagaagtgacatcactgttaattcattcaacaaaaatcttaatccttttttggaataaagcagggttaaaattaatttttttgtttctttaacaaaaatctattgagttcctaagtgtcacattagttatttggcatatcatggtgactagactcaatccctgatcaatcaaggagtatcaaggaccctccttctttgtttttttgtttttttgtctgagatggagtctcactctgttgcccaggctggggtgcagtggcacaatcttggctccctgcaacctctgcctcccggattcaagtgagtctcctgcctcctgcctcagtctcctgagtagttgggattacaggcacccgccaccacaaccagctgatttttgtatttttagtagacgggtttcaccatgttggccaggctggtctcgaactcctgagctcaggtgatccacccaccttggtctcccaaagtgctgggattacaggcgtgagccaccctttattctttttaatgacataatgtagactgacactcaggcattcatgtttctctacatatctttcccttatactttttacctgattaatgagtattaattaattactgacctcaaaaaaacttcctatttaatctagaagtgtttatgtgttggtgtttctaatccatgttctacttcattttccatttgtctgatattgcttttgaaactcattttaccaggccaggcgtggtggctcatgcctataatcccaacactttgggaggccgaggcaggtggatcacctgaggtcaagaccagcctggccaatatggtgaaatcccacctctactaaaaatacaaaaattagccagatgtggtggtgcatgcctataatcccaggtactcaggaggctgaggcaggggaatcacttgaacccaggaggcggaggtcacactgagccgagatcgcgccattgcactccagcctgggcgacacagtgagactccatctcaaaaaaaaaaaaaaaaaaaaaaaaagaagagaaaaggaaactcatttacatttaccagatgaattctgcagttttgaatttcaacctcatttgcaaatgcttatctagtttgagtgtaaatttttatgtaaatgactacagtggctatgtcattgctttggccaccttgccagacctcattcatgtggaagagactcacatgtttttaggtgacataagcagttctaagtttacactttataattaaggtattacccccttttaaatcacgttggctctatcccttgtcatcagtcaatatttagtgaccccacctgactagttgataacacagaggttctcagacctgggatctgacctgtttactgtgttgacagagccttaagggctttatctgaataagttttgtgagtttaaattatacaacactatcctaaataacactttgccaaagtccattctctccccagtaccaggccacatggaaggcctgtaagtcctggaagcgctgccctgcccactgtccccagcctaacctgatatatctactgcaaattacggtttctcttctgacaaacttaaattgcaatcaccagatgtccaagtatgaaacattgctttctgaatttccctattctgttgagccacagcagtgttctctttaataccaaacctggagaaaactgtggaagtagggagatgtcttagaaacagttctaagaaattacatactggtcttttgacctcggatacaatttcagcctgttaggattgccccatccctccccaaccatcgcactttccacttcaacacagtgccagcaatgaaaacacattttataattgtttaataactgtcctatgactgtttgccttgcctcaagaatataagaaaagtgtcctgccccaaagggaagtctggcaaggaagagagcttgcttcctaactgcaaagcaggtgcaaaagcagaagcgctctaattccttcccgctgccagagccagtgttcagcgctctgtgcctaggctcctgtgagtttggctttggtcaggcatccagcatctggctttgattgtgaagagcaccttcccatgctgagttgggagtctccttaagagatttctcggtgcccatttatttctagtccctgtctgtcccttgcagtaataaaaattatgttctccaagtgtttactcaccctctccctttcgtaattcctttgctttactgaggtctttctcaccattgcacccaggtctgtagactgtgtgggagcaggagcacttacccattcctgagacttcctaggcacgtacatgttcagtaaagactggctgcatgaattgttccaatttaaatagaaccattgcacagcttttagatttacatactaggccaaagagctgagtctccctgaccacagtgacccatggtgaggcacagaaggaggaagtggaagaggcccattaaaagacagagtagatgagtagcaaagaactgaagaaagagaaacttgaaagtgttctctttatcctttttcctgcagtgtctgatagtgcattcatttgggcagtcagctaatagccagcaagtgcctgctctgtgttccatcaccataaggttctaaaagacagagaccggccaggtgcagtggctcacacctgtaatcccaacactttgggaggccaaggtaggcggatcacctgaggtcaggagttagagaccagcctgaccaacatggtgaaaccccatctctactaaaaatacaaaattagccgggcatggtgacacatgcctgtaatcccagctactccagaggtggaggttgcagtgagcccatatcgcaccattgcactccatcctgggcaacaagagcgaaactctgtcgatagacagacagatagatagatagatagatagatagatagatagatagatagatagatagatagattgatttagatgacagagaccatttctttgtttccagtgctttctgcataagaggactaaataaacctgtattgaattaatgaaaaactgaggtcaagaattcttttttgaatgacctttcagggtctccaaacagtttccagtttactgggggaagttgtgtatgtatgggactcactgaaaaaaaaaaaaaaaaaaaaaaaaaagactgtgcctgaaagcaagtagacggggatacagttccaacatgtttagtgtggagaggggaccaaataagaaaagaacctgtagtgggcagaattgctagttgggaagtgatgagggcagtgggtctcagacttgtatgcaccagaatcagagacaagattgaacgcattgctgtggcccacccctagagcttcggtttggtggggatagggtgaggcacaaagtttacatctctgacaagttcccaggtgatgccgatgctgctggtctgtgttccatgcatcaaaaaccacttgcctcgataaatgtacctaaacacatgtgaatatcgtgaatgatgaatatagaattattattacaatttcaagtcatggttgcacttcctctttcagattcccctaaatagctatgtgaaccttaggcaggtcaggccctctaggcctgtttgatctatagtaagaatgttggcgaggtggtttctaaggttctttccttctagctctaggagttagcattgaatcactcaccgggccgaggcctgctgcttgcttcgtcctctgatgctcctgtgggggatggggcctttgatctcagcacctgtgggcctggcctggtttgcctgatttttctatcatttctgaccaatgtttgtggtgatgggcattaatgggcattaatttctctccttttttcctctgcctttttttttcatcttcaacactccaggaggaagagcaaaagcaggcagtaagtgaacttcggaatttcccgccggactctcgctcctttgcacgttcttcctttcctcatataaatgtttctcctcttctccccgcacatcatctctgaagagggttttatgtgtaaaacccccagcggttctccccatggtgttgtaaaatggcctaaaagttcaaggcatgtttacccagtagagcatgttcttacttaaaaccagagcttgtaagtacccatctgttgtgcgcattgaagtgtgcatgattagccaggctaccattgcattttcctgctctttcattctctgttgttgtgtgtctggagtgattttaattgcttgaaacaactttcagggtgctggggtgacctcatgtcatgaatgaatgtgcatgaaaatgaggacttcttttgctaactatagatgtcctgcagtctcgactaggcttctggatgctggggctgtgccagcctccttaacaaaattactgacgacgactgagacactgactccacttgcaatgatttcctgttcagaacctactccagacggagctcgggtttttctgagctgtgtggctattgcatggtgtttgggggaggtttatgtttgtttctgtttatcctgatagccactgacccacacaagaaagtcaattgcaggcttatctacaatattagcaccatatgtttatataacatagtaagatttcaaagcatacattttttaagctgaagctgagttttcgtttaccttggagcttttttatcctttgggagataaatacaaaacgtttaatttttaaaatttgccttttttttttttttgagacggtgtctcgctctgtctcccaggccagagtacagtggcatgatctcggctcactgcaacctccgcctcccaagttcaagtaattctcctgcctcagcctcctgagtagctgggactacagtcacgcaccaccacacccagctaatttttgtatttttagtagagacagggtttcaccatattggccaggctggtctcgaactcctgacctcatgatccgcctgcctcagcctcccaaagtgctgggattacaggcgtgagccaccacgcccagcctacccatttttttaaaaaacacaaatgtatacatgttttaggttaggaatataaaacattatacttataatttctagctaggagagcaatgggaccatagagtaaaggcgagaggaaaggaaagaagagatcagtagtgaggggaggaggtgagaagagggtacggaggagacagactgtcagggggaaagaagatggcacatggcatcaagagtggccgacaacccagaaatctgatggctttcgtggaaccaaagtgcacttgttttggtttttcctaggtttggttttgcttttttctttattcacacagagtttattgcttccatctctggcgtttctgcatcagtaggtacacttacatgggcaaagctgaacaggatgcaaatcaagcccagccattacatgcttcttccaggaagtgacacgcatcacttcctctccatttcattggccagagcaaatcacatgaccacacttcacctcaagggggctgggaagtctaatcctccagtttatctagaagtcccagagaagcagatgttggaaatacctcccccaagtagacaaatgagtgagactgttggagggagaggaaggagactacttatccttccagctcctgatggtctcatccccttgttatgaagtattcccttcctgatgatccagggtgtcacttcacctgttgttgctgaccactagcatcccctccttctcttcagccctccataccccagagatgcactttgcagctgcagctacttgctgcaaacctacttccaacagtctgcccagactaacagcatcttctgatctctctctgcgtgtgccagctccaagtgagcacagactggaaacacccgacacctcacctgaaaactctttcagaagagggcaggcattgtggatattggtcttagtcgtagcagtagagcttccagtagacatttaatttttaaaatttttatggattaccatgtaatccaagaaacaggaattgccactgctgtgatattagttctcaggtcaatttaaagctagccttgagcagacaggggattaaataacgtgtccatttcagtgacctttcattctgtgtgagatcaccatccccttgaagttggcaaaatgagaacctagactgctgaagcctgcctctaatgagccactgtaggtatatcttgggagttctccatggccagggacctgagctcatgtccaagtccttacagtcttataggactgtccatagcgtgaattggtacaatttgttttttcctcagctttccccaccatggtatgaggtaagaagtgctgctctgttgacttagatagaaatatccttctgtccacttcacaggtttaaactggacccatgtaagttcagctctgaggctcaaatttggactgaatgactttacgtaattcaatgtttttcagatgtacaactgaagagactataaagctttagaactagcttctgtttaatccccaccattattgagtgacaggccaaaacataggcgtatttaacacagaactatgatataaccctaacccaaccacccttccttccttccttccttccttccttccttccttccttccttcgttccttccttccttccttccaggttctggctggtgtagtttaatttctttcctatcaaaatgtcttaccctaaatgggtaagaaaataattgtataacttgttagcttgcaggtagggaaaatttttttcttttttctgagacagagtcttgctctgtcacccaggctggagtacagtggtgcgaccttggctcactgcaacctccgcctcctgggttcaggtgattctcttgccttagcctcccgagtagctagtattacaggcgcccacactgggctaatttttgtatttttagtagagatggggttttgccatgttgtccacactggtctcggactcctgacctcagttgatccgcccgcattggcctcccaaagtgttgggattacaggcgtgagccatcacgcccggccaaaattttaaaaagaaaagaattgtaaaacacttttaaaatgaagagtttattagatgtgcttcccaaaactggctctgtaaatccattatagagaacttttgatagtgtccaccttcttgcttcattccccttagggatttactgcttactactaccaggatctctttctacccagataacactctgacaccaaatgtgtaggtttcttacaccaaaaaattcagttctctgcagacaccagctgggtgtcctacgatttaattcaattctgacactacctggagttagggcagagcccacaggttaagggctctgtcccacaggagtgcctcacacttcagacaccaatcacaagtagtggttcttcagattacccacacttctgtccaacttggctacaaatcagggctcccacaaccccttcctcaggctcaataatttgctgtaatggttcatgaaactctgagaagcactttactcactattactagtgattttaaaggttattataagggcacaggtgaccatccaaggtgacgatgtacatagggcaagttccagaagggtccaggagcttcagtccccatggagttggggtatataccacctcctggcatatagacatgctcaccaaccggaagctctctgaacccctcagttagggtctttatgggggttccattatgtatgcatgattgattcattcattggccattggtgattaactcaatctttagcccctctcccctccccaaggcctggtggaaggggctgaaactttcaaccctctaataatgccgtggtctttctggcaaccagtccccatcctgaagctatccaagattcccaaagcccggtcatctcattagcatgcaaaagacacgcatatcactctggagattccacgggttttagaaactctggtccagcctggccaacatagtgaaaccccatctctattaaaaatacaaaaattagccaggcatggtagcatgcacccgtagtcccagctactcgggaggctgaggcaggagaatcgcttgaacctgggaggtggatgttgcagtgagccaagatcacgccactgcactccagcctgagcaacggagcgagactctgtctcaaaaaaaaaaaaaaaaaaaaaagaagctctcatgccaggaacctggaatggagaccaaatatatattggttatatcatagtatcacagggttactttggcatttgggaaacttgagagaaatgggcaataactgttactttaaaagcttgggtgctgtgattctgccttcagcctcagccacttttgtggtgctttgcgtggcatcagtacctccactgattcttctgtctttcctctctctcttcccccctctttcccttctgtttttctcagatctaagggttataatggaggggcaaactgcctggctatttcagataagacttcactgagtgactgttcagcccatgatttaccctgcagtttaacaggctcaggaattaggtcgcatcagttgagcgcgggtcacttaggcctataatcatcatcagacggcaattaaaggaccatttctgcctttttcactattacatcccccgcctgtagcccagcctgccatacagtagatactcaataaatatttgctgaatgataaccaatattaaccaattttataagattttgacttatactctgtatgaattaataattgtattaattataagggacataactagttgacgtacctatagcagtgattttgctcaaggcactcccagatagatccattcaggagatccactcagaaatatcctttatcaaaaagaatctgggccaggcatggtggctcatgcctgtaatcccagcactttgggaggccaaggcaggtgaatcacgaggtcaggagatcgagaccatcctggctaacacggtgaaaccctgtctctactaaaaatacaaaaaattagccgggcgtggttgtgcacctgtagtcccagctactcaggaggctgaggcaggagaatggcgtgaacccaggaggcggagctcacagtgagccgagatcgcaccactgcactccgcacttcagccgacagagcgagactccgtctccaaaaacaaacaaacaaaaaaaaactaccatcagagtgaacaggcaacctacagaatgggagaaaatttttgcaatctactcatctgacaaagggctaatatccagaatctacaaagaactcaaacaaatttacaggaaaaaaaataaccccatcaaaaagtgggcaaaggatctgaacagacacttctctaaagaagacatttatgcagccaacagatacatgaaaaaatgctcgtcatcactggccatcagagaaatgcaaatcaaaaccacaatgagataccatctcacaccagttagaatgggcgatcattaaaaagtcaggaaacaacaggtgctggagaggatgtggagaaataggaacacttttacactgttggtgggactgtaaactagttcaaccattgtggaagacggtgtggcaattcctcaaggatctataactagaaataccatttgacccagccatcccattactgggtatatacccaaaggattataaatcatgctgctataaagacacatgcacacgtatgtgtgttgtggcaatattcacaatagcaaagacttggaaccaacccaaatgtccaaagacttggaaccaacaatgatagactggattaagaaaatgtggcacatatacacgatggaatactatgcagccataaaaaaggatgggtttgtgtcctttgtagggacatggatgaagctggaaaccgtcattctcagcaaactatcgcaagaacaaaaaaccaaacaccgcatgttctcactcataggtgggaattgaacagtgagaacacttggacacaggaaggggaacatcacacaccggggcctgtcgtggggtggggggaggggggagggatagcattaggagatacacctaatgtaaatgacgagttagtgggtgcagcacaccaacatggcagatgtatacatatgtaacaaacctgcacgttgtgcacatgtaccctagaacttaaagtattaaaaaaaaaaggtgtctgatttcccaagaaagcaaataatgaaaataatttttttaaaaaggaatctgaaaaaaatttgttaccaaaaaaatacaaacaccaagctgattagtattattattaattattaatgttgttatttctagctaaagaaaatatactgatacatggcataaaaatcaccttgtcttttaaagataataatctataaaatgcaggatatctatagttatttgcatcgtttgaaaatattttaaatattgctcagtaaaagcccagtgcttacagtcagaaatacggttgtaggattcatcagcatgttacagagggacactagggtcaccagagactgatgaagtccctactggcaatggtgtttatgaccattggtgcatttgagctatgggcctctctggcctcaatcaaacaatatcccaatcctagtctggaaacagttcagatgtacaagttcatctaggaacattttagggttccatttttcccagtgactcagtgcaccataaaatttcactgctggatctctaataccacattcactgagctatccaaggaaaggggttctgtttattcatgaaggatttgtttcctccaacatttatctgatctctcctattagaagttaattatctaataatgatcatctggcttaaagacttaaaaagactttatatatgtttaatagaacattttatataatgatcatcaggcttaaagactgtaactttagacagtaaaagttatgtaaggataggaagctccttcagggtggccttggcccagcttaggtagtggggcagtgggccaaaggataatatacctggcactctgaaaataatgtgattagtggaatcttggggaattggccaagagaactttgccacacttgggacctttccttttacttcagtgagtttggctatcacgtgggatcttgccatcatgccctatctgatttccaagacccagacaaatacccacctacagctataccaaagagagcatggtttggcctggctccaggaagcccccctttctgatcacagctctaccaaatatacctcaaaggaagggcacttaatgtttagttagcaatggtcgacccacaagggctcacataaacctcatgaatactaactttgtaagtttaagagaaagtactttcagaaaaacaaacctatgcaacaagaaaaagaaacctcctctttggccattaaagagattgttggtgaaccccttgatgttagcatgcctcatgggtcacgttcccttcttagcctttggatacagtctcactgggaagcgattcagattcacatgcttctgcaatcttctgggctccgtggctcttaatcttccgaaatagaagcctgagtctacttcccaaaaggcaaaggattgccattcatttatttatttagcggtgttttactatatatgttcaagacagtgagcctggccttttggaggataaaaagagaaatcgtacacaaataccaccatcaaatagtctgaaagttatttcatggttgacatgataccctaaatgcagaaacacaagccgggccagtggtatcccgggcctcaggcaccactgcggccctcctaagttggcaaatggtacagatgtctgttggtaaatgaggatcgctgtgctatacgtaggactctcccacaaacctttatcctgggtcgcagtcccaggatatgtgcatagactgtctgctactgctggctccctcccacacatggccttgcaagagttggcagggtgtattcatcggtcttggcacctgtactcaccgtagggacctggcagtttgttgttattttttttccaaaaagaggaaatatcactataatactaaaaataggtttggtttttcttttcttttttttttttgaaacggagtttcactcttcttgcctagtctggagtacaatggcatgatctcagctcactgcaacctctgcatcccgggttcaagtgactctcctgcctcagcctaccaagtagctgggattacaggcgcacgccaccacgcccagctaatctttgtatttttagtagagatggggttttgccatgttggccaggctggtctcaaactcctgacctcaggtgatctgcctgcctcgacctcccaaagtgctggggttacagccatgagccaccgcgcccagctatggtttttctttatggttaagtataagtctatttgagcccaaagcttgaggatggccccccaggagcaaagattcaaattgccctgaatatacattctgattagcagcagttacagtgggtttaaaaaaaaaaaaaaaaaagaaaaggcagttcctaagttgtttaccaagaacttacattaaagtaacataagcagggcatgtgttctcaggatctcctgagggttgtgtcacaggccagatacgttttaaaaaaataataacataagctattgattatctatacattgttctttttatcgcacattccaggaacatgaagctaatgagtgaagcagctagtcagtaacaaaatgcctttaaaccattgcccccccgcctcgtcatggcagggtggcgtgactgaagccccatacctgtgtctctggggacctgataaagtttgaatacctcatataattcagacttccccgagttatttttgttctcatttcccctcttttcatcaagatccttctgggaaagcatcatagatgaacaaaaatggttttggtttcttttatgttcaggaacttactcttgcatacccagaaggttcatttccagatggtcctgtcttgcgtggtggggatgggggatgggtgtttgtatttcactcccccaaaactccctgagcacctaacaagagtccgaggatacaagagaaaagtagctttggggtgtgtgccacaccccccaatatttttcatcactcatcaatgtcaggctgagagatttccttacctacttcctaaatttccctcctgtactatatttctgtcttttcctctcctgaccagaatgcacacagcatatgaaaaccatccttcagggcctccaaaaacattatctcctcagccaactggagaaattcttccactggaagaatattgaattcctaggacacactgcctcccccagaatactacagactgaatctcagcaaagcattaacagaaaaggatgaagaaaaaatgatttgtaggcttggagcctaagaatctagggaaatgatgggtgtcatttactgaacaagtgaaaatagagacatgatctgggttaggaggggactttgatctgattttggacatgctattatgtcccatagccaggcagtcaagcaaaaagacctgctaggtatttggacatgcgcaactgaaatttcaatgggaaaacagggctagcaatgtagacttggaacccttcaacacaaaatgaggattgaaaccataaacgtgagccttagggaaaacccacagtagacaaaaagaagaaaaaggaggcaggagaaggaccgtcggttctcttggaagcccagatagttgcaagaaggaggaagttagtgagacaataagacaaggaagcccatgaatttgacaataaggaagttatcagcaacttaggaaagaaaatgttcaatagagtagtaaagtgtacccaactctgaaaagtgggctttgtcctgtccaacctcctcagcaccacctcctgtcaaataatgtcactccactgaacaaagatgtaaatcttaaatctgtgaattacacatgaatggactgcccttctcactaatcgagtcttgccagctaaatcccatttctttttcatctaaacaagcacgtaacctttacaaacctcattttcctcatcagtaaacttccagctccacagtttttggatcctttcatcattgtaccagttggtactctggagaaaggctataaacctagaagggtctatagagatctatttgggtcctggcctatagaggaatgaatgagtgaatgaatgaatgaatgaatgaatgaaatccagttgggtttatttcactgatttctcctttcctgactttgaaatcctgtggcccttacttcattgtctgggttttctttcaataacttcttccccagggtttattcatgccagcctcccacctgccacttttccagacagaagaaaatatcctaagaaaacatcagctgcatccctgatgcccttctcctgtggctcacctgcgtgattcttggccatgtctccagcaggacaggtttccctggcattcttcctctctgttgtgcctcacctcagcatcttctttcagcatgggattgtttccataacttcactctgagagcatctggaggcatttcgtcaaatcatgaagctgtaccagtctctagggtaacaggttttatagctgaccctcaggttggttctgatgttccatagtaacgatagtgctaaggtttggagcgtccttcatggaaaagaacatctgcttagtttcagctaaaagatgcatgttataacaagttccatagactcttacactcttctccatttactcctaatcatactttggcagtatgcatttggagctgcaatatagatgccctgatgtttaaaaaaagaaaagtagaaggctattttataaaattataggcaatgaagttaactgcagctaaagtggtgctttttttttttttttttttttttttgagatggagtctcactctggtgtccaggctggagtgcagtggtgtgatcttggctcactgcaacctccacctcctgggttccagcgattctcctgcctcagcctcctgagtagctgggactacaggtgcacgtcaccacacccaactaatttttgttggttttttgggggaggtagagatgggatttcattatgttggccaagctggtctcgaactctttttttttttggagacagagtctcgctcttgttgcccaggctggagtgcaatggcacgatctcggctcaccgcagcctccacctcccaggttcaagtaattctcctgcctcagcctcccaagtaactggaattacaggcatgcaccactacacccggctaattttttttgtattttcagtagagacggggtttctctacgttggtcaggctagtctcgaactcctgacctcaggtgatccacccacctcagcctcccaaagtgctgggattacaggtatgagccacagcacctgcccagtctcaaactcttgacttcaagtgatcagcctgcctcagcctcccaaagtgttgctaccgtgcccagtcaagtggtactttgttaaatattttttttattacaacagcttttggggtacaagtggtttttggttacatggatgagtgatttagtggtgaattctgacattttggtgcacccgtcacccaactagtgtacattgcacccaatatgtagttttttatccttcacgcccctcccaacctctcccttctgaggctccatagtccattatatcactctgtgtgtttttacatactcatagcttagctcccacttataagtgagaacacacagcatttggttttctattcttgagctaccccacttagaaaagtagcctccaggtccattcaggttgctgcaaaagatattccattcctttttatagctgagtagtattccatggtgtatatatactaccacgttttctttattcactcattggttgatgggcacttaggttggttctgtatctttgcagttgtgaactgggctgcagtaaacatatgtgtgcgtgtgtctttttcatataatgacttcttttcctttgggtagatacccggtagtgggattgctggatcaaatggtaggtctacttttggttcttcaaagaatctccatcctattttccatagtggttgtactaatttactttcccaccagcagtgtataagcattcccttttcaccacatccatgccaaagtatattgtttttggatatttcaataatgacgattcttgcaggggtaaggtggtatctcattgtggttttgatttgcatttccctgatggttagtgatgttgagcattttttcatatgtttgttggccatttgtatatcttcttttgagaaatgtcatgtcatttgctaaagtggcacttttattataataaggatccatgccagctcaccagctctgcacagatggctaaccataaacccttcagtacttttattattatgtattattaatttaaatgtatatataattttctgttaattgctttcacattggaaatttcaactccaatttttaacctgctcagacctcagaaaatcaagagagattctaggagactctcagatctgtagccaccccaggacatcccaagtgtgcagaagatacggcagtctattcttgggccctttgaaggtctaactaacctgaggatgctggctgcctacccttctttccacagcagctcaccacccaggaaaatagccctgggcagaccatcctctgtaggacctcatgactaagtcaccctcagccatccttctcattctcagcattagtgacattcggggccagttaactctctttttgcaagtagttgttgtatgtgttatagaaaaacatatgtgtttttttggtagagatgggatttcactatgttggccaatgttggccaagctggtctcgaatttttttttttttttttgagacggagtttcactcttgtttcccaggctggagtgcaatggcacgatctcggctcaccgcaacctccgcctcccaggttcaagcgattctcctgcctcagcctcccaagcagctggaattacaggcatgcaccaccacacctggctaattttttttgtatttttagtagagacagggtttctccatgttggtcaggctgttaaggatgtttagcagcatccttaactttacccactaagcaccagtagtagcctctactctcagggccctagcaggtaaaattgcccccttgttaattggaagccctgctctgagtccagagaacctttccctgtgatacaaatatgcgcctccacggcattctcagaaccccttattctgaggtttggctatcggaagggtgggccccacagatccctcctctgcacgtatttcctgcttctgctgatgccgttatcagcacccaccatatccctgccagccatcgccagcctcctgctcttccctctcagttgccaacttcaagtccattttttctcccaaaagttgctctccctctttctattcctataccccattccagcctccattatctgtcaccgggttttggaaaagccactttattgatagaacccctgtctcctgtctctcgtttctcagtccctctgtgccattgcccagagcttgattcctgagcacagaccagactggccacatccctcccctccttagaaaccttcaccggctcctcttgcctttgcctgtagcaggagtcagcaggcattttcttaaaagattagacagtaaatatttcaggctttccaggccaaaccagatattatgtaggtactatataaccatttaaaatgtaaccattaaaaaatgtaaaaatcattcttggctcatggtctgttgaaaaaaaaaacaacaacaaaacaaaaagcaaaactggtggtggaaaaaaaatagaacattttatttatttatttatttagagatggagtcttgttctgtcacccagggtggagtgcagtggcacaatcttggctctctacaacctccgtttcccagttcaagtgattctcctgcctcagccccccgagtagctgggattacaggtgcccgcagccacaaccagctaatttttgtatttttagtagagacggggtttcaccatgttggtcaggctggtcttgaactcctgacctcaagtgatctgcccgcctcagcctcccaaagtgccagaattacaggcgtgagccaccacaccccgccagaacattttatttttaatggtggttagtcgggccaggcatggtagctcacgcctataatcccagcactttgagaagccgaggcagatggatcacttgagcccaggcatttgaaatcagcctgggcaacatggcaaaatttcatctctacaaaaaatacagtaattagccaggcatggtgtcagctacccaggaggctgaggtgggaggattacttgagcccaggaggtcaaggctgtggtgagccatgatcttgccactgcactccagcctgagtgcactccagacagagcaaaactcttgtctcaaaaaataagaaacaaaaaaaataataatggtggcgagttggattttccacgggttgtgtagttttcctatctgtggcctattattttttagtttttgagacagagtttcactcttgtcacccaggctggagtgcaatggcacgatctcggctcactgcaacctctgtctcccaggttcaagcgattctcctgcctcagcctcccgagtagctgggattacagtcgcgtgccaccacgcctggctaatttttgtatttttagtagagatggggtttcaccatgttggccaggctggtcttgaactcctgactgcaggtgatccacccacctcagcctcccaaagtgttaggattacaggtgtgacccaccgtgcccagcccttatctgtggcctattaaataaactctgcagctgctcatttacatctctggctgctcaccgccgacacttctcctttcctgctacaggtcttccctgctccccacactccagcttcaccgccccgtctcacccccagtacagcctcctctccagcccagtgcctcagtcatgcactttcccccgcctggtttgcccttcccaagcctcttctgcccattgcagttgtacccgtcgagatactctcagctgccacctcttctaccaaacttaaccctgttccataacgtcaggccaggctgcttttcctctgtttctctgctgtggcacctgttacatcccgtttggtgtgctggttgcatacgtacctgactccctcgggataggcctgctgagagtggagatattgcctcagctgcatagccccctacccctaacacctttcaaagtagaagaacaacaggtgtcactctatggagccaagtgtggggggtgtttcatgatcatcctcaccaacctgtgaggtagatattgttatccccactgtacatatgaagaaccttaggtgcagagaggttaggtaagttgcccaagatcacacagctagtaaatggcagctggaatccaaactaggttcctctaggctgggcacagtggcacacgcctgtactcccagctacaagggaggctgatgtgggaggattgcttgaggccaggagtttaagaccaaccctggcaacatagcaagaccctatctcaaaaaacaaacaaacaaactaggtttatccaactgcaaagcctggactctaaccactatgttacatataacagggacttaacaaagtgcagagtgtcattgttgaataagggtgccatacctcaccacacaaatttggcttacccataagtaacatttaaattagactcatagaattttaaaaccccactgataggtcccagctggcttcctgctaatagatttagctgtctgaataaggaccacatcctcctgagaacctagcctagtttctgtttctagtatgctatctgagtgttcagcattcattgtataggtatttttctcttggttggtgaggtctctcatcattttgcagagaactggctttgaaatcttgcagtgaagactagtgggatacgggccaggcacagtggctcatgcctgtaatcccagcactttaggaggccgaggcaggtggatcacttgaggtcaggagttcgagaccaccctggccaacatggcggaaccccatctctactaaaaatacaaaaattagcggggtgtggtggcgggcgcccgtaatcccagctattctggaggctgaggcacaagaatcgcttgaacccaggaggcggaggttgcagtgagccgagattgcgccactgcgctccagcctgggtgacagagcaagactctgtctcaaaaaaaaagactactgggataccattttcaaatagggctaggcaaactgggagaaacaaacagaaaggaggtaattctagtcttggaatttatgagtttctctatctaaaagtttactttccaattttctttttatctacagatttatcttgagttttaataggttgttctttgtcccagaaatttaatacaccttcttccttctactaagaaagataattgtacaccttgccctcactctttaattcttagcataagctttgtcttctatataatttagtgtaacttgaatagggacagaatcatgaagattgagaaccctaactttctgccattggcaacaccgtgatcacaaatcatccagcagtcctagaatagctgcttcctgtcttaccgcagcttgcctcaccagccatcacagtgagtgacaggttatgcatgagccctgaggtttctgacatgatatggaaacaaacaggtgtcacccctctgcagagagaccccatggcagactttctggtggcctcatccttccaacagacacataataggtaaatgtgtgttagcggtggtgagagacttcataaaactctttagcccctctctccagtgtctagaagccaagttcatctttaaaagactccactttcatgctgaccaagggtgttgaaaaaaatagaaaataagaataaataaaagactccgcagcacttaagcttgcaggtgggcgcctctgctaagcagggaaggtgtccaggcacattcattgcctgcttccttgctcacggccattgggttgcctctctccttcaccctcattctccattctctgagcacttccattgccagtcctaactcccaatagtcttaactcttgtcgtgtgaggcggttatttccaactctcacagcaggacagacagtgcagcatcagatagccccatcacctctccctcgtttcacgtccactttgatgagacagctgcatcttcctagcatggtcaccaccagcaccagctcaaaatagttatgtggggtttttaactttttcttgaagagaaaaatggacaaaggctgttctctacatatcccagttctctatacattcacggttgcctaaatttcagacttgcagcaactctctcccatcattgttttttgtttctctgagagggcctctgaaaatcggcagcaaagagaccactttgtttaatttaaatacacggcagcaaaatgaaggtaattgtccacacaggccatctgctacctggcaggtgtccatgagtcagggagatagaaatggagactaaagtgtcttccattctgttaccatgataacagcttagctccaagttgtagttgcgtgtgcgtgtggagggggatgcagttatgaatgctctgcagagggcattaactcttaaagtcaggccttttgccacaagtctctctggccttgtttacctgactataatgtgtgccaggaggattaaaaattcttccctattccatgaggaaaaagaaagaagggaagtcctatttttggagcccctactaagtgccaggcatcatgctggggccacccaagcatggccaagaacagtgcagtatcattttcctactaaagacactgcctttctctccgtgcagctggtctcctggccagttctctctgccacagcatgtgcgtccctgcctctgtgctcagatgcagagctggtgaaggatccccgtgtcctcagggcaccttctctggcattttctatacctgttttggctccaacaagagattgtttttatacataagagattttcataatccctgtattctcctttctcacatttccttactgggaatgaaattgactgtcccctggaaaatcacggttagtgtcagtcatcagaagtcttgactgatccatgttccttttagtctcagaaacattgtgctgtgatcccaatatgcttagttttccgccagcagtttgaggcaattagcagacccagggaccagtcctagcctgtctactgattttgtgtgtgaccttgtgacctctcttgacctcagcctcctcaaatgaaaaatgaatgttggactaaaacaagctagtttgctggggtcatgaaccctctgattttgtaatttctgaacacttttcttggaacatgatgcagagctttctcgggttctcagggtctttgctgatttgaaaatgaagagccagcagtctagagagcttatcagattgtaatgtttcactggctctacatttgcaacagaattgtttccaactgttatacaagggacctctgtattgagagaacctgagtcacagggcatttattgtgtttagttattggttagacccatgattggcctgtgctggactcaagcctttgttacagcttgtactacaacaagattccactccttatatcaggaaaccttaaaacactgagtagcacattgcagagcttcccttgcttctccaggcgaattgccctctcctggcagctgaaacccagaggcacaagagtcttttgtgcctatcattggacaacatatccccatccttggagccacctgactagttgctctacctttgcagatttctaggtgtttctcaggtttcctgtaatctcagggtgccaactgtgatgcctccccctccccaagtctcccactgtgccgcgtattctagactggttcgcgttgagcggagtgttcagcagtctccatggagaagggcctgcctctctgaacataaagcccatctgtgcttttgagacgaggtgcatttgcacagtgcggtgctccatcttgatttttagtgtgttctgtctggcctgtgcctatcaagtaaacagaaggaacaaactccagccagattcagaggtgattgtcagcatgtcaggaatgttgctgtgcacagaaggtttctcagactgcatgtgcgccacacactccagtttgtacttatttagttagaaggaccttatttcagactctttcctgagatagttccatcttatacagagtatcctgctccctacacctcctcatcagcatcatctgtacaaggcctacgtggccagcagctgtggtacggactccacttgtgagaaaggaaagttagaagcagaatatgccatgacgtgaccgagatgctgctgggaccccagaagagcattcctcactgacagaatggtcagaactgaagcaaagtgttggttcttgccatgtctgagacgaggttaacttagcgaagatcataggtcacagaattttatatctgaaaaatacagtttttatcccagacaagtgatatcccacttgtctgattcattagcagcgagtcactaggcctagcccacattgaaggggaggagactccacccggatatgaatgcaggggagggtcccttggggccatctcagaggtctggtgaccacatttgcttatctagttaaagtatctcacataaagattcactggttggctgggcccagcactcctgtaatcacagcactttgggaggctgaggtgggcagatcacatgagaacaggagttcaagaccagcctggccaacatggcaaaactccatctctactaaaaatacaaaaattagccagatgtggtggtgcatgtctgtaatcccagctactcaggaagctgaggcacgagaatcacttgaacccaggaggtggaggttgcagtgagccaagatcacaccactgtgctctagcctgggaaacagcaagatcctgtctaaaaaaaaaaaaaaggtcaggggcgatggctcacgcctgtaatcccagcactttgggaagccaagcgaggcaggtggatcatgaggccaagagattgagactatcctggccaacatggtgaaaccccatctctactaaaaatacaaaaattagctgggcatggtggtgcacgcctgtagtcccagctactcaggaggctgaggcaggagaatcatttgaacccaggaggcagaggttgcagtgagccgagatcgcgccactgcactccagcctggtgacagagagattccgtctcaaaaaagaaaagattcactgacgactgatagatgtattacttcctggagattactacctgctccagcacttttcctgctcttttccacttttcattacagaagaaaaagggccaaaaatgtgatgcacttcattgtcatttaacaagtatttattaagaatttacctgtgctgagcacagggattcagaggatggaatttaagaagtgagatagtgctgtgatggagacacacaagattccgtgggagtatctcagaaagacattgtctcatcctagaggagatagtagtgagactgatgcccaggggaccagcaggagccaatcagacagcatgggggagagtagtgctcccagcagagggagtggcaagagagagcagagtcccatcaacagagtcaagtgtggatgggcccacacttttgcttttttgtcaaaaccaccaaggaacagagttggttgacatcccttgcgtgatgtatatctcatccaagatcggctccggtctccaggcttcctgaacccttagcctcaggcctggcgaaagcccatgcatattggtgagctatcacttgtgcctctgacccacccaggattgcaaactggtattaccctacacaaaccagaattcacggagggccctgacagctctgtcctggcttcattttcatccagtgtgatcctaacgccaagggctggggcataagacccatggagaaataacacctgcccaggagtcgtagcttttctctttcaactgctctgaacaaacacaacttctagaatctggtttttatcttcctcagaaggcatgccctaggtaatgatcccaggaagagggtctgattatttccaggctgatggtgggcaggaggtttcacttccagatactagagctttagacacatgtggctggccaccctgcctacccctcttgtctcatcccccatcatcatttcaatatcaaagtatttgcaaaggttcagtgtcatgctgttatgaagcagcctggatgttcacctgggtcctatgactctgatgtgcggtcctcaggccatggtgcctggcccagatcatgcagagggagattcctgagtcctcgccatatgtttaatgctggctgggccatctgtcttacagtgaagtgtgttagcatttcagaggtcattcttttttttttttttttttttttttgagacagtcttgctctgtcacccaggctggagggcagtggcaggattttggctcactgcaagctccacctcctgggttcaagcgattctcctgcgtcagccttctgagtagctgggattataggcatgcgccaccatgcccagctaatttttgtatgtttagtagagacagggtttcgccatgttggccaggctggtctcaaactcctcaccttaggtgatgcacctacctcggcctcccaaagtgctgggattacaggcatgagccaccgggcccggcccatttttgttctttaagtggatttaatttccatcttgagttcctacgctgtctgaactggtcacttaatctaggcatttccaggcaaactcgaaaccagccctcagagattcttatcctgcttcctgtgccctgagatttgcctattctggacattttatataaatgggatcatacgatatgtggtcttctgtgactggcttctgtgactggcttcttgcacgtagcatactgttttctttcttttttttttttttttttgagacagagtctctttctgtcatccaggctggagtgcagtggcgctatctcagctcactgcagcctctgcctcccagattcaagcaattcttctcccttggcctcctgaattgatggacatttgaattgtttttactttttggctatgtcgaataacgctgctatgaacatttgggttcagatttttgtgtggacatgttttcatgtctcatggatatatacctaggaatggaattgctgccagtctgtccaaagcagctgcactattttacttttttttgggtgggggaggtgggggtgtgggggtggtatttggtctttattccgtagatggcttaaagaaattcagttatctaaaatctcaggacaaatttatcccttttatcttatattcaattcagaaattgttgagattttcctagaatcacagtctgcaaatacatgacagtgaaggattggaaggtggtaataggaaaagtagctggggagacaaaacagtgcccagactgaggttttaatgttaggaaaaaagaacattaatgatactgcagaatggtcacaagagctatccctagcaccagtctttttttttttttttttttttttagttccttttattaatttcaataggttttgggggaacatggcgggaggggcagatttggttacatggataagttctttagtgatttctgaggttttggtgcccccgtcacccaagcagtgtacactgtacccaatgtgtagtcttttatccctcacccccctcccaccctttccctcaagtcccaaaagtccagtgtatcattctttttttttttcctcctgagacagtgtcttgctctgttgcctaggctggagtgcagtgacacaatctcagttcactgcaccctccgcctcctgggttcaagggattctcctgcctcagcctcccaagtagctggtattacagacatgaaccaccacatctggctaatttttgtatttttagtagagatggagtttcaccatgttggccaggctggtctcgaactcctgtcctcaagtgatccgcccatcttggcctcccaaagtgctgggattgcagaccagtgtatcattcttacacctttgcattctcatagcttagctcccacttatggataagaacaacgatgtttggttttccattcctgagtcacttcacttagaataatggtctccagttccatccaggttgctgtgaatgccattgttttgttcctttttatgactgaatagtattccatggtatgcatttaccacattttctttatccactcgttgattgatgggcatttgggctggttccatatttttgcaattgtgaattgtcctagcaccagtcttcaggagggagggagggaatatttaattacagctccttatatgtaattctgggctacattttttaacttgtctattaatccttttataatattccatattatgtaagagaaaactaagattcagtaggattaatttatttactcaaagaaaatgttgaaataagaatgcaaattccatctctagtgctttcttcacaacataaatttttatctagcttccttgctcactggaagtacctttatcaattacatgagaaatacctacaaatcagttgcaatgatttattcatgtattaatttgtttaatcatgattttgtcacatagattttgaatatttgctattgctagaaactgatgctgatgtggttagagagatgtatgtaaatatttaaatatacataaatatatatttatatttatatttatgtatatattgtgatttatatatttatgtacataaatatacatgtatattatgtaattggtatatttatgtgtatttatgtatttacaaatatgtatactgtgatttatatatttatgtatacatattatgtgatacataaacttttaaattttttaatttttttatttcaataggtttttggggaacaggtagtatttgattacatgaataagtttgttagtggtgatttctgagattttggtgtacccatcatccaagcagtgtacactgtaccccatgtgtagtcttttatccttttccacaccccaccctttccccgagtccccaaagtccaatatatcattcttaggcctttgtgtcctcatagctaagctcccacatatgagtgagaatgtacaatgtttggttttccattcctgagttacttcacttagaaaaatagtctccaattccatccaggtggctgtgaatgccattatttcattcttttttatagctgagtagtattccatggtgtatctatcccatttgttttacccactcattgattgatgggcatttgggctggttccatatttttgcaattgcaaattgtgctgctataaacatgcgtatgcaagtatcttttttgtataatgacttacttccctgtaggtagatacctagtaatgggattgctggatcaaacagtagatctacttttagttctttaaggaatcaccacactgtttttcatagtagttgtactagtttacattcccaccaacagtgtaaaagtgttcctttttcactgcattcacaccgacatctattattttttgagctttttattgccattcttgtaagagtaaggtggtattgcattgtaattttgatttgcatttccctgataattagtaatttgagcatttttccatatacttgttggccatttgtataccatcttttgagaattttctattcatgtccttagcccacttttttatgggattatttttttcttgctgatttgttttctttgtagattctgaatattagtcctgtgtcagatgtatagtttgtgaagattttcttccactctgtgggttgtttgttaactttgctgattatttcttttgctgtgcagaagctatttagtttaattaagtcccatctatttatctttgtttgttgcatttgcttttgggttctcggtcatggagtctttgcctaagccaatgtctagaagggtttttccaatgttatcttctagaatctttatggtttcaggtcttagatttaagtctttgatccaacctgagttgatttttgtataaggtgagagatgaggatccagtttcattcttctatgtgtcttgccagttatctcagcatcatttgttaagtagggtgtcctttccccattttttgtttttgtttgctttgtcaaagatcagttgggtgtaagtatttggctttatttctgggttccctattgtgttccattggtgtatgtgcctatttttataccagtaccatgctgttttgatgactgaggccttatagcatagtttgaagttgagtaatgtgatgcctccagatttattctttttgcttagtcttgctgtggctatgtgggctcttttttggttccatatgaatttaagggttgttttttctagtcctgtgaggaatgatggtggtattttgatgggaattgcattgaatttgtagattgcttttggcagtatgattattttcacaatattgactctacccatccatgagcatgggatgtgtttccatttgttcatgtcatctatgatttctttcagcagtgttttatagttttccttatagaggtctttcatatccttagttaggtatattcctaagtattttattttattttattttattttttgcaggtattctgaaaggggttgagttcttgatttgattctcagcttggtcgctgttgatatatagcagagctactgatttgtgtacaataattttgtatcctgaaactttgctgaattcatttaccagttctaggagctttttggatgagtctttagaattttctaggtatacaatcatataatcagcaaacagtgacagtttgacttcctctttaccgatttggatgccctttctttctttctcttgtctgattgctctggctaggacttccagtactatgttgaatagaagtggtgaaagtgagcatccttgtcttgttccagttctcagggggaatgctctcaacttttccctgttcagtataatattggctctgggtttgtcatagatggcttttattacattaaggtatgtcccttctatgccagttttgctgagggttttagtcataaagcgatgctggattttgtctaatgctttttctgcatttattggatcatgtgatttttgtttttaattctgtttatgtggtatatcacatttattgacttacgtatgttaaaccatccctgtgtccctggtatgaaacccacttgatcatggtggattatctttttgatatgctgttggatttggttcactagtatttttttgaggatttgtgcatcagggatattggtctgtagctttcttgttttgttatgtccttccctggttttggtattagggttatactggcttcgtagaatgatttacgcaggattccctctttttctatcttttgcaatagtgtcagtaggattggtaccaattcttctttgaatgtctgatggagttcagctgtgaatccatctggtcctggactgttttttgttggcaattttttttattaccatttcaatctcactgcttgttattggtctattcagatattctgtatcttcctggtttaatctaggaggattgtatatttccaggaatttatccatttcctctaggttttctagtttatgcatgtaaaggtgttcatggtaactttaaatcttttgtatttctgtggtatcagtagtagtagctctcgtttcgtttctatttgagcttatttggatcttctctcttcttttcttggttaatcttgctaatggtctatcaattttatttatcttttgaaagaaccagcttttggtttcattcactcactcattcattcattcattcattcatttttgagatggagtctcactctgttgcccaggctggtgtacagtggtgtgatctcagctcactgcagcctccacctcccgggttcaagagattctcctgcctcagcctcccgagtagctgggattacaggtgcgtgccaccacaccctgttaatttttgtttttttcagtggagatggggtttcaccatgttgcccaggctggtctcgaactcctgacctcaagtgatccacccaccttggcctcccaaagtgctgggattacaggcgtgagccaccgtgcctggcctgtttcatttatcttttgtattgttttgtgtgtatgtgtttcagtttcatttagttctgctctgatcttcgttatttctcttctgctgggtttgggcttggattgttcttgtttctccagttctgtgaggtgtgaccttagattgtctgtgctctttcagactttttgatgtaggcatttaatgctatgaactttcctcttagcatcactttttccgtatcccaaaggttttgatagattctgtcactattattcagttcaaagaatttttaaatttccatcttgatttcattgttgatccaaccatcattcaggagcagattatttaatttccatgtatttgcatggttttgagggttccttttggagttgctttccaattttattctaatgtcgtctgatagagtgcttgatatgattttggttttcttaaatttactgagacttgttttgtggcctatcctatggccattttacatttctatcagcagtatattagggttctaatttctccacatccttgccaacacttgttattacctgtcttttttattatagtcatccttgtgggtgtgcggtgatgtctcattgtagttttgatttgcatttccctaataatgctgagcatctttccatgtacttactggatatttatatatctttggaggaatgtctattcagatcctttgcccattttaaaatattatttgtccttttattattgagttgtaagagttctttatatattttatatatagatcatgtatcatatatagtttgcaaacattttctccctttctgggggttgactttcactttcttgatggtattcttcaaagcacaaaagttttacttttgataatattcaatgtatctagtttttctttcatagcttgggcttttgatgtcatatctaaaaagtcattgcctaggccaggcgcggtggctcacacctgtaatcccagcactttgggaggccgaggcaggtggatcacgaggtcaggagatcgagaccatcctggctaacatggtgaaaccctgtctctacgaaaaatacaaaaaattagccgggagtggtgacgggcacctgtagtcccagctagtcaagaggctgaggcaggagaatggtgtgaacccgggaggcggagcttgtggtgagccgagattgcaccactgcactccagcctgggcaacagagcaagactccgtctcaaaaaaaaaaaaaaaaaaagtcattacctaatccaagattataaagccttccccctatgttttctctaagaatgttataatttcagctcctatgtttaagttattgactaattctgaattgatttgttcatatgttttttaatgatatcttttgaaaagcagaagtttggtcgggctcagtggctcacacctgtaatcctagcactttgggaggccgaggcgggtggatcacctgaggtcaggagtttgaagccagcctggccaagatggcgaaaccccatctctactaaaaatataagaaaagccaggcatggtggcacacacgcacctgtaatcccatctactttggaggctgaggcaggagaattggttgaacccaggggacggaggttgcactgagccaaaatcgcaccacttcactccagcctgggtgaaagagtgaaactccatctcaaaaaaaaaaaagagaagacgaaaagaaaaagaaaagaaaaagtttaaaatttcaatgaaagccagtttatctgtttggttttgtttttacatatcatggtttgggtgttttcttagagaaattttatagttttagcccttatagttactatgatccattttagttttagctcttatagttactatgatccattttgatttagttcatatttatttgtatcatggaaagatctcagaaagcatgctaagtgattaaagcaaattgcaaagtgatatgagcagtacaataccattcatgcaaaatttaaaagcgtgaaataccatctattattcatagctatacatgcacatataggttaaaagtttcacagcagaattttgataggggttgcctctgaagggaggagaggaaagaactggaacaggaaagaactggtggacaaaaatattgcaaatttttctgcaatatttttaggttgaaatacatttgacacaatatgaagttaccaatttggggtggttaattatgttgtactttttagttttctgtattttttttaacttctcaaaatacacatacacacacacacacacacacacacacacacacacacaaatgattcaaagtaagaaccacagaaaacaatccatttctgttgagtttggtggccacacggttgaagcactgcggtggggtgtcgtgcgtccagcctgtccacctgttcagggccaattctgtttgtatatggggtttctagctgagaaagctagaagaaggataactgtcttcatttgaattcactctcacactttggcttctattttttccagttttgcttccacagaaaaccctagtccaccttccacactcagttcccgttgtgctgaagagctacagagcccacatctcagtgagcggcccttgattagttttctccttttatttattttatcccattgctccaaactttctccacaactataccagggcctcccaaggaaagcttggtttctgtttaccatgtgtcctttctcacctcgtccccgcggggtggccccggacagccttgctgtacatgtgcagtgcatgtggcatgactggccccatggccccgcttgcagcctgcagccgagctccgcacatgctcagagcatgccctgcagggagtggggtcacaacctgcagagtgcacactgccacccttggagtcaaggggttgttcccatgcctcccactggcaagctgtgtggcctgacacaacgtctctttccattcttcttcttctataaaatggacataaaaatatataccctggcttggtatggtggctcacacctgtaatcctagcactttgggaggcgaaggcgagcagattgcatgagctcaggagttaaagaccaacctggacaacgtgttgaaaccccgtatctactaaaaatacaaaaaattagcccagcgtggtggcgcacacctgtagtcccagctactcgggaggctgaagcaggagaatctcttgaacctgggaggcggaggttacagtgagctgagatcgtgccactgcactccacctgggcaacaaagcaagactctgtctccaaaaaagatatatacgtatataaatatatacatacacacacacacacacacacacacacacacgtatgtcctttccactcacaggttgccggcagcagcggggggaggggtccaaatgagaacatgtacatgaatgtgtttgcaaacaaaatgaaagctgtttgcatgttacttcctgccctgcaagccaagcccttctagagccctggcccagtcacgcagctcactctgtctccaccactctgtgccagcctcttctttccctcccattcttggtcttgttcttaggatgttctctctctctgccctgcacgcccccttccttttttccttttcttcctctctccagtcttggaagcagcctaactccttcctttcaagtatgatcttgtaccactgaactgaggcccactggctggctctggttgatggagaaaaagtactttcttccttcctcaaagaggtcaggtacttgagataacgtattttctgtctttgaatctccaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtgagtttctggagcagagttcagcggggagctgaagggatgtgcaaacacggacaagattcctgctgaggttttttccatttctgttttgtgctctttgcttggaatgatcagattttgacagacagtgtaaataagtcaggtgctggccccttctcatgagacgggctggtctccagcgggagggctgcaggcttcctatgtgtgccaagaacaggcctcctggggttctctgcccttttttctggattattggaagtgctttgtcctttgggctttgtctcctccagaggaattggatggaataattccctggcctagaagggactgtaacaggcactgtaactgggaccgtgctgaaagcacagtatgcacgccattgtcacagtcatcgggggagctggtgaccagcagtattaagtagttgggtggggattcagagggaagtcctgctggggctggaggtgagaaggggaggtggtagtggtggttgtggagagtacagccccacccccacaaggctgaggaagacctcggtggaatgcttattctggaacccagctctggattgtgtggtggcggcaaagcgtggagttgacaggatgctgctccctaggtagagagggcagagggagagggaccagtgggctggtgcctcctgcccccggtgtgcctgggaatgggtggagctgctgtggccccatctccccttaggtgttccacacctgtgttctcgggcctggcagaactgaggcatttgctcagccgtctcttctccacgctcacccaccctggcatccccatctgctctgcctctcctcaggtacgaggagaaacctccgcaatgacctgctggtggcagctgactccatcaccaacaccatgtcatccctggtgaaggagctccattcaggtgaaacccagagctcccagccagcttcctggcctcccctgccttgcccgcgcccttctcacttccttgccagcaccggcagaacctcaccacccagcttgcaccaccccatttcatcacctaactttgccttctaggaacacactggatgtctccacccagagagcctctgtcacacaggatcgcgtaggggcggtttcacattcaggcctatctcaggagtgcatcttgtggagcaagctgaatgtagagaaattcagacctttcagtgcaggcaggccccttcctcacttacctcgtcttccatctgtactttgtccacagccgctctctccctaggcctgaccgaccacctcattctgaaacttccctggaggtctggagcggaatcagccaggaaagctctggaccttcccctgctgcctttctgctctctcctgtttgatttgtttttgaaacctattccctccttttgtccgtgaccaggctctgatttcacctgaagttcatgacctgagtctgtcgcctcttctgctccttgtgttcagctcatctgtgacttctttctcagtctctccatcacctcaccaattcagtgacttcccaaagacctttacctcgtggcatttcaccttacataaaacccaggaaagagagagaaaataaaaggccattcacgtatcctcctatctccaggaatccccatgactctaccagttacgtaggggccagagagtcactaacgatttcacagcggtggggtctccatgttttgtgttaaactaatggtttccctccctaagcgctgtaggtcactcacactgatggctctcttttgtttctttccacctaatgtagtgcttttaaataccttgaagtagcttaacaggattattaaataaaaagataaagcagtttttccacggacgattcaaacacatacacttattcaaacactcttagggaaggcaagccttgggtatttttcagcccttcgtaggagaaagctcacatgtttagggttgtcatgggactggacagagcccccagctctgctctcaagtctgcctgttttcatacagaccaaagtgagtgtatagcccagcttcgtctttccagtcagttaaggtcagacgctgcctctcttgtttgatggtgccaccctctccattctagcactgtttctcaacccccatcagaagcacggccccgctctgtacacataaacagaagaggcgacagccttcaggatgacctcacaggtgattagaaggcgctttccctaatgcagctccccacagatgtcagaaatcccacttttagaggaaatttctcagggaatttcgggccatgggaattaactacacttgtacttcatggccacttattagagtttatgcaaaataagtggcttctgcgttcatcgtgctagggtgagaggtcattaaataccattaagtggaaagcacatagagaccaaatagcttcacaaaaatgtaaagcttataggaatcctcagcagtgtctcatagtaagaaaggatggtttcaacaaaattatgtagtgtaatttggaaggtgccttagagagcacattgtccagtcccttactttagagatgtagcctgtgcttatcagaaaagtggtctgcctaaggtcgtgcagcttgaagggggaaagctggtcctagaacctgggtcttcagagcatcaagccagagatcttactcccctccaggacaagatagcaaacccagagtcccagaggcccctttccctgatgctgtcctctcagtcactgaagcctgtaggtagacgtggaccaaagccacacatggcacggtatccctctaacatgcagacataaactccctttacatgtgagggtgccaatttctcagtgaatggaatagcttcacccatcaccaacatgtttttactgtctccttgacagtgacttgacaggtttttgttccaatgagaggacatactcagattatctttacatatattctatacagtgtatacatactgtatatacatagcttgtagtcctcatctttataaagttttttcacagataatcgaatcctagaattggaaaggatcgaggccacaggcacagtggctcacacctgtaatcccagcactttgggaggctgaggcaggtggatcacctaagctcaggagtttaagaccagcctgaccaacatggtgaaaccccgtctctactaaaaatacaaaattagcctggcatggtggtgcatgtctgtaatcccagctactcgggaggctgaggcaggagaatcgcttgaacctgggatgcagagattgcagtgagccaagatcgcgccgctgtagtccagcctgggcaacgagcaaaactccatctcaaaaaaaaaaaaagaaaagaaaagaaaaaaattgtaaaggatgttagaagtcatttaatccaactcgccacccaataaaacagtcctctgaatatttccagcgagctcattcatgatcaactctaatcactggaaacttcttcctcagtggggagccaaaatctcactttctgtaactgatttatccctgtcctctcaagctacccaggataagctcagtccctcctctgcaggctcgcctttcacgggttggatggcaaatgacaacccttcctagttttctcctctgtagactgctacacccaattccttcaacctttccaaacgtgacatggttttctcttaccagcctgcttgaccataccaggatgtggccattttccaaggctcctattcaaagtacatgcccagggcccagcaccctgctctccatcacaggggatcttgtccctgcagagcacaaggcatctgtgaccctcttgagtgtcccctggaaaagcaccttagacggcattagcacttcccacatagccactttgcactgtgcggtcattttaagtttatcatcagctaaaacatacggaattttttttttttaacagaaccccgtgttaatctaggtattcccccaccatatattgtatggtcactttcttaaacctgaatgcaagacattagatgtctccctggtcatcaccacctgagggcagacaggcatagaacagaggcacgcaaccccacactgcacgcccccagccctggtcaggaaagtgagcgatgtgaccgcactgctccctttgggctgtggtcttacgggctcctattcagcagtgctggggcgtgggccgcacaagtgcagactggtgagctgaagcaccctcagaggcctgcagccaggagctgttagctagagtttcctcccaagcctcagcagttgctttgttcaccctccttctgtacttgtcctgtgccgaagggtcactggcctccttggacttgttttcacagcagaggaaggtgcagaggaagaagaagagaagatgcagaatgggaaagacagaggtaaaggcagctcagcaggactgctcgtttaaatggggagcccgagctcatggatcagccgccccccactttgtttctgcattcctccctgccaccacctttcccagagctttcggacccgaggtccctgtacctacttttcccatctgacagtcaggttttaccttccaggtgacaaggtcagtcgatcaccaagagcttcctcatttcctgatcctgggataggtagttgggatacaggaagtagatacaagtagaacacaaaagatgaccctttgactggagaagtttatgatctagttaataaagcaagaccaggccaggtgcggtggctcacgcctgtaatcccagcactttgggaggctgaggcgggtggatcacaaggtcaggagttcaagaccagcaggctggccaacatagtgaaacctcatctctactaaaaatacaaaaaattagccaggtgtggtggcaggcgcctgtagtcccagctacttggggagaatgaggcaggagaatcacttgaacctgggaggcagagattgcagtgagccgagatcacaccactgcactccgtcctgggcaacaagagtgaaactccatctccaaaaaaaaaaaaaaaaaagaccaaaaatgcaaaataaatagatcaaatgaagtggcagaaaaagctaatcataaaactttcagcatataagtataataagggtttctgaaaaggaagagattgttgtggactagaatagccaaatggttttgtggcttcatggaagaataaaaccaagaagggaaggtgtcagcaaaggacagtagtgccttcctagtttcattatatatcgaacctgcttaacacatgacatctgggaagagctgcagggaatgattttcacgtatgatgatctcatctaatccttaacactgtgagacagattcgaatatccccattttacccatgaggaaataggctcagagagatgttgttcatgtagctgttaaacggcagagatttaggccagacgtggtggctcacacctgtaatcccagcactttggaaggccgaggcgggcggatcacttgaggccaggaattcgagagcagcctggccaacatggtgaaaccctgtctctactaaaaatacaaaaataagccaggtgtggtggtgcatgcctgtaatcgcagctactcgggaggctgaagcaggagaatcccttgaactcaggaggcagaggttgcagtgagccaagatcacgcaactgcactccagcctgggcaacaaagagagactctgtctcaaaaaaaaaaaaaaaaaaaaaaaaaaaggcagagaactgggtctttctgactccaaacttcgtgctcttaatcttcatccttctatgttatactgaacagaaaacaaaattttctttggacatttgagggtgagctgttctttctgttgtgcattaatgtgttagttgctggattcctcctaaacatcagctcctcaaggcagagattttagtctgttttgttcatgttgtgttccagtgcctggtgcttagtaggaggtcaataaatgaacaaatcaaaggaaataaatggggtgatgagatagagagtaccttatcggggagagaaatgcaatggctggtcaccccaaggaggtgaaggtagggagagcaggaagcatgaggaggagccagcagcagccctcccagggaggaattctgaacaaggctcgggggagtgaaagaacctgccagctgataaatggcacagcctgagttcaactccaatgcccatggtttagtctgagctgaactggtagactaagggaagtggagtggtcttacttaaggaagggtagaagccaagtgggagatacaggcaaggaagctgtgacaagaaagggaaacctacaggacagtgggtctggagcattcttggcccataggggctggagtggctaagacagggtcgtctttggagtctcacggggcaaggaatttgtcagcaaggaccctgaaattgctgaggaagaaactgggagaagaggaagaagattctgcagattctgaaatcgtctagtgagtctgagctaggcctgggaggaagtggacagcagcgccaacgagttgatgagaatgacatatgtggcacggacaccaaaaggtcagactaggctgggcatggtggcttacacctgtaatcccagcactttaggaggctgaggcagggggatcacttgatgccaggagtttgagaccagcataggcaacatagcaagaccccatctctacaaaaaataaattagccggatgtggtagtgcacacctgtagtcccagctgctttggaggcagaggcaggaggactgcttgagcccaggagtttaaggctgcagtgagctatagtcacgccactgcattccagcctggataacagagcaaagccctatctaaaaaataaaaataaaaggtcacattagagagcagtagtgtttcagacatccaggaatgcttcatagaaatgtagaaacaattgacttacccacacagacaagaaagaaggcaggagggcaaaaggtgaagagatacacagataaatttacactggtgtaaacacatgctgcaaacacgcgcacacacacgcacacgcacatgcacatgcacatgccaaccaaatcctagcattcatgtggaatgttcctggctgaagacataacagctgcatctctggcctcccttcacctgcccctcccttccccagtagctttttcccatggcctctcctcagtccttttcactccaccaaagcaaacctaggactgccccagccactgaggccttgccctggccacgaactctagcccttatcctggttcgagtctgagtgtgggccatgcctcacatgggaatcagactgggtttcccttgcccagccctccaggccccagggtgctgtctctgcacctgcactcccctgtccacatcaaactgggtttcccttgcccgggcctccaggtcccaaggtgctgtctttgcacctgcactccactgtccacatcagactgggtttccctcgcccgggcctccaggccccagggcactgtctctgcacgtgcactgccctgttcgcatcagactgggtttccctttcccggcactccaggccccagggcactgtctttacacctgcactgccctgtctgcatctcttctgtctttctgtgcctcttgcccttagagctccttgtctgtctttcagtgcatataccagaatgtctgtatgtctatgtgaaatctttttgtgggaatgcctgaatttttacgtatgtgactttctggtgtcatccctaaggccaagagtgttaagagttggggtgagagatggtagagttttttatgtttggctctccacattatataggttctaggatatgtccctgaaactacaacgtagctcatacatgggcatttttataagactaagtgtttttatgggtggacctcctgattctctgccatgagctaggcctgagattttacagacctaggactaactgcagtcacctggacaccagagatctgtaactgtcaaccgtaaagagagagagtatatttgcttctttggggttgaaaccatactgacgtaatataaacagaatttggtcagcaccatcaggcaaacatagtctgctcgataaggaaactgtgagagtcaaatggaacttttgaagaatctagaccaagctgaacttccctgccatattcacccctgcctcacgcctctccctgttcacccctggctggctggctgcatcctggggaatgcttctgctccatcggggtacccttcctcctctgcatctcctcaagagaagtgtaaccaagacacatagaagaagcacagactaacacaccttcccccatagtacatcatctccaccctccacagcctcatgttatgctcctgtgtccttcacagtctcccctcccataccctgccatcccggtgtgggggctgtaaatccagtttgcatccataaagagccctggtgcaaggctggacagcaatggccctcagagaacagaacaggctcaggaggggccaggcagtgctcgagcctcgggtgagcaagcgcagggcttttcaaagcagaccatctgcaggagggggaccgccctcactcaaggcgcagtcatgttcccttggggaactttcagagctgagtgggctttgcccccctcatgtaactgctccctggatttaaggagttttgattccattttttaatgactttccttctcctgagaagcatctgtctccatggctgcctcgggttggctacagtagtagaaagtatgactctaccctgctgtcatacctgggtgggaaaagtcaacaaacgagtaacgggagaagcaaggaagcccctggggtgggttggtcagggaagcccctttgagatagtctggggcatgagaagacctggccgtgacctcagtgtgttgtttctgcccatgctgccacaggttagcagaggagccggacacagaggaagctcaggtgagtacaaagagtcctctgcctccccacggcccctccctccttcctcagcatcttcccttcccctcccttcctgcagtcacaggtccctagccagggcagtcctaacaggtgaagatgcaagagcccaactgtcccttccctttgcccaccccagccatgtgccctccttgccctgtttctaggctgtgtcctgtcttgcacagcactgtctgcaggcctggtccttgggcatggcctggtgtcctctgtgttgggatggcattggcagacccgacactgctggctgaaacagggtgtgctgagcaaggccacctccctggggagcactgcctcccatgctcctttcccacagccactgcccacttccttcctgggatccaaaccacagccagtgcgtccctggattctgtcacccagcactgcaccgaatcacagtccctgacccacagacatgtgattcatgcaggatcacactgactacagggctgaccaagccgcttcccatggtgcccggccaagctgcaccttctcacttcctgaagaagcaatgcagaaaagtacggactgctccagtggcagatgctcattgcctttaggaattagtcattcccattttccagctcaacaccttaattctttctagtcccagcaccaagatatcagacttctccattttaaaatcttgtcttccctcccctcctcccacccccccacctcttatatttaaaaattaggcatcttcctcgaataaagaagtcagggccctagctgcacaatccagaaaaggggttttttcagaccctcccaagtcgtgtcatcctggaatagcctctggccctctctgcccaaccgcgccaggccattgaaggcctctgcccgctcccccggggcccctgcagcctcggcctgcgctgactctggattgtgcgagctgaggagagggcagcacctgggccacgcacattctctcgctgccctggaaatcacagcgccccaggggcttggagagaggcttctccctaaactcactgtgcacattcaggcaaggccctttcccaagcaagcctaggccgtggcagccgaggagggaaatcaggaactgactcgccctgcaggagcctgccagagcccctctctccccggggcagaaggaactggggtgcaagggaacgtggcagagccatgtgcccccaccgccttgttgcacatggaggaaaccaatgccccacaccagaagctccatgccagaagcagaattggagccgggtcttctgcctcctaatcctgcgctctctgacccacatcaggggtgatgagaaacaccaacagccgagagttaaactaagagtataaaacttgggtgccgcggattcatggatgcccaggcctgcgctctgctggccgggggctgaggcttcctccctttcctcttagtattcatcggcacacctcagtcctccctgcccttctcctgggccacaattctccccaagaaatcaccccattcaaaccttgcattgtgaacccaattctttcttccacggaaacacttcctgacccttaggaatgatggcagaggaccctaggtaccacccttcagcccaacgcttgaaaggcgcccagcatcctagcagcccctccctgcagggcctcctgttcacagtagatgttagcagcttttgtcctgaaccctcaacagtgcccgtgactaacggtgagtgtgtcttgcgcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaagctcttgtgtgtttgtgacctgatgaaacacttcctggcgtctggccagcacgtggggtgctcctgaacgtgggggcacaagtttccttatctttgacctttaaaaaccaacaggtttcttccagcgtgcaaagaaagcgtcaggccttgctcggctctgtagacattcacaccctggccacggtgctaaaaatagtctcacactggttaggcttccgcccgccccgtgtgatgccgccgcctgcagcccgggagggaggggcggagacccagccgcgcgccgcagccgggctgagcctcctcggagagggcgggagggtctctgcgccgcggactccgtggccgccagggggcgcgccgccgggggcgctgctcgcagcctctcgccttaggggtcgattgggctcgggcacacgtgatcaagtcccgttcccggtgattttcatttattttttcctcctccctgggctccaggatgttatttttagcagaagaactgctataaatatttataaagggcagtgactgtaatgaagcgagaagccccacagctggctccccagcatccctcacccacctctgcagacccctgcccttggctttgaggaggtctgtgcagagacggtgggatcaactcctggccgcacacggatggagtcccaggcaagcctgccaaggcccagtcagggtaaaatagaaggggtgggtgttcacaccttccgtcctttcctctctgtctcttctcccccatagctcatcttcccattggttggcactgtgtccccacgagctttccacggagttgcgctcaccgtggcccctctctggctcttcaggcaagcagagctccctgtttccaagggcgtggggccctcttctctgcccaagcccctgctgactctctgtgttttcagctctgaggccagcactcaggtaccgggtgcactctggtgatacccgttcttgctgaggttgatttctcgtagagctagaaaacccgccattacctaagccccgagctccctcatgactgttggcgtctgctttaggacccacatgcctgtcagacctttggaactgggtccctttcctcaatcctggcgaggaacacaggtggtcatcacggaaggaagatgggcacttccatcttaattgctctgtgaccactgagcaggctaatttaacctaggtagacggttttttgagaaactgcagcatcactgactcctgggtgagccaggctgccgtgcagcaccacagcctgggctggcgctgttttgcagtgctggaggaccccgggagggctaccaaatgcatcgtgggtcttgaggaagcaacagctccaccgagttcttgtccataagtcccagccaccctgagcttcctcttcccttcgcagcccctctcatctgctggtgaggcttcaaccactggcagacgtgctcctcttcgggctgcttactgtgctcctgcagcccataagcgcttcggaggggtgcagttgctatggcaatgcctacagccatctgaattcctgctgcaccttctgggagaaaagagctcatgaagaggcattcggtggattcccagtctggcctctggcctctgcactgtcaggagtcagctgatgggttacatgccggacacgtgggaggtaggtagcctgccttccttgggaagacacactctgtacccgcaagcctcatgcgcccggacgggttctccttgtgtggatcagaaaactaaatgaagtgtcctactcagggctcctaggtaatatactgcaccagtggttctcagacttaagcatgcccgtgaatcccctggagtgcttgttaaaatacagatagcatggccatgcctccagagtctcggattcagcaggtcttgggtagaaccagagaatttgcagtcaacaagctcacaggtgacggtggtgccgttggtccaaagaccacactctgagattcacaggacaacacttggatgaagaagaaaaca

SEQ ID NO: 13633 - DNA, 39686 bp, Human
  misc_feature (1)...(39686): n = A,T,C or G
tctgtgatatggagagggaggcagctagacaaggatgtgaataccaagaggtagagattattggggggcaacttggaggctggctaccaaagtctttgttggtaaatcttgtgggatttttttggttttgattttttgttgttgttgttaaaacatgcttcaaaattaagaaattataaaaggtgtgtgatgacaagtcttccacccctgacccctagttacccagttccctttcttccagccaacaattatttttaacatctttattatacttccagggggattttatactgatacaaggaaatgtacataatatttttcctcttttaacatgaatgatagcatgctgtacagctattttgcaccttgctttcttcacttaatgatacagcttaaaatggttccgaattggtgcataatcatttccttaccttttacagctgcatagtatttcacaggggtgttgtagcatggtttacttacccattttcctattttttggttattctaatttttgactattacagtaacaatatggattatgtcctgtgtgtgagtaatatccatgaagtcagttcatggaagtggaattgctggttcaaacattagtttcagttatagttttcatggataattaccaaattgccctccccatggactgtgccagttctcttggcagcagtatatgagaatatctatttgcacatactcttacctacacagagtatatatcaaacctttgaatctttgctactttgagagacaattatatctgtggttttaatttgaattcttcttatgagtgaaattgaacatcttttcatatacttaagaaccatttgtatttccttttctgtggtctgttcatattctgtgcctatttgtctgctagtgttttccttagtaatctgtaggaactcattgttagaaatttagtcttttttggaggggtgggggaaagttgttaatatattttacatattttttaacatatagggttattatatgttttacttttttattgttttgaaacaatacagtatcaaactttgaaaaagttgcaagtgcagtactacaaactttttttagtagcagttgagattaagttgctgacatgatgcttcaccatccctatttagtgtatattcccttcagatacaaacattccacaaagccttctacataatcatagtacagccttcagaatcgtgaaactaatactaatggttttattatcacgcctagcagtctctctgcttctttgaccctaaaggagaggagcacacactctagaggtagacttcctaggttcaaattccagctctgggcctggtgcggtagctcacgcctgtaatcccagcactttgggaggccaaggcgatggatcacctgaggtcaggagttcgacaccagcctggccaacatggcaaaaccccatgtctactaaaaatacaaaaaattagccgggtgtggtggcacgtgcctgtaatcccagctactcgggaggctgaggcaggagaatcgactgaacctgggaggcaaagattgcagtgaaccgagattgcaccactgtactccagcctgggcaacaagagcaaaactccatctcaaaaaaataaataaataaataaataaataaataaataaataaataaataaaaattccagctctgccactcactagttgtaggtcttttggcaagtcactcaatcctactatgcctcaatttccttatctcttacaaaggatgtaataatcatgcctcctttgtaggtcattgtgaagattagatggttaatgcttagaatagtggttgctgcaatgtgaaaaccatgttggtgttcctatcataataatattattggatgaagaatagttgataagattaagttttaatgttttctagtagccatggatgaggttatcagagttcatagactacaatgtaaactacaaattgttcagctaatccaggatatacttttgttcttctctttttagattccagaatgactactatcttgacttacccctttaaaaatcttcccactgcatcaaaatgggccctcagattttgtaagtttattattatttttttatttttagagattggatttggatttataaacatctcgcacagatactgaatggtattgctttttgtaaacagtttattttgtcttccagccataagacctctgagctgttcctcccagctacgagctgccccaggtacagtaatttgtaaaataaatatttctgatttaaatgttagattccagattctatagtttgtgaactctgaataaaaaccaaaactaatttgctaattctcccctttttatgagcacatgaacatctctgttgccttcaaattaaaaaattataggtccaatcaataatgatactacattatttaggattaggcttgaggatgttaatgggaggctgttttctgggatttgaacctgctggagtcatggaggttccataaacctcgttggtcagtttatttatcctcttgctgtccgtcctggaggtgaatggcatacaaatgctcttgagacctgctatggaaccaaaagttaactttaaatttgcaatttgtgaaatgcttctctattgatgaatatcttcttctcccatgtgcaagagggcccattcctgaaatagaagtgattaggaactagttaataacagaaagttgtttagttaatatgaaatgaaagagtaaggaaatgtgttgattttatatggtcatttacacccttagtaaacccaatgaattaggcttctttactgcagatttttgtagaatctgctgtaggtttttatcttcactggctagtgctaaaaacaccctgacaaattcttaacatttttctccttgcctagattctgtattgacccatgcctttgattttggttttattatggtatttctacctgtataataatagaaaaaataccttccaggctgggtgcgggggctcacgcctgtaatcccagcactttgggaggctgaggcaggtggatggcctgaggtcaggagtttgagaccagcttggtcaacatggcgaaaccccatctctactaaaaatacaaaaattagctgggcatggtggcatacgcctgtagtcccagctacttgggaggctgagacacgagaatctttgaacccaggaggcggagcttgcagtgagccgaggtcacaccactgcactccagcctgggtgacagagcgagactccggctcaaaaaaaaaaaaaaaagaaagaaagaaaaaatcctgggatttggttcccaggattcagaagacctgtactctcttccagctctacctctttctgggcagtgtggccttgaactggtcactttacttccctgtgcttggtttcttcatctaaaaaaggaatatataataagtctagtcttgtcagcctcatatagttatgagatatctcaaagcactttaaaaactataaattcactgtaagtgcaagatggtatttttctattattgcctaatcccaactagagaagtttcatattgtcatataacaaatatatttcctgtggcctttacattctaactagaatataggtttgtagtagccccataaataattcctgtctgtcttgttttgccttttccctaattctaatgttgacccaggtctttgctttgcaaagtcacacaaatagacctgatccttgccaagtgggagaaggtcattctgaataccagcagaggaaaccaagtatctggtgtttaaactattccttatattgctctgtaactgtttctgatgtttgtgtctccccaactgtattgtaagccctgtgagtctttagctttttggtatccccagtgtataacatggtgttccgcaaatataacagtgtcccacaagtaacttgcattaacgctgatgatgatagtggtaccagaaggcacgtgataaaacaatgggaagtggccagctgatttgagggaggaagcaggcatgtgcctgtgctgagcaggttttaggttgcagtaattttttttttgttttaactggcattctggtttgaagattgcagtaattttataactaattcctcttgaagcttgtgtgaatatctcttcttgacagagctgttaggatgaaggaattaaaatagaggggtacagaatttatggatgtttttagtcatctgatggactggaaatgtaagtgtctgatggaaattttgactgatttgatggttatgtctatgtatagatgtctttctctctgtgtatatatatatatatatacacacacacgtgtataatagttgtataatacatgacacatttattatcttctttgattttaattgtttttaaagagtatacaatgtatatcagtcagccattgaattgtaggttttggagttggttagagcctttgaggtcatctagttcagctctaatatttgcaaataagaaaatcgtggcagagtaggcctacaacccagatattttagctctcaattcagattcttataattcattactgctgtgtgcccagagcactgtagaatatataaaatggagctgtattgtcttgagaaaattttgatgtgcttaggagccagtgtgcacatgaagcagaatgagagtccttaggtgactattgaatacataattggccattattagaaaggggtcatatggtagttttctgctgtggcctcaatcagtcctctcgtaaatgtgctagtggctctgttttctctaatgctttttcttatttatttataagtgttgaaagtaatgggttcatgtacctgattgccttgttgatcttgcgtcactgggaaggctaagagctccccttctttttttttttttttctttttttttgagacagagtctcgtgctgtcgcccaggctggagtgcagtggcacagtctcggctcactgcaagctctgcctcccaggttcatgccattctcctgcctcagcctcttgagtagctgggactacaggtgcccgccaacacacctggctaattttttgtacttttagtagagatggggtgtcaccgtgttagccaggatggtctcgatctcctgacctcgtgatctgcccacctcggcctcccaaagtgctgggattacaggcatgagccaccacacccggccaagagctccccttctaatgctgcttgcctaagacagggtcccataactgtagtatatccattgtcttcttcccagtttattgggggagggggctcaggaaaaacctctgtctcctctgtggcacctttacccagtaacggcggggctgagggaggaggaggtggtaaggtaggtgatggttcctcttcgcttctctttttaggctcttctgtgtagagcagggccaaagcagccctaactaaggcccacaacgttaaagatgttactgggacctgttgcccttgtgcatgatgtcatttaagatttcttcccacttgtggctgggcgtgatggctcacacctgtaatcccagcactttgggaggctgaggcaggcggatcacgaggtcaagagatggagaccatcctggcaaacacagtgaaaccctgtctctactaaaaatacaaaaaattagccgggcgtggtggcgggcgcctgtaatcccagctacttgggaggctgaggcagaagcatggtgtgaaccctggaggcagagcttgcagtgagccgagatcgtgccactgtactctagcctggggacagagcaagactctgtctcaaaaaaaaaaagatttcttccaacttgttcccagaactctaggtctagtgtgccttcttctgggaaccgtgggttatggaaaacaacagtttgcattaggtcccttaactgagcctccgaaacggaggctgtgctagcttcaagcagctgtttcaatacttttatgtactgttgctgttgagctgataactcaagtcccattgttacgggtgggcctttgttcttagagctcccaagatggggcaggcggctcccaagatggcggcaagcctttttttctctgacctgaggctcttggcctcatggattccaaggaatggaaccttgggccatgcagtgagtgttatagctctattagaagccatgggtcatggaagagaatcgtggaacccagcgactagcgttgagctcgattaggacgaacctgggcacttggccgcacagaaacaatggcgagcctctagcccaaacaggaatggcactgggtgcctcgctggatcagaaacgcagcggacaccctgccagatccgaggggtggaagtcaacagcgggtctgcgacggtggcgaacagcgggtctgtgacagtggcgaacagcagtggtggaaggtgagcaaaagctcagctcgagccagaacaaacatggaccagaagagtgtgcagttgcaagatttaataaagtgaaaacagagctgctatacaagggtaggggatccaaagggggttgcccctccttgctcaaatgcctggggtttatatcccaatcattgtcgctccccctgtgctctcagatgatagatgatttgagtatttctttacctcctgcttttaacctaattgatattttagtgagccttctttaccacctgattggtcgagtgtgagctgagttacaagccccgtgtttaaaggtgggtgcagtcaccttccccagctaggcttaggaattcttagtcggcctaggaaatccagctagtcctgcctctcaccatgatgaaaccctctcaccatgatgaaaccctagcttgaacatcatgtcccatgatgaaaccctagcttgaaaatcccctcgaacttggaaatcctgagtgggcaccaattacttactgcacggtcacttcactttcattttcaagggttctgtcgtgatccattgcagcatgtctcacacggggcaccacctgccgggtctgtcccacagaccctggctgactgacagatgaaatgagtactcagacacaggtatgcagtgtaagagcagctaggggtctgcctggctctagtggccaaagtgcagcagccctgagaagctggagctccttgcttttattcagtgtaggcacagtgatgaaagcctggagcaaacacaatctgtgggtaattaacgtttatttctccccttccaggaacgtcttgcatggatgatcaaagatcagctcctggtcaacataaataagctagtttaagatacgttcccctacactcccttgtacctactccttgccctctgcctcagggttatagaacagctgccttcagctattctcccccagggctctgcagaaccttctgaccttttagaaggcctgcatctttccctatagtttctcccaccactccgactgatctcctacatataataatgaatattttttaaatgtgccttgtagagttagtttaattactttataatatgctaaattatttggaatggccagtgtgccctagaggttgcccagaggtttagaggcaggaatcatcagtaactgtagttatcagggaaggctttactaggaggtagaatgtgaacgaggcccaagagacaggtaagaattcgatgggcaaaaaaggggccaggcagatgggaggtccataagtaaaggcaaggaggctgacctgagcaaagctgtaaaggactgggggctggctcatcttgttctattttgagaagtagtggaaaatacttaaggtggaaccgagtaaaacaagctatttgttagaagagttaagaatttgaattttatctgaaagtatataaaaggaatatatggtcagttttttctggttttttttttttttttttgaggcagagtcttgctctgtcacccaggctggagtgcagtggcatgatctcagcttacggcaacctccacctcctgtgttcaagccattctcctgcctcagcctccccagtagctgggattataggagcgtaccaccgtgcccagctaatttttgtatttttagtagagacggggtttcaccatgttggccaggctggtcttgaactcctgacctcaaatgatctgcctgcctcagcctcccaaagcggtgagattacagcgtgagccagcacgcctggcttggttagtttttaaaatgtggaatgacatgatggtgtaccattcgacctgtcacctgcaaggtcagtcatgaatagtgtgcaaatcttcaaatttagtgacctgttttctgtctgctcaaataaggattttccttgaggaccgatgcatttaaccatcttgttctccttgacactctcctgcctttgatcttgtgtactgttctctcttgattctcctactacctctcaagttactgtttgtctcacatattccctcagccttctcattgtagggacatcacaaagctaagggttttttggtgtagtaatggaccctcaagttaaggatgagaaggtttgtgtgtactacagctggaaaggtgttaggaaccaagcaagcagctctaggggccagctactttgtctcacacaccacatggtatgtccctttcctggtctttctgcttctatcattcttcattctggctggcttatttgctcacttatggtttacaaactctggcttacgaatgacatcagtttaccatcaacctgttcttcctcatggcatctttttagcttcaactaattggcatttctttccatgcttctttgcctagagagagaatctgaccaacacagttgatcacttgtaggtagatgacactggtttctggttggctcctatatggatggatcattggtgagtccagtacctactctgaatctaatcagcttttatattgacttagggatgtgtctatggcttcccctttggcagggactgtaagcagggcaactccctttagaggggcctgtgggatgtccaaaacaacaacaacacaacaaataccccccccccatccagacaaacaaaaaaagtatcttttattgttaaagaggaaataggaaatttaaaaataaaagaaatagagggggctgtgggagaacaggcattgcagaatacatctctgctttccttctgtattctaagcttcaatatttcatgactttctaatctacactcatttctcttcagaggttttgctttgcatcttctagctaactgtggaattaacatatccacctggttgtctctctgtcacctcaaagttagcgagtttaaaaatgaggccaggcgcagtgccttatgccggtaatcccaacactttgggaagccaaggctggcggatcacttgaggtcaggagttcaagaccagcctggcaaacaaggtaaaaccccatctttactaaaaatataaaaactagccaggtgtggtgtcgtgtgcctgtaatcccaactgcttgggaggctgaggcaggagaattgcttgaacctgggaagtggaggttgcagttagccgagatcgtgccacagcactccagccttggcgacagagcaaggcatcatctcaaaaaaaaaaaaattaagtccccttttttttccaaaaccagttctcactttgtttcgggtagctaggtattcttagtctctaagattcctttataatcctgttttcctctttcctttctttctatatctgattggttgccaacataccttgttttcttttataaacttcctctttactcatgttgatactgcctttatcctggccttttgtgccacatgcttgggtttgccacagtctctttgcttacctccttgttgcctttatctccttcaccagcagcacttctccatgaatgctgccagcgtcatctttatgccctattttatcatgactattaactctcactaatatttctttaaagttggttgtagatgtttactataaatacttctctgtgacattaacaggtgtggtaaggtcgttgttgacattgtattcccaataatttaggatttttttctatctttgataaggaataatgatagagtaggtaaattccaacattaacaaaaacaagaaaataatgaactagattttgatatactaacatggaatgttcttcgagctatattgttaagccaataaaatatacataatatacaagtatatgcatgtaagtgcactaaaagaaacgatttgaaagtatatacaccaaataaacagactttacctcttagaagaaaatagtgtggtaggcgaaggcataaagagggaactttagtttttactctccatagttcagtattatttactttttaaaaaaaaccataggcacacatttatattttattctttaatttaagaaacctaaaggaagtttgcttttttgagattaaaaagtatttaggcatgtagatttttgcagaatagcaagtcaccaaccaagtgccccttatttccacgtagaaaaggtaagaacatcaagctatgtgaagagtgaacaatatcaatcattgcaacttctaatattaagggtagatttgcgtgtaaatttggttacttctaatgaaataggttgtcaaacacttagtaaaaatgaactattttgttaatggcataaattccctcatcattggatataagctttgtttatcttaaatattatttagaaacttacaaatgctagtcaatttcttagcctttttttaaaaaaaaattaaagtggtttagtaaatggcaaatgcaagttggcattaatgatgtaataattcttagaatgactatcttaaaaaatgtaaaagtaggccaggcacggtagctcacatctgtaatcccagcagtttgggaggctgaggcgggcagatcacctgaggtcaggagtttgagaccagtctggccaacatggtgaaaccccatctctacaaaaatacaaaaattagctgggcatgatggcaggtgcctgtaatcccagctactcaggaggttgaggcaggagaattgcttgaatccgggaggcagaggttgcagtgagccgagatcacgccattgcactccagcctgggtgacagagcgagactccatcttaaaaaaaaaaaaaaaaagtaaaagtcatcagactttatatattttaattagtagtttttgtttttaaactttatcttaaagctgtccagaccaaaacgaagaagacgttagccaaacccaatataaggaatgttgtggtggtggatggtgttcgcactccatttttgctgtctggcacttcgtaagtatgacatgatcatattatttttttccttcttttaagacactttcaaaagtagtctttgtaaatgtaacccagtaggtaataatattgttagtggactaatatttggatagcagtcccatgaaattaatatagaataagtcaagacagtggtgaaataatatggcaacatttgttttttatccttctcatgaataagtctagcgtagttttacttgaaacagctctattttgaaaacctagaggtccagatagcttgcttccaacagagctgtcctttccttttctggagacaagtacattgtccctgtttctcctcagaagtttgagtgctgaagatgtgggccatgggcattctgaagggcctatataatccactggtttggcctcctggaaattattaaaattggagttgatagggctggtccaaacccccagcatagcacaaccccaagtgtgtgggaccagaatggtcctagaccagctccagaattccctagatccaaattgctcttctccttggccttttgtgcttcttttctgtccccgagtgaaggttagtctatccaaaagctgataatggactttgataacaaggtttaaactgttcattctattctgtttagattgttttaatgtttatattttgaataggtagttgccagctttaaaaaaatgctgcggaatgttaggcatctgttaaaaagaatgagacctatctttatatactaatatggaagacctaagatcttgaagatatgttaagtataaaaagcaaggttcaggctgggtgcagtggctcacacctgtaatcccagcactttgggaggccaaggcaagaggattacttgagcccaggagttcaagaccagcctgggtaacatagcaagaccttgtctctgcagaaaataaaaaatattagctgggcatggtggtacatacctgtagtcccagctactcaggaggctgaggtgggaggatcacttgagcctgggaggtcaaggctgcagtgagccgtgatcatgctactacctatactccagcctgggtgacagagcaagactccatctcaaaaaaaaaaaaaaaaaaaagcaaggtgcacagtattgtgtatagtgtgcaatgacttatgaaagatacacatgtgtgtgtgtgtatgtgtgtatacacacacaacaaaggttcatttttaaacagatggtttgggacctacaaatatattttcttacagaagtaatgctatatgttggccaggcacgtggctcatgcctgtaatcccagcactttggaaggctaaggtgggtggatcacttgaggccaggagttcatggcaaaaccctgtctctactaaatacaaaaattagctgggtgtagtggtatgcacctctagtcccagctactcgagacactaaggcatgagaatctcatgaacccaagaggtggaggttgcagtgagccaagatcatgccactgtactccagcctgggcaacacagcgagaccctgtttcaaaaaaaaaaaaaaagaagaagaagtaatgctataagtaaatggtagtgacgtttctttattcatcctattttatcaatatagtaatccacttaacgatgtttctataatctctttcctgtactgacacaacagtaaaagtaagaatcagaaggctttagcagcaggaagaagatgatgtcctccttttactcagcagcaataaaatagaaaaagttccatcaagacatgaaagttcttggctaggaagactttttttgtaaggatcattatatattatgtaggtgtttgatactgttttactagctgttaaaaaatacaaacaggccaggttcagtggctcacacctgtaatcccaacactttgggaggccaaggcaggtggatcacctgaggttaggagtttgagaccagcccggccaatatggcaaaaccccatctctactaaaaatacaaaaattagctaggtgtggtggtgcatgcctgtagtcccagctacttgggaggctgaggcaggagaatcacttgaacctgggaggtggaggttgtgatgagctgagattgtgccactgtactccagcctgggtgacagagcaaaactccatctcaaaacaacaacaacaacaacaacaacaaaacacccaaacatactcaactgtttcatttacttttattaaacatttgatgattagtatttgcatgaagtttaatttgaggtatttaccaaattggcatagggttgttcctttctttgttgtgtattgtgttttagtttaattcaggattctggttcatgagcaatctagtggtacagagaagagaaaaacattgagtaatgtaagaaatgatagtgaatagggaagaaagaatcaaaagtattttaaggcaatattcatgtaaagaacaaaagtcactaaaaaataacattagaggccaggtgcagtggctcacacctataattccagcgctttgggaggcggaggcgggaggatcattcaaggccaggagtttgagactggcttgagcaacatatgagcaacataactagacacctatccccaacgcctcctcaccccctacctcccagtcctatctctacaaaaaaaagaaaaaaaaaaaggtgttttaattagccaggcatggtggtgcatgcccctagtcctagctacttgggaggctggggcgggaggattgcttaagcctaggagtttgaggctgcagtgggctatgaacgtatatgagctatgctattgcacttcaacctgggtgacagagccagaccttgtctcttaaaaaaaaattaataataataacatagagggaaaatgtataaggacaacaatttttacattattgatgttaggattgaagtaccaaatgagtcttctgtaatagaagatcattttctaagtggaaaaagtctttttctgtttaatttgcagaaacgttgctttcaacttgagtgttatttggaaggccaggttcttatgggtaggggcatttgggaagcactcccgggaatagactctagcagtggaattcagaagtctgtcaatcattcaggtagaggagtgtgagagtatgagaataaagattgtaaatgataagttggctgggcgcagtggctcacgtctgtaatcccagcactttgggaggctgaggcgggcggatcacctgaggtcaggtgtttgagaccagcctggccaacatggcgagaccctatctctactaaaaatacaaaaattagccaggcatggtggcgtgcacctgtaatcccagctacttgggaggctgaggtgggagactatcttgagcccaggaagcacgttgcaccactgcactccagccctccagccttggtgatggagtgagacactctctctcaaaaaaaaaaaaaaaaaaaaaaaggattgtaaatgataaataatttatggcttaggcattttcaaattgacacatgacttttccccaaataattctgtcctaaatttgaggaaactggatttacctatgaaaaatttggaaaactactcatggttctcctgtgattctgagtgaaaatgacagtaaaaatattttggagtttttaagttttaattttcagggacttgaagaatgaatcttcttatttaatccaatgattaaatctctgacttaaaaataaagagaatttatttttgatctttaaacaaacaaacaaataaatagagttcatacccagatcttggtttctaaatagcagtcttcaatacaaagaaccagagctcctttgaagaatgattagggctgagccagagaaaagacaggatgagcaaggagaacttgtagtgccggaaagcaaagaagtacttaaaaaaaagaggggttcagggggtcatgtcaaaaagacacaggtctgacctgcaggagctaccggtcaccaaaactgcaatgatttgagcaataaaataaattgcaatagtattggaacataacccaaagaataaaacaaatgcctacgagtctaatctgatataaataagtgaataaataaatacacattgggaggccaaggtgaatggatcgcttgaggtcaggagttcgagaccagcctggccaacatggtgaaaccccttctctactaaaaatacaaaaattagctggatttggtggcaggcgcctataatcccagctactcaggaggctgaggcaggagaatcgattgaacccgggaggcagaggttgcggtgagccgacatcgtgccactgcactccagcctgggcaacagagtgagactctgtctcaaaaaaaaaaaaaaaaaagagtaaataaatgagaaagaatgaacaagtcttccttacagaagaattttgattaataaatataggaggactgtgtacagtggttcacacatgtaatcccagcactttgggaggctgaggtaggaggattgcttgaggccaggagttcgagaccggcatggacaaagtgagactccatctctgcaaaaactaaaaatgaaaaattagctgggtgtggtagcagacaccggtagtcctacctacaagggaggccgaagtgggaagattgcttgagcccatgagtttgaggctgcagtgacctgtgattgcaccactgcattccagtctgagtgacagagtgagaccctatctcaaaaaataaaaataaataaagaatgagaaaaataaccattagaataccacataatacttgctgcgagatctacaaatgaatgctaaaattaggtgaaatgctaagaagaaacagaatatttgcatagtctcagagaatctcccccaaaatatttatcaattactatgatgatttcgacatacgtccgcaaagtctgtgttattcctgccactggaaggtggaacttaattctcccctcagaatgtgggctagacttagtgactcacttctaacaaattgagataagaaaggaaaaaatagtaactttatagtggagtaaactggcagacatcacttgacccaaatcatcactttaacatcactggtagtaagtcatgttgatatcatgtgccccctgatacgaagctaagagaaatacagtttacctctgtgatattcttcccctaaatccataaccccagtcttcaaaagtgtcaaggtcatgaaagacaaggaagactgagaaactgtcacaaattggaggagactgaggaggcatgacaactaaatgcaacatggtatcttggattgaatcttggaacagaaaaaggacattagtggaacaactggtgagactcagataggtagtagcttagtgaatagtattgtgccaatgttcatttcttagttttaataagtatatcatggttatgtaagatgtcagtattagaaaaagcaggggaaggctgggcgcggtgactcacgtctgtaatcccagcactttgggaggccaaggcgggcaaatcacctgaggtcaggagttcaggaccagcgtggccaacatggtgaaatcccatctctactaaaaatacaaaaaaatcagctgggcgtggtggtgggtgcccgtaatcccagctattcgggaagctgaggcaggagaattgcttgaaccctggaggtggaggttgcagtgagctgagattgcgccattgcacttcagcctgggcaacaagagcgaacctccgtcttaaaaaaaaaaaaaaaacagcagggggaaagaggaactctgctctctttttccaattcttatttatgtatttacacagggtcttgctctgctgcccagactggagtgcagtggtgtgatcctagcagcctcaaattcatggccttaagcagtcttctcacctcagcctcccaagtagctaggactacagatccatgccaccacgcctggctaatttttaatattttttgtaagagacaaggtcttgcttgctctgttacccaggctggtcttgaactcctggcctcaagtagtcatatcacctcagcctcccaaaatgttgggattctaggtgtgagccaccatgctcggcctctttccaattctttggtaaatctcaagttacttaaaagcaaaaagtttcttcaaaagtcctaatacatcacctgtagccctgtaggcattacaaaataaataaataatatacttttaaaataaaatgtttaaaggaaaagagacctcaaaggtggggcttcactttaaagaaaatttagcatatgttatactgaacattaaggtgttggacaacatttttgttcgattcttagcaagctcaggaggagttaaggcttgctagacttttaaggatgacaaatagcgaagtcacactatttcttcatttgaaatgatggactgccttggatagtaaagttaagtgtgtttgtagcagcatgtgtttgatgatctctgggtatttcaaatagaatgaaaatttttcattgaagctctagggttttggtttaaattactggttttcgttccccagatataaagacctgatgccacatgatttggctagagcagcgcttacgtaagtaaatgcagtttcatttccgttcttatttcattaaaggcactttctccagtttttacacataaaatagcaatttgttcttattttagccatctgtactatacaaatttaagcagcttatgaatattgtcaatctttattttgcaggcctaacagtgtcttagcctgacagtatactttaatgctaccttagctagccacaggactcgattgatcagcctaaacacaatacatatatttgatgattgccttaggaacttgtataagggtagctgaacagattatgtagatatttacctagaaagaagcctaaaagacacctgaagattcatgtgcaaaccaagtaaaaatgtaaaattagatgtagttaaataagattaggctggatgaataatttggttgagaatcattaaatgtgttgctgtttcataacatgtaaggcattatctcttcattttccactgacactttgcctttgtgtcttcaaccagccacagttctttcttagtttggagaaacccttcagttgacctttctgtccattctaactctatgtttgttttttttttcttcctgcaatacctcaagcatgagtgaaagagcagttgtttctgtttccttattattagtttcctctgtctaattgtataatcattatttccattttccctttgttttacagaaaccatactttagaatcttctcttaataatggttttatgattgctcaatgtactgatcctttctcagtcctctgtctctgtactttatagcacttgacactgtaagctataatcacctctcttctgttgacttcttagtaatatgcctttatgatttttctttttcttctgtatcctgactgattcttctgtagcttttttttttttttttttgagacggagtctcgctctgtcacccaggctggagtgcagtggcgtgatttcggctcactgcaagctctgcctgccgggttcacgccattctcctgcctcagcctcccgagtacctgggactacaggcgcctgccaccatgcccggctaattttttttttcttttttttttttgtatttttagtagagacggggtttcactgtgttagccaggatggtgtcgatctcctgacctcgtgatccgccctcctcggnnnnnnnnnnnnnnnnnnnnttgattgggccctccattagcatgctcgacggccgccatgtgatggatcactcctgtaatcccagcactttgggaggctgaggtgggcagatcacctgaggtcgggagttcaagaccagcctgaccaacatggagaaaccccatctctactaaaaatacaaaattagctgggcgtagtagcacatgcctgtaatgccactacttggaaggctggggcaggagaatcccttgaacctgggaaggcagaggttgcagtgagccgagatcacgccattgcactccagcctgggcaacaagagcaaaactccgtctcaaaaaataaaaataaaaaaccacacacacacacaactggatctctccctctttctctttttgaaaggtgttttgcaagtttcattccttagagctttgcatttctctgtatgcatattttcctttaaaaatctcatctactagctaggcatggtgtcttacacctataatcccagcactttaggaaaccaaggcaggaggatcaaggtaggaggatcttttgagcccaggagtttgagaccagcctaagcaacatagtaagactccatctctacaaaaaaaaattttaaaaattagccaaccaagagaattcagctcaggagttgaaggttgcagtgagctatgattccactactagactccaggcagggcaatcgagcaagactttgtctcaaaaaaaaaattttttttaaatttttaatttatttttttctgtatggagtctcactctgtccaaggctggagtgcagttgcttgatcatagctcactgcaacctcgaagcctcccaggtaactgggactataggcgtaagccaatgtttctaaccctctttttagtttttttaattgataaaaaactacagattttacagatttttatttatttatttcattgtagccaagtttagtcattactcattttgaagctcagcttattccacattttatctggcactccttcaagttggctcctgtgtgccttttgttttttagtataatgctggttgttgatatataatttgcatgcaataaagtgcacagattttaagtgtatagtttgatgagttttgacaaatgtatataccccgtgttcctgtttttgatatggtcccatttgtcttttttttttttttttgacacagagtttcgctcttgttgcgcaaattggagtgcagtggcacgatctcggctcactgcagcctccgcctcccaggttcaagcaattctcctgcctcagccttccgagtagctggaattacaggcacatgccaccagtcttggctaattttttttgtatttttagtagagacggggttttgctgtgttagccaggctggtctcgaactcctgtcctcaagtgatccgcctgcctcggcctcccaaagtgctaggattacaggcttaaaccactgtgcccggctgatatggtcccatttgtctttgagtgcttccttacttttggcacaaaaaagatggaaattcactttgtactttcttctggacctggtatcagtcatttcttaaaaaaccttttgtccttttaatggggaatggcatttagaaaccaaatctggggccgggtatagtggcttacacctataatcccagcactttgggaggccaaggctggtggatcacttgcagtcaggagtccgagaccagcctggctaacatggtgaaccctgtttctactaaaaatacaaaaataagccaggcatcatggcaggcgcttgtagccccagctactcaggaggctgaggtgagagaaccacttaaacccaggaggtggaggttgcagtgagccgagattgtgccagtacactccatccagcctgggtgaaagggcaagattcttatctcaaaaaaaaaaaaaggaaaccaagtctgggttcagggagtgctcattcctactggagtgttattgtgtctagtttctattcatgggcacaactagaatatatgtattatttcaatcatttgttgatactgatatttcaaactaaaatttaacatacccaggacttctttttttttaattttttttaatagtcttaagggagactttgctttatctctttgattgaatatttgtctctctttttcactgcaaactttggtttctactaacattaattaacattaatttataggtttcttatctattttattctattccaaattattttttattctctaacttctcattaccaattcagcatcaaatgttgacttttaaaatcactctttcattcatttcttctttgagaaggtgccaaatgcttgtcaaattaaagaaaagatacagtctctgtccttttaaattcaaggctaacctttttcaaggagcgcagtgttttgtgtgatgatctctggcactgccttgatgtgtgaaatgtttctttgctttggatttctacttccaggggtttgttgcatcggaccagtgtccctaaggaagtagttgattatatcatctttggtacagttattcaggaagtgaaaacaagcaatgtggctagagaggtgagtaaaacaaactttatgttgtttaaagagtgataggagaatcactttgaatttcaattaatagaagttactttacaaaagcctttaaaatctattgagttacatttgacctaaaatgtgattttacagcttgggtaatgtgttatttaatatgtaaaagaattctaatataaatcaaatgacatacactatattagtgtatatccatactttactgtaaatcaaataaattatttgagctggtttaggacattgtctcttgtgttaggaaaatagagatcagcaaagtgtggctgatagtatttttagtaatgttagatatcatggcttccaattaatttaaaatttcaacatgttgcagagaactaatttcataacttgacttttgttagctggaagtagccttgcttactcatttgttcccatcaactagatggcacgtaaggcagcttggctttttaaaaactatttcacaggagtttacttttgccctagttggcatagctccatgtagtgtcgattgggcaaccaagataatgacaggccttggaacttctaggatgtgtcctacaggcaaatccaaacacgtcttctgggctgtgttttcatttaaaatcgattggatgaagttggcaccaaaagcacatttcattgtactcagtattttccctagttctggtctgtgcttgccatattgttgggttcagtatcactgtcaactgagagacaagggcacatgagcaggactgaaagtatttgttctgttccacctctgtacctggcagaaatgttagaactgccaaaggcctggcatgactgaagcctacgaaactaactgtgtgctgttgaggggcaggaaggaattaacaataggaagagattttatttcccttctgaaattttttgtttttccttgaaccttgacatttctgaatgtttcaaatatgataatttcatgagtacatcaagctgctcataatacattttcaacttttatattctgaaaataacctattacttttataagagcacttaagatgtaaatagtaaatttttttgctgttttctcctcttgctcagctttttatcccatcctttcttccttctcctcctcctcaaaaaataaaaaaataaataaataaaaataaatgtttccattttctctgtaattcagttctttttttcctaaaactaaagccataatgttttcctctgaaatttttcctggaaattttacatccatttgcagatctcagctattgattgacaggaggtagattccctctgcctgccctgtactaataccagttatgttgtgctccaggtaatttttgcagcatctgcagggagagattgggttgagggggatacattatgagaatgtcactctaaagctgtattgcaacctaaaagctaacataatttccagccaaagaatttcttaggccctattgcctgtattaataatgttaatatacagtccttgcaacctaaaagctaacataattttcagccaaagagtttcttaggccctattgcctgtattaataatgttaatatacagtcctaaaaggctcctggtgttcatgaacctgactttgttgaaaggttcagcatatttccctgttctccagcttaaagacatcttcctccttttcccttagtgccctgagagctattcaaatttcaatagaagtgtgtggacaagggtcaccaatagccacctctatttaaagctccttccgtcctgagagtcatctagggccaagggcaacacaaattagaaaggcccttgtgagaatcgagccattgcaacctaagtgccccttttacacttgccctttgcagagctcttccctcctgcccccctgagatacttgcgtctctcttcctttcggattggtttacgttgagaggctgatgcacaggtgcctggcagaagttctcaacaaagcaggttgggcatttagtatcaggcctacctggaaagaccagaatgaggtcatgttgcagttacatcactaacacatttctgtttctatagattatggtaaatagcataaaagtaagtaagtataaaggtaaaaatcagttaagagacattgaatttctaattgagactttggaaacatttattttactaaattataggagagtgtgttctgaggataattaatagtttcagggaaagaatactaaaaatgaattccctataatgggatccagtatttcatagtaaatattgtgtgggtgtgtatgtgggaggaaatctggaagctttatttctaaagtaaaactttaatattataaaaataagtattttataattgcacctgtgcattaattatttacataaacaaaaatggaatcagacgttgattggtttttgacagcataatttcccccaataaatagtataataaaattatagatgtgctcatttcatgtttgactttcactgtgccattataatagaggccatttttaaaagattaataatgacctcagtttttcttaaagccgctcagatgacaaattattctctttgtatcacgtattatgccatcatcctggccacttgttagttggtctgacccttatttgttcacagactcacttgtaactcaggcaattctccagtttctttcattgagttgagcttctgtatagttggcaagttttccagttcatctttgcattgggtctgcagtgtgctatctgaagtatcagacggtcagtaagagaaaccagctggcagtgagcagaaagataggtgtaaagcagacagggtcttgagtgggaactctgtttatgaagggtcagttctttagaaatcattttcatgtttaatcacttttgctttgctgctaagctttgtgactgatcatgagacctgataacacagatagtgaggactccaccccataatatatttcatcatcattccagcaactgtctttaataggttcttttaagtatatttgaacattaaacaagttaaaatcaaattatatattgatattcttgaaggccctgagcaaaacatcgataagaaattaggtgagttaggagagtatcatagcctcgtgtctgcactagaaaccagccagcaggaattttgcatatacctgtcaattaatggcaagattaaatattagtgaaccatttctgtgatggacttcatttgattttaaatattgctctggagaatgttaaactgaaaccgtttccagatgactatgaagattagtgctcaaagcatcatttacatgatgcccttcccttatagtgatcatttcattcactctatttcctaaaggctgcccttggagctggcttctctgacaagactcctgctcacactgtcaccatggcttgtatctctgccaaccaagccatgaccacaggtatgtttaaatggaaacagacagtacatgttaattattctcctttgtcttttacttgattataaaaatgtacttttttttttttttttttttttaacacagaacctcactctgtcactcaggctggagtgcagtggtaccatcatagctcactgcaggctcaaactcttgagctcaagagatcatcctgccttaggatcccaagtagctgggtctacaggtgctccaccacacccagctaatttttaaattttttgtggagacgggatctcgccatgttgcccaggctggtcttaaacctctggcctcaagtgatccttctacctcagcctccaaagtgctgggattacaggcgtgagccaccatgctcatcccaaaaagtactcttaacagaagtaaaagattagcacagatctctatacttgtgttttttaaaaagtaaggtcaggtttaaaatttgggggttctaaccgtagttaacctctttttttgctctccatacctgaggaacattaccattggcgtggttcctctgtgaataatgtggctggctgcagcagggattatcaactggaggagtgtatctctaggaaggtacttcagcatctgaggcatgagtaaatagtttacaacctgccaggctttcaacctaggtgcttcagatatgatattttcccacaaagatatggtcttccttccttcaccactaccatacttgtaaatcattgctttagatggcacagctctttccttcactttctccttacatccttgtcatttttataaatcactgaaaaccccactaacaaactttagcaaaactgtgggatattttgtagcatcagctcttagtgtgaggaggcaaggaagcctgaaagatttagtaatcatgtgctcatctagtaacatcaaggcccaggtgggcaccccacctcatgtgtggcggggaatgatgcccgtgactgggggcgttcgccactctaggcagcatgtgaccaactcctggttagagaaacagaatactggccagtggccataaggagagagggggcctgccttacgtttcaacagctgtaatttctctgctttgcagcagaagttaacattctctttataggataaaaaatctttattaaaactaaagctgggagcatataaatatgcaagatgttctggtttggaatatgatttgttcaagagttggtccaatggatattcctagaagttgacgtccatatggcaggaatgaaacttgtttttctctaacgtgttgaatgtgtttttagtcatttaagaaaattaccttaattcttctgaaaagttgaaaactttaattacagatgttgtacaaagctgataactgtcattcagctttttaatcaagaagcttaaattggaatggtatgttattttctgtaaaagatattcatgaagtataacctgtgccctgtaggtgttggcttgattgcttctggccagtgtgatgtgatcgtggcaggtggtgttgagttgatgtccgatgtccctattcgtcactcaaggaaaatgagaaaactgatgcttgatctcaataaggccaaatctatgggccagcgactgtctttaatctctaaattccgatttaatttcctagcacctgaggtaaggcttgtgtttgcagggcatcccactgcagagatttagaattaggtatggcagtgtggactctgctatgctgtaataggtgtagattctgtagttacaggaaagggttaattacttgctcaagatggaaaaaaaagatagtggttagaaaactttaatttgtgagccctctttagagatcctctttagagatcctctgcttgtcttggacttgattgattaatggtagacaaatagattttaacttttccaaataacacagaacaatcctaggtgttagcataacaccggttaacagtgtacctgctccttggatatctcctttcccagctccctgcggtttctgagttctccaccagtgagaccatgggccactctgcagaccgactggccgctgcctttgctgtttctcggctggaacaggatgaatatgcactgcgctctcacagtctagccaagaaggcacaggatgaaggactcctttctgatgtggtacccttcaaagtaccaggtgaaatgaaatgcttcatgacacttattagggagttctgaattgctcctaaaactcaaaaacatcccgagtgatttttccataagtatgttggttctgtttccaaagtattcagcctttattcttaaatatggatgcaaattttgatttatgttgtaacaataggttaacattttttaatgtttctataagagtgtccttttaagatctgagcactaatctcagcactttgggaggctgaggcaggaggatcgcttgaggccaggagttcaagaccagcctggtcaacagcgtgagacttcatctctaattaaaaaaaaaaaaaagaaaaacagagtctccttttagatcttgctgatatattttagttcttacatacatgcctgtttttaaaattcctgaatcgtctgacttctgtatagaatagccaactgtgaatgaatgtcttaagaaaatagggtgtcctatttttagtaaagcatttagatgatttcccaattgtcttttaagactttagtttaaaatttgataatatgataattataaaacactttccttctagtgaataggtaaggtttatatttcatttgtttttgtaatttttaaagcatatttctgtggagaagatatataaggcttgtggttccatagagttaaaaaaattcatttttttaataggaaaagatacagttaccaaagataatggcatccgtccttcctcactggagcagatggccaaactaaaacctgcattcatcaagccctacggcacagtgacagctgcaaattcttctttcttggtaactgtcaatgttatttgtatttagtagtgacttttctatttctgtactctctgtagaaaagcctaatataactttttgtgtgtgttatgaatagagggttaaaaatatagttattcattttaatgtgaaagtggagtcattaaaaaaaaaatagaatcacggttttaaggcccgagaagtcacctaatccagccaccattctgccacaaaagctcttcctttcaggcacttaaccagtcaaaaacttctattgcttatggtgggccctggaaatgaaaagaatagacaattgcaatatagtgagatgctgtgatggctgtaaggcttaggtcgaacccctgacccagatggggggacagtcagagagtcttcttggaagaggtaacacttgagcagcaaatcttgaaggaagagtaaaagccaactcaggaaggattttaaaaggcatttcgggccgggtgcggtggctcacgcctgtaatcccagcactttgggaggttgaggcaggcagatcacctgaggtcaggagttcgagaccagcctgagcaacatggagaaaccccgtctctactaaaaatacaaaattagccagatgtggtggcacatgcctgttaatcccggctactcgggaggctgaggcaagagaattgcttgaaccctggaggcgtggaggttgcggtgagccaagatcgcaccattgcactccagcctgcacaagagcgaaactcccatctcaaaaaaaaaaaaaaaaaaaaaaaaaaaggcattttggacaaagggaatagcaaatgcaaaatcaaggaagtatgagagcaaggggttctttggggaaaagttaggttggagcataaggtatgaactgggaagtcgcagaagacaaggaaaagcaggcagaaagagtaacaggatacctcttccagccctgattgttagaaaactgctttacactgaccccaatattattttcctgtaagcatcatggaacaaatctaccactgtttgttttgtgttttttttttaacttatcaacatgtagcttcatatccttccatgcttttctgactcctcaattaaacatctttattgattctgctgctgcttgtaagatgtgatttctcttctcttaccaccttgggtatagtcttctggatataggccatctggtcagagtttctcttacaatgtaactctcctacctggccataaagtcttgaaaacatacgcagatgtttgacatatttgcccatggtaaatgactaattaatgcctgctcttgataggctaggggagtggaatctggagtagttccaacaggatggaacaccaccctgttaagcccaggtggtgaagagctggttaggttggtcatttgcaaaaccgaattggatgatagagccatgtggcatggactacacttgccagatctgaatccttttgattatttccagggtatgctaaaggtccaggtttatttagtgagaatcagagacacaaatcatcagaggtgacacatcacaatacatggattttggggactgcattagtgccccacattcattgcaattttgcacaatggcacattgaacctgttattaatgtaatgtctgtaaaccatttattccatatggtcacctatgtctccagactttatggacaccctattggtggctacacagtctcttcagggttgccgagttataaaaatacgacagaatgtggtagaacttattttgattttacaaattatgaagaatagtttccttttctttggaattctgaagtttttgggggagcttttcttctttgaagtatggtaaaggacgttttttcagtagtacttctttgtcctccagcttctcggttgtcatttgggaagaaatgtatggggtgtatccaaagagggaagattgtggttctaatgtcctcagctggttctcccattggtttgctcgttacagaatatataagtagaataaaatgacctgtaagccacgggcagaaagcagctgagagcccagaaaatgtaaaaataaataaataagagatatgtttattttggttcatattttgtgccacaagctaaaaactttggcttaaataagtgtttagtgtttattatgagcagttctttctttttttttttttttttttttgagacagagtctggctttgtcacccaggctggaatgcagtggcacgatctcagctcactgcaacctccgcctcccaggttcaagcaattctcctgcctcagcctcagcctcccaagtagctgggactacaggtgtgtgccaccacacctggctaagtttttctatttttagtagagatggggtttcaccgcgttagccaggatggtctcaatcacctgcctcatgatctgcccgcctcagcctcccaaagtgctgggattacaggcatacaggcatgagccaccacgcttggccatgagcatttatttctaaagttacctcttctgttgattcattttgattattatgatacttttgaacagccttctctaccctcatcctccaaaaatgagtcagcgtgtgtatgtttgaattatgatttaatgatggatacagtgaagtaagtgttgttatatagaatcactgtataagtctaatgagttaatagattcaggtacagatatataagatggctggagaaagacctccagacaggctgaagaattttaacattgtgctggttaacatttcagactgatggtgcatctgcaatgttaatcatggcggaggaaaaggctctggccatgggttataagccgaaggcatatttgaggtaaagtaaatgttcaaacaaatcatctctgatttctttattttattaccaaagctcacctctctatttttttacctagggattttatgtatgtgtctcaggatccaaaagatcaactattacttgggtaggtagcagtttgtatccttggactataatcacaagtatttgattgcctatgttttattatactggttaataaatgattaacactggtttattatttatttgtttattacactggtttgagagtatattaagccctgagttcataattggtttatgtggtggtttttttaaaaaaaataatagtaatctggccgggcacggtggctcacgcctgtaatcccagcactttgggaggccgaggtgggcagaccacgaggtcaggagattgagaccatcctggctaacacggtgaagccctatctctactaaaaatacaaaaaattagccaggcgtggtggcgggcgcctgtagtcccagctactcgggaggttttggcaagagaatggcatgaacccgagaggcagagcttgcagtgagccaagatcacgccactgcactccagcctgggcgacagagcgagactccatctcaaaaaaataaataaataaataaaatagtagtaatcctttccattggtatatcatgttacagttttggattattttccatttttttcctataagttttacatatatatatggacacacacaacttatattctttttcattaagatagcatatgcattttttcatatggctacacaccctgctacacaatcttcctaatatagccttttataaaagcctccccatgtttagactctgttccgttccctcacaaggctgtagcctctagcctccactgtgacgttcacatcagtcaagccctttcccttgccttgctctttgaactctgttcttccagttcttcatgttattagcttgtccttatccctcactgtttatttattatcaatttctctgactctgcaacataagagtagagggcatgtctgtacagtttcactattttatctttaacatttcattaatcagtacagaaaaatcaaagaatgagtgaaaagacattagagtacctatgtaaaactcagtttggggaatatgaaggagctcttagtttaaaaattaaagttttaagatattacttattttttctttgcagaccaacatatgctactccaaaagttctagaaaaggcaggattgaccatgaatgatattgatgcttttgaatttcatgaagctttctcggtaagtaatttgaaagacacatatgaagggactatagtcataaaaaatgtcatccatatttgtgggagagagcaaggcatggtttatgatgtgagtagagcaggagtggacctgcatattttaagtactgattcacactgctgggaggggcccgaggggagggaagcaagggccacacatacagtgttggagaacataccaaattgcttctttaggaaattgccattgaaaactgatacaaagatttgttcaactttacttttttttttttttttggagacagagtcttgctctgttgccccagctggagtgtagtggcacgatctcggctcactgcaacctccgccttccaggttcaagcaattttcttgtctcagcctcccgagtagctgggacaagcaggcgcctgccaccatgcccgactaattttttttatatttttaatagagacagggtttcaccatattggtcaggctggtcttgaactcctgacctcagatgatccacccgccttggcctcccaaagtgctgggattacagatgtgagccactgtgcctggccgatttgttcaactttaaaccatacctaaagttgttaaactttcacaaaccattcctataagaaagcgtagaggaacatgaataacgaggttcttattcgattattttctcttccagggtcagattttggcaaattttaaagccatggattctgattggtttgcagaaaactacatgggtagaaaaaccaaggtgagtttctaattttaaaaaatgcgtgaattttcaaagcacgttaataattggatcttagttacctgttcttaagaatatgaagggaaagcttctctttcttttgaagaattttgtctttcattaaagatatttatttcttagtgtaaaagtagaaattcttgtatttcattaaatatatttatttcttagtttaaaaatagaaattatttagcaaaaataaaattctgtgttttttgttccttgcattctgacattagatgaaaaataaatggactcctgacttttaatattgacctagacttactttcttttgcagtaaaattatttgtaatatgtctgacgttacgtattttcctctgtctctcttacttcgtagtactaagagcctagcttgattctgatcttaagtaaacttatctttacatttgtgtctttgggggagccaggttggattgcctcctttggagaagtttaataactggggtggatctctgtccctgggacacccatttggagccactggctgcaggttggtcatggctgctgccaacagattacggaaagaaggaggccagtatggcttagtggctgcgtgtgcagctggagggcaggtacgttacagtggtgtcataggaccctccagagagtcattttcttggaatgactagaatgtatgatttagtttgaaaccttcttaaagcaatatttttgatgacctgggggtggggagtggggagggataacagctgtaattctgataaaactttttgttttttgggttttttttttttttttttgagacagtcttgctctgtcacccaggttggaatgcagtggtaatatcttagctcactgcaacctccacttcccggattcaggtgattctcgtgcctcagcctcccgagcagttgagattacaggtgtgcaccaccatgtccagttaatttttgtatttttagtagagacagagtttcgccatgttggccaggctagtctcgaattgccgacttcaagtgatccaccctccttggcctcccaaagtgctgtgattacaggcatgagccaccatgccctgccataattctgataattctttggaaggaaacagctatttaaacccaagctatttttccccaatataatgtttattttttacttataaatatatgctgattatgaaaattgtggaatatatgaaaagtatatagaaaaagttagaatcatctataatctccccatcagacattaacattattaacatcttgatatattttcttctttaataattaacttttatttatctagtcaccataagactttataaaatctctccaagagagaaactatctttctagagaactgaattataccttaactggggagttaatttacttctggataacttactgctgttcagctggggaaatatattgttgacagattttttcctttctacttcacttgcattagagacccaacttcctgactgctgtagcatctcactctaggaataaaatccaaaaggaagattgtagtttgttttttgtttgtttgttttttgagacagagtctcactctgtcccccaggctggagtgcagtggtgccacctcggctcactgcaacctctgcctcgcgagttcaagcgattctcctgtctcagcctcctgagtagctgggattacaggtgctcaccaccaagcccgggcaattttttttgtatttttagtagagacggggtttcaccgtattggccaggccggtctcgaactcctgacctcaggtgatccacctacctcagcctcccaaagtgctgggattacaggcatgagccactgtgcctggcctgtttttgttttttttttttttttttaatcccgatgtgaacagattttctcttcctctagattacagaaacttcctgttcctgatcaaaatgaataaatatttaaaagcataaactggccgggtgcagtggctcacgcctgtaatcccaacactttgggaggttgaggcgggtaggtcacttgaggtcaggagttcgagaccagcctggccaacatggtgaaaccttgtctctactaaaattataaaaactagcctagtgtggtggtgtgcgcctgtaattccagctactcaggaggctgaggcaggggaatcgcttgaacccgggaggtggaggttgcagtgagccgagatggcgccattgcactccagcctggtgacagagagagactctgtctcaaaaataaagtaaatgaaataaatcttacgtttaaaagccctttttcatggattttcctcagagactttgcagaaaccaaggggtcagttatttatcagttggaacattttggactttatgatcacaaatgctttttaatctgtgtaacttcatctacagaaaaccatggtccattaagactagagcgatccctctatctcttcatgccaggcttctaccagggagataacctgtacacattactcacgagcatagtgcgtaatccacatagggtaatgtctgcagatttgagtatgtgttccctaattctttatctagcatgtagagtataaataacacaatactggatgcttttatggatgaacaaggaataatacctagcacctttcttctagaagtttatagtatgaagagagaagataagatgcatctgagaaactagattaaacttgacattgtttgatcaagagccacgtgagcaataccaacatggttggagacagaggagaaatccatcgtggtgaatctagagcagggtttctcaactttggcactaacattttgggccaaacaattctttgttttggggggctgtgtgttgtagggtgtttagcatggcctctacccatcggatagcagtagcaacaagctcctccccacctctgccccaggtacacacggttggtataaccaaaagtatctccaggtgttgccaaatctgatctagagcaagaaaaaacatggaacatgaaaacagtgtgtttaaaataaagccagagagggctgggtgcggtagcttatgcctgtgatcgcagcattttgggaggctaaggcagctgggtggcttgaacgcaggaattcgagactagcctgggcaacatggcaaaacctcgtctctaccaaaaatacaaaaattagccaggtatgatggtacgcacctgtggtcccagttactcaggagggaggtgagaggattgcttgagcccgggatgttgaggctgtagtgcgctgtattcacgccactgcactttagcctaggtgacagagttgccttgtctcaaaaagcaaataaagaaattaaaataaataaaaaataaaataagcaagccagagaggagtagtctaccttattatgaattctttcaggacaacccccaagtcagtcaaaccttcctatccctgctctttttttgtctgcttgtgccttttcaatgtacttaacatgccaggtgtggtagctcatgcctgtaatcctagcactttgggaggctgaggtgggcagattgcttgagctcaggagttcgagaccatcctggacaacatggcaaaaccccatctctactaaaaatacaaaaactagctgggcgtggtggtgggtgcctgtagtcccagctactcgggaggctgaggtggaagtatcacctgagcccgggaggttgaggctgcagtgagccgtgttcaggccactgcactccagcctgggtgacagagggaggccctgtttcaaaaaaaacagaaaaaccaagtacttaacagtttgttttgaactccagtgtatacttgattgaggacaaagaccatgtggcaaatctttaaacctgcagtgttcaacttggcactttgtaaataatagtttcttttatttacttttttgttttttagagggtgtctaaaaattctatgctaggatttagactcatctaaactaaggacatagctagtacatagcactgtgcatagtgctggataaaagatattctacttctggccgggcacagtggctcatgcctgtaatccagcactttgggaggccgaggcaggcagatcacgaggtcaggatatcgagaccatcctggctaacacggtgaaaccccatctctactaaaaatacaaaaaattagccggacgtggtggcgggcgcctgtagtcccagctactcgggaggctgaggcaggagaatggcgtgaacccgggaggcggagcttgcagtgagctgagatcgcgtcactgtactccagcctgggcaacggcgaggcacggtctccaaaataataaataaaaaaaataaaaaaagaaagatattctacttcttccctttgtggtccctcagatcattatcttaacctgtgtagaatagtgaagaagggacaagcccagcctttggaatcatctagacctggtttcaaatcctggccctgttaccttaatagctttgtgatttgggtgagtcacttaacctttcagagcctcagttttcccctctagaaacttacttttattggtatttgctgtatcatgtttatgtttatacagttaaaaaagcccctggatttctcattttaacagcatccatttgtagagcatcactaggaattagattctgtactagacagagcctgatgcatatatgtatacatgtatatatgaatgtatataaatatatatgtgtgtgtatatatatacacacatatacaaatatactgtatgttatgtgatgcccacaaaaactctatgaagtagacactatgagccccattttgtagaggaaattccagtttagactgactacaaactttcccaagatcacagtgattgattggcagagccaggatcccactccaaagcctgtacttttctccttgttctctgctgtccctgtactaggtggattcatcaccattcattgctctaattggactttgttttctttacagggccatgctatgatagtggaagcttatccaaaataatagatccagaagaagtgacctgaagtttctgtgcaacactcacactaggcaatgccatttcaatgcattactaaatgacatttgtagttcctagctcctcttaggaaaacagttcttgtggccttctattaaatactttgcacttaagccttgccagtgttctgagcttttcaataatcagtttactgctctttcagggatttctaagccaccagaatctcacatgagatgtgtgggtggttgtttttggtctctgttgtcactaaagactaaatgagggtttgcagttgggaaagaggtcaactgagatttggaaatcatctttgtaatatttgcaaattatacttgttcttatctgtgtcctaaagatgtgttctctataaaatacaaaccaacgtgcctaattaattatggaaaaataattcagaatctaaacaccactgaaaacttataaaaaatgtttagatacataaatatggtggtcagcgttaataaagtggagaaatattggagaactgtttacctcattttttattcatcaggggagggtggttctcttggcttaggaccagatttttgcctttaattactcatttataacttctaactattgtggtcaatgctgaggctgctgggaagataaagacaatcctgtttatttatttattattattattttttttttgagatggagtctcactctgttgcccaggctggagtgcagtggcacaatctcggctcactgcaacctctgcctccccggttcaagcgattcttctacttcagcctgccgagtagctgggattacaggcacccaccaccacacttggttaatttttgtagttttagtagagatagtgttttgccatgttggccaggctggtctcaaactcctgacttcaggtgatccacctgcctcggcctcccaaagtgctgggattacaggtgtgagccactgcgcccagcctgacagtcctgttttagaataacacattttgttttccccactgctgaactgcagaatgtttatttcactgtttggagatgcttctgttagctaggatttaaataaagtgtaaagaagttttttattttgatcaactactctaaatcctctcagatttttgaaaactaccctgtactaaaataacatggatgcgagtgtttaaagaaacactagcttctttttatggacatttgtgtgactgttgcttaggtctatgaaagttactgggaatcaaaattaccctgtagttcagggacagattgggcaggagacctagtgctaacctcttaaaaggatatttgagagtcccagcatcgtttccccatggtttccttggtaattataatgtgagtttttaatacgaaaaccattatatttacatatatatcacaaaaatcaggtatagataagttaaatataaaatgtaaaaaccttaaaatttagaaaaaaaataaccctgtgaccttaggttgaaggaagagagggatttcttgaagaaaacattgaaaatactaatcatgaaagatctataaatttgcctgtgttgaaataagaacttttattcttcatgtgatgatacagagtggtggagaaacaaactaaaagtggagcaaatatagtagatacagctttaaaaggatccaggatatataaataattcctacaaatcaataagagtaaagaccactcggctgggcacggcggctcacgcctgtaatcccagcactttgggaggccgaggcaggcagatcatgaggtcaggagttcaagaccagcctgaccaacatggtgaaaccccgtctctactaaaaatacaaaaattagccaggcatggtggtgggcgcctgtaatcccagctactcaggagcctgaggcaggagaatcacttgaacccgggaggcggaggttacagtgagctgagatcacgccactgcactctagctctgtgcgacagagtgagactctgtctcaaaaaaaaaaaaaggcaaaagat

SEQ ID NO: 13634 - DNA, 39480 bp, Human
tgggctgagattgtgccactgcactccagcctgaacgacagagtgagactccgtctcaaaaaaaaaaaaagcaaatatttattatggggacttctgtctattaaaaccattacaatgtgctgataccacatgaaaaaggaatgtaattactgtgcctctggtgtggctgggttcagttaagaattaattattttaatatgtttctgcaacacctttagctttctcttttcacatgtcctgggcttcaactatcacccaatctgatgactctcaaatctgtaacgtcgtcctagtcctttttctttagttccaggctcatccctctcacgatctactatatctctcacttggatgtcctacaggcattttaactcatttttaaaaagctacacgattgaaatgttttgagttattttaaattcctctgtcatctcactaaattggaccaataattgtttctcaaacatgttctttcctcttcatttccactgcagatgctttcctaatttagttcctggatcaccacagtatcctcctaaatggatctcactgccttccatcctccttgatgctacctgagggcttttctgaagacactttttctttttccttttttttttttttttgagacagggtctggctctgttgcccaggctggagtgcagtggcgcaatcatggctccctgcagccttgacctccccagctcaaggaatcctcccacctcggcctcccgagtagctgggaccacatgtgcgcgccatgacgcccggctacttttttgtatttttggtagagacgggagtttcaccacacttgtaattgcaaaattgccctgaaatgatttttccattctcttcccgacaaaatccaaattccttagctagtcattatctgaccttggccttccctccaatttcatctccccagctaaatccaaagacagataatttgccacctagcctaatatttaaaagagtacactggcgttagcctgccttgacttgaaatcacagaacctacttcacagggattaaatgaactagtacacatataaagaacttatgtcttgcctggtacatcatgtggtaaatattagctattcttcttatccaccctctcaactcatgcatttgcacctggtggtccccttgcctggaatattacctctcaccatccatctaacccctgcttctctttaaagattcaatccaggagtcagattcctagcaagtttaccctgccccacccttccatctcgttagtctccaccgcttcctattcaaattattgtttgcgtcggtcactagaccgtgaacttcctaaaggagggatagtgtcttcatctttttggtcaaaacctaaagacaggtgcacgatactttctgaatgactgcacagaaagcgccccatatgtaattaagtctgttaataaatattcctaaacgttattttgtcttgtgtgtagacctgccccgaatacagtacaggagcatcttcaaagtacttccagtgggtgccctggacagcagctaagaaccccggggtaaaacgagtttcctctctactgttacaaatcagaaacctcctccgtaaaagcctcagatctgggaaacgcggatgcatatgccaacttttgagtctcagtctgcgcctgcgcacgtgacctctacacgtctcctctgcgcctgcgccgctcaagttagcgcgaggctactcagtcgagggtgggactacgcttcgcgttttgggattgggcgctgaaggccaaaccggacgacgcggaaatgacgtcacgccgggggccctgccgcgcggtggctgctgggtgccgcacgccttcccatcctcctcctctcccctcccccatccctccccgccccctcggccgctccgctccctggcgtgactcggcactgagagtcccgggagaagactcggcggtcgccacctcttctgtccaggcctcggccttcctgagtatctctccttcctctcccagatcgtcttctccttcagtttcaaagccagtggcgtcgcggccaccctgccgggctctctgtgaggatggtgggggtgaagcccgtcgggagcgacccggatttccagccagagctgagcggcgcgggctccagactcgccgtggtcaagttcaccatgagagggtgaggccaagctcgagctctgtgggtccccgtctgtccttccttgctttcctttcactctttgttggccctggtttcctagccgtctgctgccccggagtgtccggcagtcgccgcagccccaggagctgccggaattaggcctcgtttctcgggtgtgaacccccatttatgcacaggggttcctagacgggctcgggggcctggctggccggcttctccagctcaggagatttctcacctgctccttttcaattctttgacaaactggttttgggggtggcccgcccctattccttccagcctgtgggagtctccgcagccacccttgcctgagcctgaccccttctttctgcagagccagctgtcatttgcatctccagagctccaaaagcttaatttaccgaacactttgtttctcttcaccacctacatctctctaaagcctttgaagattcagatggggcgatctaactaatatgcgtagctctgagtcctgaatttctgctaatgcatttcgaactaagttaacgttgggttagggtgctttttaaattatttgaacttttttcttcctcgttcggccactaacttgtagcttaggctcccctatgtatgcgattgcaactggtcacacacgacagtacatatataatatatttcaggtggacagttggccggatgtcttagtttgacccggctctgttttttcacttaagaggacagggatcttgaaaaatgttaactgtctttggtaaatatcaacaaaattataggtcgtagaaaaggtggaccttttatagtggatgtgtagtaaagttcctttgtaagaatgacatgttggaactcggcgttgagaaccaagatttcagcgtgtgtgtgtgtttcacagatctctccttgtgtatgtcgatagtatttagttagaagtatgagaggtttccgctttattttccttgaccccttggcgttatttatacatctaacttggagcagtctactgctggtatcactgtttatgtaacacactttcttgtccaaataactgtataaacacaaaattccattttgaatttcagagcaaaaaacaaagtttctactagatggttcactaaatgttgagtatataaatggtggcattaggattatatcgttttagggaatggatgcagatagatatgaaaacaagttaagacttatttttggaccagtctctcttacactgaattgaaaaaggatagtaccttgcatttcatatggtgggctagagtacccatatgatatacggaattttgcatttactaaatttaaaaggataagtgatgtcatatatataaaacacctaaaaggaatgttagaattctataaatgtgtcttctcatttttagcaattttgtgatgtctgtattcttaataataggggaatacctgtagtacattaagtatctaggccacagtagaaaagggaagataggatttcaataaggaacctcacctcacttttagttcacttattctaattctggcccgtcgaagcttttatatttttgtccctcaatgatatattgtttttctcccttaccatagcagtgggagagataataaaataataaataaatattgattgaagtgagaaaactggggaaacattgctgcgaaggaaggttttttctatcagtgtggtgtcacttaagcataagcataactgcagacattgattggtaaggaactgttacatttaaaaaggtattttagtggaattaaaattttttttctttgtaaaaaccgagggaaaattaatgtttggatttagagtaagttcaaaagcatatttatattacgtttacaaatctggtaagattattgtatttacctttaatattcctcgaacttattggccattaatacatcctgtctaaactcattgtcaatagaaccccagaattatgtatatgacgggtcagtattagactcagaaacaactgtattcagtaaaatcttgtaagaatcctcttagatcaaagttaatgctgtcccagtttagactgagggcatagtttctccagcacctatttcatttcctttccaaccctattttaaaccttttttctttttttttaacctctatgctttatgcactctcagtctaaattttactaaaatgatacatagattgttctcctgtgtaagaatctttagtggcttatgataaaatatatataacataaaattgaccatttagccatttgtaagagtataattcattggcattaaggacagtcagccctctgtatccatggattgaaccaaatgtggatagaaaatatttggagaaaaaaaattgcatttgtgctgatcatgtacacacttttttcttgtcattattttctaaacaatacagtataacaactatttacatagcatttaccttaggcattataagtaatctagagatgatttaaagtatatgggagaatggtcgtaggttatgtgcagataccatgtcattttctattaggcccttgagcatctgtgatttagtgtcttgctggaggtcctgaaactaatcccccagatacccagacatgactatacagtcacaatgttgtgccaccatcaccactgtttcctataactttagacagaaattctatatccattaaaggataactccccatccttacttctccaaagggacaaaactgtacccattaagcagtaatttgcccctccccatctacctccttggtaacttctattctgctttctgtctctatgaatttgtcaatttgtggcacctaatataagtgaaatcgtaacaatatttgtccttttgtttttgacttcacttagcatagtattttcaaggttcatccatgtcttagtatgtctcagaatttcattcttctttataactgcataacataatccatttatttatatggcaaattttgtatacctgttcattttttgatggacattccagttgtgtcttcctttggctgttgtggataatgctgctaggggacattgctatgcggggatctctgcttacttgcttgcttttcttttttcttatttgttagagacagggtcttgctctgttgcccaggctggagtgcagttttgagacgatggctcactgcagcattgaattcctggcctcaagcaatcctcccacatcagcctctcaagtaaatgggactacagacacataccaccatgcccgctaatttattttttgttttagagactaagtctcactttgttgcccaggctggtctaaatcctggcttcaagcgaccctcccacgtcagcatcccaaattgctggggttacaggtgtgagtcactgcgctgggccttctgtgcccatttttgaattgagtggtttgtttttgggttgagttgcaggagttctttatatatgccggatgttaatatttaatttgcaaatactttgtcccattctttgggttgtctttttcttgatggtgtcctttgatgcatgagttttaaattttgatgaagtccaatttatctatacttttgttgcctgtgcttttggtgtcatattcaagaaatcattgcaagattcaatgtcatgaagatttctccctatgttttcatctaagagttttatagttttagctcttaagtttaggtccttgatccattttgagttaattttggtatatgtcataaagttagggtccagttcattttttggcatgtggatatccaatttttccaacaccgtttatcgaaaacactgtcttttcctcattgaatgatcagcacccttttcccagagtattttttaaggattaaaatagtcaacgcttacatattccttagtctgtgtaaggaacttgtttaagctcttatattgactcaattcattcctcagaataaccctaacagctatccttgttttacagttgaggacattgagtcacagagaggttaaataatttgtttaaggtcccgttaataaatgcatcgtttgaattataaagtgctgttcttgatctttccagcctaaggagaaaagaaatgcacgttcatctctgtgtatctgcacagagcctgacaattttcaatatgcctttccttaaataatttacacctctgcctgcaattcatttcactctctgatattctttttggtaatatttttaaacagtgtctccaaattgttacttatgcccagatacattttagtggttatgagtagtaccagttttgttgttactaaagagttaaaagaatatacattgtgtcgttcgttgtccctggtctcccccctccccaccattaaacagtgtgaatgattttttttttttttttttttttttttgagatggagtcttgctctgtcatccaggctggagtgcagtggcatgatctcagctcactgcaacctctgcctcccaggttcaagcaattctcctgcctcagcctcctgaggagctgggattacaggtatgcgccaccacacatggctaatttttgtatttttagtagagacggggtttcaccatgttggtcaggctggtctcgaactcctgacctcgtgatctgcccgcctcggcctctcaaagtgctgggattacaggtgtgagccaccacacccagccaatggtttttatcttgaattgatgaatgtatcacttttgtagataatgtttaccatgcactgattttttttttttttttttttgagacagggtctcgctctgttgctcaggctgcagtacagtgatgtgatcatggctcaattgcagcctcgacctcctgggctcaagcaatcctcccaactcagccccagcagtaatcggaactacaggcacgcaccactatgcctggctaatttttttttttttttttttttgagacagagtctcgctctctagcctaggctggagtgcagtggcacaatctcagctcactgcaagctccacctcccgagttcacgccattctcctgcctcagcctcccgagtagctgggactacaggtgcccgccaccacgcccggctaattttttgtatttttagtagagacggggtttcaccgtgttagccaggatggtctcaatctcctgacctcgtgatccgtccgcctcggcctcccaaagtgctgggattacaggcgtgagccaccgtgccctgcctaagttttaaaatttttgtagaggtggggttttgtcgtgttgcttaggctggagatacattgaattttcttaaagcagatctgcctttgtagtttgttagggtttgttacaatctaagaaggatgtcagtgtatattaggatgttgagttctaatagttacaatagcttgtccaaataattgtatattaaacatatgttaattacataccgcaaaattactgataactgaaggaagtttattgaagtacagagtaagcaggcccagtagtccataggaaccaggcagaaaacgttagcaagtagctgtaagactagggcatattgaagccctggagaacagagttgctttatttgttaactttttattgaagtgcaaatatacaaaaatgtgcaagaaatagatcattaactccggactcctcgcactgtcccaagcttcttcccactactcttgaattctaacactatagatcagttttgcccgtatttgaactttatagaaacagaatcatacagttatgtagtttgtctggctacctttcaagagtgttaacacagtttaatcttggcaattgatttggaaataacaatgaaaggcactgtgtaggacattgttttggactttttagcatagctgttaagagttgggttctgggatctaatttaaacttactaatttgttgttttttagagtcataaagcttaaatgaggtgacatgagtttgtgaatgcgtaacatacagtaagtgcccaatgaatgctagctgttttatgtaattaataataccaattgtgattaagcctgccgattagtaaacatagcacatgtataaattgcttaaagttttaccctgcaggaaaaaagaaaaaaaaattctttaactgtggctttagaaagcatattatccacttaccagttgtgtatattgacacaagttgttgctcaagataagacacttatcttgaagggaaggacagttagctagttcatgaaatggaatttgttttatattatgactgtagtaaaaagtgtattaaaaagaagctaatgctctttcaaagaaagctgatcttggattatatttatgaattgcctgttctagtggtggccctgccgccaactaggatgtttggtgttgggcaggtcatcttatgatcttcacttcttacttactggttaattatattaggttatgtctgttttaaagttttagttttgtgggttcctttttttttttttttttgagacagagtttcgctgtttttgcctaggctagagttcaatggcgcaatctcgtctcactgtgacctctgcctcccaggttcaaacgattctcctgcctcagcctcccaagtagctgagattacaggcatgcgttactaggcccagctaattttgtatttttagtagagacgggggtttcaccatgttggttaggctggtctcgaactcctgacctcaggtgatccaccagccttggcctccccacagtgctgggattacaggcgtgagccactgcgcccggctgggtttatttctttatacattgtagaaagctagcggtttactgtattctttttctcaaacagcataactcaaaatccttctaacatacacattttatatattggactaagcagataagttttcagtcagaaggtttagagtagaaaagtaactttttttttttcttcattttaaatgtctggactaggtgatctcttgaaccttttgcagtgaaataagaaatcgtagattgtgcaaagggcagctaatcaaggtgtgtgcaagagaaaaaggtgtaattctgaaattcaagcatactgggtgcataatattgtagagctgggaaaagtccttggagagtccttttattttatacagagaaatcaggtgacttgttcatgatctcagctaatggaaatttgtttactctcaactgctcctgttaaggagacagacatcttatgtaaaatgatcaattggctgggcacagtggctcacacttgtaatcccagtactttgggaggctgaggtgggagaatcacttgagtctaggagtttgagaccagcctgggcaacataggcagacctcgtgtcttcaaaacatcaaaaattggcagggtatggtggcacgtgcctgtagtctcagctgcttgggaggctgaggtggaaggatcacttgagcctgagggaatgaggctgcagtgagccatgattatgccactgcactcaacctgggtgacagagtgaaaccctaaaaaaaaaaagaaaaaagaaaatgatcgatttatttgaatgattgttttgtgaaagtgtgctgctgtatatatttgtgagtttgtatatatttatgcttctctgctgatgcattttgatttttgaccaaagttccaacctctgatggctaactgaaattaaagaatctagataaagttaaatcttgaaacagttttttgcacagtaaccataattttaatagtctgttcagctgcaagatgtgtgtctgtaacaccagttagctcgtaaataattgatgaatagagagatgtcaatgtgatatggaagttgtattggttcatgtgtgattattcctaggtagtgaaaaatagaaataaaaccttcatctggaagcagaaagctctcagccacacaggcaaattccctctcttgtttattttaagaaagttaatgaagttaaataagagtgcctacacctagcgtttgttccccagaagggtttattttcagtgttgcattttctcctgtcccttccttaatggcagccccactggctcagagctccacttcagtctgctttgtcacaacacctgtaagcatcatttccagttgattttgttcttttcaaatattccccaaggtcgcttccagctctgagccacatgctgggatgtccatctttttcctgaatcctagttactgtctttttttttttttttcttttccaagttggagtcttgctctgttgcccaggctggagtgcacgatcttggtgaccttggcttaactacaaccttccgggttcaagtgattctccttcctcagcctcccgaatagctgggactataggcatccgctatcacgcctggctaatttttgtacttttagtcgagatggggtttcaccttgttggccaggctggtcttgaactcccaccctaaagtgatccacctgccttggcctcccaaagtgctgagattacaggcatgagccatcatcgggcccagtctggttactatctttcttactgatcttgttacaaaattgcatgggtttcaagtagtttgccaacaaacttatttttcccataaattctctctttttggtgtgtgtttttgcaggagggtggttttcatgaatggatatattgtactatagaatggatacctctgtaatttgtgacacctgtgtaaatgcagttaacactaaattcttctcaactcatttaatattttaaaatgaaaatacctattcatcacaaaaaagcaaaggatgcagaattatggatactaactgttcattgtgcctgtctctgtctttttaccccctatgcatttatatatatacataggtttgaaatgtgatcctagagaacattttataatgagactttcttcccccctaaacactgcaaagtatcaggctggggtgcagtggtgtgatcttggctcaccgcaacctccgcttcccgggtgcaagtgattctcctgcttcagccttctgagtagctgggattacaggcatgcgccaccatgcctggctaatttttgtatttttagtagagatggggtttcaccatgttggcctggctgatctagaactcctggactcaagtgatccgcccatcttggcctcccaaagtgctgggattataggcgtgagccagcgtgcctggcccctgtcataactttttaaactagttttccattaattgccatttaagttgttttctaactttactattacaaacatgttacattgaacttccttatactacatgttattgtgaaatagagtaagtgttgttaaaatggaatagactttcaaaagggcaattattgggtcttggcttgtgttcatctaaaatgaatagatatgacccaatcagtggcctttgaaaaacagtgtagtgatatatattcccatttataaagtttaagactaattttagttgactgtaaatattattttcttagatttttggtgtatggctttcaggataacacaaggtgaaatgctgattgaaatgttaagaatgtggagttgatcacaacttgagttttaacatttgtttttattttgtgcattagatttgctttttcttgcatttcttatttctgcaaacttttattgagacatacatggcacacaattagaaatgtatagttcaattaattttcacaaactgaacacacctatttaatcagcttccagacaaacaaaacattgctagcctccagaagtcttattctatcagtaactcactaaggtaaccattgtcttgatttctgataccattgattggttttgtctgtatttgaactgtatgtagtcatatagtatatgctagtagttgctttctttcctcaatgttatttgtgaggttcatccatgtttttgcaagaggttttataccagttattttcattattgtgtagtatttcattgtataactataattagcttacccattcttttgttgataagaatttaattgtttctgatttttgactcttagaactattactaataatactttttcaaatgttctaaggtgaacatgtgtcttagatgtattccccaggaattttgatgggttggtgtattttagcagtttggtttttttccctccaaaatggttaataccagcttgcactctcacagtatataaaagtttagttgctctgcattcttgacaatacttaattcttcttgtagctatttttgctgagttggttttaatctgcatttcccgggtatccctgatgactaatgaagtagaacatctttcctgctttatagaaagtttttgactttatttattgactgtttggataatctcatttgtcaagtacctattcaagggttcattctttttcttttgggtttcagtcttctccttgttttgtaggagttctttacgtattagaagtataagtcctttgtttgatatgttttgcaaatactttttcctagtctcttaaagacattttttgatgaataaaaggttttaatcttccagtttatcaaatatagtccagtctgtcaaaccttttttttttttagtacttcttgtgttttgtataagaaatcattgcttagtttgaggttttgaaagtgtcttcctgtattttttcctaaaaccctccttgtttcaccttttacatttagatctacaacccatctggaattggtttttgtgtatggtgtgttgagattcatttcttttcctgtatgagtatatagttgatctagcagtatttattgaaaagaccatccttttcccactgcaatgctacatcaagtttttcagacatcagagtactgtatgtgagatgggtctgtttctagactcttctttcaaaggaaaactgatttgatcattttgcttattcttgtacaagtactatattctcttaataaaggtttatgatagttcttaagatctgataatataattttttcagattagaacctcaaaacgacttgggctgtccttggcatttctctataatttttagaatggaaatttgttaatttctacaagaaaacctgctgagatcttacatcagttgtaaagatcaaattgagtaaaattggtatcttggcaatattgagtttcaaattcataagcagagtaaattcctccatttatttaggttttctttaatttctctcagtgagaacaaagctagaagacttaacactattagttatgaagactaaatgtaacatctgggctcattaagacagtatagtattgatacaagtatatgtaaataacttactcaaatagaccagagaatcaggcctagggttatggttcatgcctgtaatgtctgcactttgggaggcccaaggcaggaggatcacttgaacccaggagtttgagaccagcctgggcaatatagtgagaccctgcttctcaaaaaaaaaaaaaatgtagcttggtagctgggtgtggtggcatgcacctgtagttgcagctacttggaaggctgaggtgggaggattgcttgagcctggaagattgggactgcagtgagccatgatcatgccactgtactctggcctgggttatagaatgagaccttgtctccaaaaaaaaaaaaaaaaaaaaaaaaaaagaccggcttggtggctcacgcctgtaatcccagcactttgggaggggccaaggcaggtggatcacctaaggtcaggagttcgagaccagcctggccaacccagtgaaaccatgtctctactaaaaatacaaaaattagctgggcgtggtggtgggcgcctggagtaccactctggccgacagagtgagactctgtctaaagcaaaaaacaaaacaaaacaaaaaaaacagagagtcaaaagccagcagtatcagtgtttgttctattttatgtttaattgacgagtgctttagaattacaatctttagtgttattttacttaattttccttttctaacaggtgtgggccatgtttgaggattgccccagcattcagttctatgagtaataaatatccacaggctgttttcttggaagtcgatgtacatcagtgtcaggtaagggaaaggaatcttttttctttttaatttacttttgaataaatttgaaatccaacattaatattcttcatttatctcttgatgcacatagtacttattcctttgaagataggaagatgttatgttgatgtcattattacagatgtcattatggctgcattagttaagaagagtagcacattattaattgcttcaggtttgtattaatcaccttctgatataaaattaatacgatgttgttaataggtcacctagcagttctgtgtattacatttccttatgttttgcaaacctagaattatatcttctacccccgaggtattggcattatatagcagtggcaaggagttcttggttgtagtttgaattgatcagtttgttatcttatctccaaatggacacactgagcagaaactttaaaatggtgattattgttgattgagccacagtgttgtaggtgaattgccctgattatttagttggaatggtatgtggcagttctgtatttgtatatgcagaaatgtggggaattgttaagggaaaaaaaaattggaaagctccttccaatactaaaaagtagagtctttagttctaactaaggaacaactctatagctctgcagctttatctttgttaaatttctgagtgtggaaaaaattttagaatattatgtagtgtgtagttactttgggggtttgttgaaaaccctacattacacacatttatgtttcagcacttagttgcatgttattgcactatatcattggcccctgatttaatcactatttctagaatgaaaatgcttttctcctggagctgttctgtcaggtattgtaaccactggctatgtgtggttactgagcactttaactgtgacaaattcatattgatatgtacggaaagtataaaatacagatcagattttaaagacagtataaaaaatgtaaaatattgcattatctttttatgttgattagattgaaaatggatatattagatttcctgtaatattaaacttgattttacttattttgcttttttaatatagataatagaaaatttacaattgcatgtgtagctcacatgtgctacatatccattgttttgggcagcactttcctgaaaggtcatagttttttcacctagaggctttgagaagacattcctgtgttatctttatgttctttttctttaaaaagtatagtagtgactttcataatatttgaatatataaggtgccatatttgctttactgtttcctttatacttgtcatgaaaagcttaaactaggatactcggtggttattaggtaatttccattcagtagttagtcttatacaattgtggagctaggacagaatttataaagatagctgttagaatgtgttttgatgggtgaccaaaagtcatttctgtaagaataaaaattgggtgacggttgcagtgcaaaatacattacatgctctttttaacaggcagattggctaccggttttcagacctgcacttttttctagtagcagtggtttgtgttgactttatcaatacccttcttggttattctttttgagaaatacctgtaattatgaaagatctgtctggcattaagcacagtttctgcattggaagctaatttttctactggatgatgtatttaccagtaaaaatgataaaaacatggggaatgttctttattgtgtgtgtgatggtaatgtagctatgcccaaaggggaactctcttaggaataggtctattttttccttaaataacaaaaatgcagtattttacatgtttttagttcatgcttatggtatttaacttccataaaggtgtagaatgaatattcaaagtggtttaagatttaattcataacactgtccaacttgccaattctagggaacagctgccaccaacaatatatcagcaacacctacatttttgttttttcgaaacaaagtgagaattgatcaatatcaaggagcagatgctgtgggattagaagaaaaaatcaagcagcacttagaaaatgaccctggaagcaatgaggacacagatattccaaaaggctatgtatgtagactgaaaagtgaaatcataatgtataatatcttgtacatgtcattattgggctaaaatgaaatataactatgtttccatcttctatctcttactggtttagaatacttttaaataagagctttcaaatttattagctgactattgagttttgtctgtatgtgtacgtttgtgtgtgtgttaagcctctatcataaatcatttttcctaaatttctcctaattttctttgccactttttaaaaatctgctttctgaactattttaatagccatttaaaaatacttgctttatacttttttttccagaaaatgtagaaatgtgcattagaaatttttttttcactttttgacagttatgtaaaatgacttacaggttttagttatggccattaactccttttactgtcactcacttcctatagttttatctttttaaatgtatgccctcttttctggcactgtatttaaaaaaaaaaaaaagtctaattactgattttgttttagaatcaaatttgactttgttatcacatgtattctaggttttaagagtaagttatttcaaataacaacataaagacttaagaatctaaaggatagtgtgtggaaactgcagagtataaatagttagaatgcagcatttttaatttgagagctattcaagaaggaagcaaaatttggaagtagcacttcatggtattagatttgcttatacaaataggtaaatcttgtatactaagagatatatatagtttttaagttctctggttacaaagttactgcactggcagatcaaagaatgaattttaaaaaaagttacctcaagttaaagttaatatcttttttttttttttttttgaggcggagtccctctgtcacccaggctggagtgcagtggcacgatctcagctcactgcaacctccacctccagggttcaagctattctcctgcctcagcctccccagtagctgggattacaggcacctgccaccatgcccagctaatttttgtatttttcgtagagacgaggtttcaccatgttggccaggctggtctcgaactcctgacctcaggtgatccacctgccttggcctcccccaaagtgttgggattacaggcgtgagccactgcacctagccaaagctattatcttaaacaatgtataacaggcatattaaagcagatctgtgtcatggagctacaagtcctccctgtaagtctaaattcatgccgaatgaagagatgctatagtccaaaaaaaaaaatgagagattctttctatatgggtgtgtagtaggagattgtaagggtgtcagaaagcatcagtaatgtgataccagcattaatttaaggaagtacaattactatttatttaaaatagacctgtaatttgaaattgtaatgtccaattaggaagtatcaacatatcgtttatgtcagggttgttacatcttttggacagttttggaaatcatttaacttgtaaaccattgtgtttatatctttgtatttttttccctttattactaagggtgtttgcattaaaaagtcttaggaacacagcagtcttgttgcctagctacaggcatacttctttacacatccgctgtggtatgagtgttttggcctcagataggaaataggaaaaaatgaagttttaagaaataaaaatttagtttttgtgcaaatgttatggataaaatatgaaaagctgttatttttaaatgtccctttttttctgtcaggtgtcaatcaagacattaaagttttgaactatttaggtctcacagggttattcagtatttaaatttggtaatcttatataacgatgataccattataactcccaagaaatttaatattgatacaatatttctaattatcctacagttaaattttcttaattatccccaaaatattctttatggctgtttcccaccatttaggatcaaatcaaggatcatgcattgcatttaagttgtcctaattaatgttctttagtctagaaacttttctctgccttttttttctgtcatggttttccattttgaaagtctaaaccagcactggtctagtaatatggtagccactaggcacacttgtctattgaacattttgttatatgactagtgcaactgaggaacttaatatttaattttatctaattttaattaatttaattttaaattgccacatgtggctaatgagtatcatattgaatagcatgggtctaggctgttttatttaattaattttttttttttttttttttgagatggagtttcacacttttgtctaggctggcgtgaagtggcatgatctgcaacctccaccgtccccctggcccctgcccctgccgctcgtttgaagcagttctgcctcgggctcccaagtagctgggattataggtgcccaccaccacacccagctactttttgtatttttagtagagagggggtttcaccatgttggccaggctggtctcaaactcctgacctcaggtgatccacctgtctcagcctcccaaagtgctaggattacacgtgtgagccactgcacctagctaggatatctgttttatagactgttgcgtattctggattaacctgattattttcccatgattggcatgttgattataaaggtagcaacatttatttctcattgcaggttttcagaatatgtcagtttccagttatgtcaactatgcaatgtaataatgccagtttgtcccagacagtttttataacaaaataatttaatgcacccctttaaatatgttttgtgggctgggcgtgtggtggctcacgcctgtaatcccagcactttgggaggctgaggcgggtggatcacctgaggtcaggagttcgagaccagcctggccaacatcagaaaccccatctctaccaaaaatacaaaaattagccaggtgcagtggcacactgctgtagtcccagcaactcgggaggctgaagcagaattgcaggaggcggaggttgcattgagccaagattgcgccactgcaactccagcctgggcaacagagggagactttgtttcaaaaaaaaaaaaaaaaatacatatatatgttttgtgtgccccacaataaataaaaacaaaaactatttagaagaatttacccacttagtttatttttatcatttaggtattgcaagtctgactgtaatgttgtcttaatcctagataccatattgaagtgacatatagataggatggaagacaaaaacattttaaagattttgtcaaaactgcccttttaaggcaaatgttcataatgctccgaataattctgctatagtaaaactttgctctgtagcccttttttcttccctccccatcttttaaattggctatacgttaccctgagtaatacatttactataacatttcagctttgaaagcatttaggctgttttatctgtaactagaggtctatactaatgattattaccattttcatatttacttgacatacaaagttttcttcagtctttgagaattatgtatgtatgtatttgtatctttaaaaaacataatgaaaaccctttgagatagagaggtgaacatgtgactcatctataatacttggtagacttgaaaagtaatccttgtttaggagataaaatggatacttttctagaaaaatacacttttaccaaaatcaactctactagaagcagaacacctaaatagaccagcaccatagagaaatagaagaaatagtagtaaagatttcttccctaaaggcttctatgactttacaggtaaatgttgccaaatccgtataaagatcaggtaatctactgttactgtaactacttaagatcttaagtaaaaagaaaacttttaaatttgtttttgaactgtgacattgatctgataatttgacaaagtatgcaccaaaaaagaaagctgcagaccagtttcaattatgaatattgatgtaaaatttttaaataaagtgttagtaaacaaaattcaataatatcatcatgggctgggtgtggtggctcatgcctgtaatcccagcactttgggaggctgaggtgggtagatcacttgaggccaggagttggagaccagcctggccattgtgaaagcccatctctactaaaaatacaaaaagtagccagacatggtggcacacgcctgtaatcccagctactcaggagactgaagcaggagaatcacttgaacccgggaggtggaggtttcagtgagccaagataacaccactgtactccagcctgggcgacagagtgagaatgtctcaaaaaaataataataataataataacaaaattgagtttttttaaagcatgtaagagttgtttatgttaggaaatttacttaatctgtcacattaatagacctaaggagaaaaatcatgatctccaaatatgcagaaaaggcatttgacaaaatttaaatacccctttattcctaaagcattcagtaaaatcttaataagggaacattggaagcattcctactaaagtcagaaataagacaagcatgaccaaccgctgttaacacaactctgatgtgtgggaggttggaagtgttagaataaagtatacagagatgggcatgtgctgacaccacagggaagtaaacggtaaaatccaaagtattgagaaatctataagctaaatgactagattaaaagagatttcagagacatattaaccaaatacaattttttttttttttttttttttggagacagagtcttgctctgtccccaggctggagtgcagtggtgtgatctcggctcactgcaacctccgcctcccaggttcaagaagttctcctgcctcagcttcccgagtagctgggattataggtgcccgccaccatgcctggctaatttttgtatttttagtagagacagagtttcaccatgttggacaagctggtctcaaactcctgacctcaggcgattcacccgcctcggcctcctaaaatgctgggattgcaggggtgagccaccccgacccggcctccaaatataatgtttatactttttttttttttttttttttgagacagggtcttgctctgctgcctgggctggagtacaatggcgcaatttcagcttactgcagccttgatttcctgagctcaagccatcctcccagctcagcctcccaattagctgggactaaaggcacatgccactgcacccagctaatttttttttttaagttttttagagacaaagtctcactatgttgcccaggctgctcttgaactcctaagctcaagctgtccacccaccttggcctcccaaagtgctgggattagaagcatgagccatcgtaccaggcctttttctttttatctctattattggtgtatacttttttggatctttattctgcgtgtaacaattcaagtgtgaaatatttatgagacagtggaggaaatttgaccactgatttgatggtgttaaggaattattgattgtgataatgatattgagaatgtttttttttaagttcttattgcttagaaattcatactgaaatgttcatgaatgaaatgaaaagatgcttttttttttttcaaactaatcaggaggagagttaggatgtagttgggggttaaagatgaggcaagagtggccttcagttgatgattattgtagctggaggtggtggatacatgggatttactatattattatatttttgtctgtttgaaatttttcatgataaaaactttaagtccttatttgctactcatcttaaattggacatcttcatagatataaagagtccttgaccactagaagagggaaataggctttctttggatcttacggatattttaatttgcatattttcttctgtaaaacacttattttttaaagtataagtcaacattttataatcttaaagacatcatttctgataccttatcaagtaggctaagcctagacttggctttaataattgatggtagatctcagtcagaaatgcaaatgaaaggactactgtaaaagttttatgaactgttttaaaagtgttttctttaaaattgcctaaagagaatcagagatttaaattttttaaatatttttatacctaatccaaatatgttgcctaaaatcttgcaattttttttcagatggatttaatgccttttattaacaaagctggttgtgaatgtcttaatgaaagtgatgagcatggatttgacaactgtttacgaaaagacacaaccttcttggaatctgactgtgatgaacaggtaattgagggctgaagataagcttgtggagattatcactatttatgcctgctcttgtttcttgttcccattttgtggcttacgtctctccttcccagatgatcacttcttcctttcatttctatagcttttagtttctttgacttttgttttttgaccatacatacccaccttctttgttcttgtatgtgggctgccaggtgcactaagaaaaattgctgaactcttgggtgggacccactgcagaattgagctcttaccactgtttggtctttttgttcatccttaacctgacttccataccttcttcccactcagatgaatttgtatatgagaaatagagactaatgaaatgagcactccctgtgtggctaattcctttctcctagatagaaacctgtattatattccctatgcttccctgccttgcccttatcacaaagtaagttgggtgttaccaccttgatcaagctttttaaatcttcattttggctgttacttttctcagtttactttctcttccattgtcactgatttgtcccattccagttcatcttctatacggtaacagaagttatttttctaaaatataaagttgcatgtttccattccttagaagagtaaaatgactcttcactggctttaggaggaggctgacttgatctgtttttaactttctcatctcttctgctcttcacctacagttcagttccctaataatgtcatgcttattattttttgatacactattatgggtcaagtataaaaagtattggtgtaactaaaggaaatagcctagttattttcttaggcagataaaccacaacatgattctgaaatcataaatccaaaccccatctttccatgctgtaaccccagagccaccatgtttttcagctttgagagtatcattcacattgtgtttcttgtaaatggtgccctaaaaataatgtaataatgctaatcagcaggactggttcaggcttcatgaaattttcctgctcaggaaatcttcccagggtagatgcataggtacgtacatcaaacacacttttggctggaaagaagattgagcaaatgatccagaagagtttcggagagagaaacattctgacagtgtttcatattcctcttcccttatgtggccttccagattcagtcagtcaagtaaatgtagaatggaagtttggaggttacttcagagctgtaagaaccctattctcttgagtttgggattagagtccatttcagggctagtctctgcataacctgtgtattgcctctaaatcgtcaagtgatgtggatagatacttgacaaataaaccatcgtagagctatgtgctaaaatgttagtttaaattttattttgagaattttgtttgatttgttagaaagcaggttgcttgccagtttatagctcataagaccttacattcctatgcatagttttagtatttacttgattaattttttcttgtattcccttatatacataactaatagtagtagttctcagatgttatctaatcaagtgactctccacttgctgatttttcatattacgttggttttgttcgatgaattaggttggttttttttttcttgcctgttattttcattctgcttcagtagtttatgtactcaaggtgtgtacaagagccctttaaaatgaaactcttatcttcacagctgcttattactgtggcattcaatcaacctgttaagctttattccatgaaatttcaagggccagataatggtgagtaaaggatagcttttctttaaactaacttctgctttgtagaactgttagcataaaattaaaactttttattaaatagaggtacttgttttttctttttttttttttttgagacagagtcttgtgctattgcccaggctggagtgcggtggtgcaatcttagctcactgtaatctctgcctcctgggttcaagtgattctcccacctctgcctcccaggtagctgggactgggactacaggcaggcgccaccacgcctggctgatttttgtgtttagtacaggatttcaccatctgttggccaggctgttcttgaactcctgaccccaagtgatccacccaccttggcctcccagagtgctaagattataggcatgagcaccgcacctggcttgttttggaacgaagcaagatgtaaatgaatgagtaaataatgtgagattattaggtactgaaagtatgaaagaaagagaacttagttatttttatactttttcattttaaaatttgtttccttttaatctgagaagtgctgaatccttttttccaactgttctaaaactgtagcttttgagcagccgtattttagaatcaaaactgaaagatttatttcaaattccttttattttgaggaaactgaggctccagatattcctgtttgtgccctattaatagtatcatttttttatatcgatacatgtaaatatgattgtgcagacttaggatttctcttcttgtaaaataaagaattttccttttttgcccccccccattttttctttttctgttaagctttttctgagggggaataggggaatggagactagggttctgatttttttttttttttttcgattgattggaagaaataaccaaggccttatttagaagatagcattttcttatttgttctgctaaattttcatgttaataatttttattaataaaattgtacttttactctgaaattacaaagtatttgtataagcaaatgctgtagaaatgagtcttacttttccttcttcagccacaaaatatgggtcttaaatcgtgccttgaagttaaagggattaaggcattctatacatgggactttaccacttatcacatcctaatctaatccctaaaatgaaatttggcaatttttattaattttcttttggctaaatgttgtcactgataatgctctcctcctaaataactgaatgtaccaactattggcaactataagatctagctcaaatgctatttcttttatgaaactttttgttaacctgcatatattgtcagaatctattgtcaccttccttgtacctcctctcctgtggtattttgtttatcgtagcatgtcttttgtagttggggggcagggactccctctgtgtgtgtgtgtctgtttaaatcttatattcctaatatttaccacagtgttagctcggccaagaaggaaccagtaaatgtgttttggaaaataaaggattggctacctgaatactcagacttttgtacaagttctaataatggagttatttgaagtatatgtgtattgatttgtgtgtgtctgtgtatagtgtgagtgtagtggtaaagggagtatagtatatttgaggtttttaaacattttattttattctaccattgtataggtcagggccctaaatatgtaaaaatttttatcaacctaccccgatctatggattttgaagaggcagaaagaagtgaaccaactcaagctctggaactgacagaggatgatattaaagaagatggcattgttccacttcgttatgttaagtttcagaatgttaacagtgtaactgtaagtagtatttcgttcatatgtatttaataggtttgtgagtaacaatactattttcagtatcctaggtaagtctaagtgattctttaaagtggtatttattcactcagtttgaaatgagtaaaatgtttaatgggataaattttcttctttttaatttatgtaccctaaagaggaaggacagattgatttttgaatatttgtggggttttgtcagttattttatatgtatatggtaagttttgctggaagtttattctacaactttatactaaaactgaagatatttgtgctttattctttatacctggtatagtagtgatgtgtttgtaaaatcttatttacttttcttgaatatggagtttttaagtgtggtggtcatgatcttagtaaaaatgactttttatttatttatttttttttgagatggagtctcgctgtgttgcccgggctgacttgaactcttgggctcaaataatcttcccgcctcagcctcctgagaagctgggattacaggcatgcaccactgcacctggcttaaaaatgacttttaaaaagataatactacattttataagatgacctaaggtatatctgaattttttcttcctttgaggcaggttcttgctttgttgtccaggctggagtacagtggcacgaccttggttcagtatagccctgatctactgggctcaggtgattctccctcagcctccagagcagttgcaaccgcaggcacgtgccacctcacccagctaattttttatttttgtagaggtgaagtctctccctgtgtggcccaggctggtctcaaactcctgggctcaagcagtcctcccacctcagcctcccaaagtgctgggtttataggcttcagccactacacccagcctttctgaagattgactagtgcttgaggtgattttaagtgatgtattttagatgtcattattaaagtgccactctcaagaatcagctaatttttagcagttattaattgcttttaaaaaatttagcattgaaacccagctcacacttctcacctacagtcatttagaggaatgggtaggacagttagaaaagaatagcagaatacttagaaaaagaaagtaggaaccagcacagagccactgagaatgtcatgccaaactggtacagcttgtttgttgtgatggaataattctatttttgtaaattagaagaatgctaaagtatgtgttcatttaagaatgtttttgagagtttcacagaatatacatagtagtagtatgaagaattataattggctgggtgtggtggctcactcctgtaatcccagcattttgggaggccaagatgggcagattgctcgagcccatgattttgagaccagcctgggcaacatggtgaaaccccatctctacaaaaaaatacaagaactagctgggcatggtgatgcgcctgtagtcccagctactctggagggaccacttgagcctgggagattgaggcttcagtgagctgcagttgtgtcattacactccagtctgggtgacaaaaaaaaaaaaattataatcaagttgagttttaagtattagaaatatcctacccaaatgaaatcaaagaaaattgttatattaaacttagtatactcattatcaaatattttcttgaaataacatatggctgcctatgaaaacaataaaaactgacgaatgagtggcatctcagaatgaaagaagtatgttgtttaaatcacgagaggcagtttttaactggtcatgggagtacgctggtagtcccagctacttgggaggcttaggcaggggcatcacttgcactaaagagttcaggaccagcctaggtaacataatgagaccttgtctcaaaaaagagataggtgcaatattttaaagtagacagcacctagaatattgtgtttttagaaatggagcaaatttcaaaaatccaatgtatgacaaaggatcaatgagtaaaacttttagtttttatcgtgctgaggggagttattaaatatagagtcaagcttaaaaaaaaaatgaggcacatagtattgttttaggagctgattcccaatactattttttcttttaatattctaggaaatagaatggatacaggaatatcagaaagaatatcactttagagattttcctcagtgaaaaactatgattttaataaaatttccaatgatagtctgtcccattgtaattgtaactcttaataccctttcaacattctctataaagaatttaattgctgggcgcggtggctcacacctgtaatcccagcactttgggaggctgaggcaggaggattgcctgagctcagaagttcgagaccaccctgggcaacacagtgaaaccctgtctctactaaatttaaaaaaaaaaaaaaaaaaaaaaaattagccgggcgtggcagcatgtgcctgtagtcccccctcctcaggaggctgaggcaggagacttgcttgaacctgagaggtggaggttgcagtgagctgagatggcaccactgcaccccagcctgggcaacagagcaagactccatctcttaaaaaaaaaaaaaaaaaaattagccgggtgtgctggtgggctactcaggaggctgaggctggagaatcgtttgaacctgggaggcggaggttgcagtgagtcgagatcgtgccattgcactccagcctgggcaacagagtgagactccatgtcaaaaaatacatatagagagagaatttaattgtgactctgccatactatcacaccaagttaccatgaacttatatatatgggtctcttgccatgacatctctggagaaagtgagaatagcagggcaaacagccctataattagtagtcctatcctataggagtactagtcttaatgttatataattttgattaattttttttttttttttgagccagagttttgctcttgttgcccgggctggagtgcagtggcacgatctcagctcactgcaacctccacctcctggattcaagcgattctcctgccccagcctcccgagtagctaggattacaggtgccagtcaccacacctggttaatttttttgtgtttttagtagagatggggttttgccacggtggccaggctggtctcgaactcctgacctcaggtgatctgcccacctcagcctcccaaagtgctgggattacagacgtgagccactgcacccagcctagattaatttttacaaagaatggagaatatttatgttattaatttaaggaaattgattaaacttaaagcatgtttgtgaagaaggattgtaattataaatgcaaacttttttttggtagatatttgttcagtcgaatcaaggtgaagaggaaacaacaagaatttcatattttacttttattggtactccagtccaggcaacaaatatgaatgacttcaaacgagtaagtttgcttaaatgatacttcgggatagtaaaaatataattttaatggaataatttcatgtatctcaactgtcacactttcttttaacaaaataattcaaaattatatcatgtcatgaaattttacaaggctaaactaggatagaaagttcccctaactatatttttagatatccaacaaagtaatctttaataaaaaatgatgtcttaactgataaaagagtcttttaatgaatgacatcaacataagggtaaaaataatggcttggttatagaaagtggttagtaataatggaaaaatgaaagtaaaatcatttgaaagcagttgtgagaattaaataacttagttgatagtaagattctggtgattatttctgatgaaattttaaattacttgaataattttatttaaaaaaaatggactgagttttaatatactgacatgttaactttccaaaccatgtttgtatgctgaaatagcacatttcatcaaataatgatgaacaggcaagttttctgaagtatttttgtatatctttatgtgtgtgcatataattttcttttgaaaagacacaattataaggtttgtaaagaattaatagggtacatgggacctttgttaatccagattaattccttctgtacattactggaacgacttctaatgggcaacagttccctagcgtcactcttaaatatacagccagagattatcaaagtgctactgagagctttatcagtacagagcgttagttgctatatactcagtttaaatgtggcagcacagaatacataggtatcccactgtctctaatgattgcatctggcaggcagtctagaacttgaggaagagtttccttaggcctggcaattcctagatgaagaggctcccaagagacccttgttgtggaattgaagatggagaacatcttgagcactctcattctttttggtggcatctacagatcttactttaattcaattatagaaaaatgtattagattgcataacagaggatgatcttacaaaattgtatgctgtttttaccaaattgcaaacctggacaataggtattttaactggttgttttccaattactattttcctgtctcatagcgtgattaccttttggggactgcaggaataattatgcactttagagctgttatgtctagatgtttcacatatgtattatgacaggtcagaagaagcagagattaagcatctacatttttacgatatgaaatatgttttattgggaaaatgtgtgagcaacaaagacgtcttggctgcctgctttacctttttgaattagatgccattggacttggctttaagtgtgccttgtgtggtttattcttaacttagttttttataagatctattactattatcttattattttctcatatcattcattaatttggctctagtttcctgtttcttacctcagtttatgctatttgattttcatttttttctgtaaccaccattctatcttgtttaccttcttaccagctagccattcagttaaagtttctctaatttgcatgaataattatccatctaactatctgcctccacctcgtgtttaacatccccctcacatcccttctagcctagtattttctcttttctgactgtcaaactacgtttttgggggctgtctttaggatagcaaaggtgtaagaccttttttgtttgagagtatttgtgcttgttttataacagccatttattcatttgattttttttaactttaaattaccatatggtagcagttctcaagctttttgatctcaggacctctttatattattaaatactattgaaggccaaaaagaacttttgtttatgtgggctatatttatctgatatttgccatttataagttaaaagtgggaaatataaaaaatatttgtaaataatgaacacatgttaatgaatatttttaaattagaaataagcatattttctaaaagaaaaaccaatttggtaagaagagcattgattcagaattttatgatttttttttttttttttttgagacagggttttgttctgtcacccatgctgcagtgcagaggcacagttatggcttactgcaacctcaaactcctgggctcaagtgatcctccagcctcagcctcacgagtagctgagactacaggcgtgtgccaccacactcggctaatgttttatttttgtgtggggacagggtcttactatgttgcccaggcttctctgtttacgagccttatagtgtcctttccttctcatatctgcttctgcattcagtcagctttcctgtcacacatcatatagcccctggaaaactcccctggatacttgtgaagagaataagagtctaaaaggcaaaaaacgatttagcattatgaaaatagtgttgacctcccagactccttgagagggtcttggagaccacactttgagaactgctacaagaataatttgaataccataatctactcccttgttggtgttctgggcttcttagccccttgcttttaatgtttaataaattttagttgattaagtgattttcttaggtatattaatattgcattttcttgtaatatttctgaatgacatttgtactgtagttattctttgtcttttagggttattctttaaaagtaagctagtatttcattgtttttatattgtacaaagtaacaacttcaatgtagttaaaaaaagaaaaagagggtttacatgtaactgaaattggccagcttagtccttgtacagatagatttgcttattaaaaattataattgagtttggttttcattgaaggaaataatatgtggtatggtatcttttgtccctgtagtacgatgctagtacaatagtctctccttatctgtcggggcggggggatacattcttagacccccggtggatgcctggaaccacagacactaacaaaccctgtacatactgtgtattttcctatacagatggttcccaacttatgatggttcaagtttacaatagtgcaaaattgataatgcactcagtagaaaccattctcttaagtgtggggcagttaagcatttttgacttacaatattttcaccttacaatgggtttacttatttttatttttttgagatggagtttcactcttgtcacccaggctgtagtgcaatggtgcgatctcagctcactgcaacctctgcctcccgggttcaagtgattctcctgcctcagccttccaagtagctaggattacaggcgcctgccaccatacccggctaatttttgtatttttagtagagatggggtttcaccatgttggccaggctggtctcaaactcctgacctcactgccttccttggtcttccaaagtactgggattagaggcatgagccaccgtgcctggtctttacaatgggtttaatcgggatatattaccccatcggaagtcgaggagcatctgtacatatatacataccgctgataatgtttaatgtataaattaggcacagtaagagatttaacaacaaagccagagcatggtggctcatgcctataatcccatcacttccggaggccaaggctagaagatcacttaaacccaggagttcaggaccagctggcaaacatagtaagactccatctctatttaaaaaaaaaaaaaaattacccatgcaagacggtgggtgcacctgtagtcccagctacttgggaggctgaggtgggaagatcacttgagcccaggagttcaagaccagcctgataaacatagtaagattccatctctataagaatacacacacacacacacacacacacacacacacacaaaattacccaggcaaggtggtgggcacacctgtagttctagctacctgggaggctgaggtgggaagatcgcttgaaccctggagttcaaggctgcagcgagctaggatcacgccactacactccagcctgggtgacagagcaagaccccatatcaaaaagaaagaaaaataaaaaagattaacaccaactaataataaaatagagcaattacaacaatatactgtggttaaaagttaacatggatatggtctctcccatgcttgctctttctctcactgtctcaaaatatcttattgtactgcaccataggcagttgaaactgcagaaagtgaaagcatggataaggagggactactcttcagtcatgatctctgtctacagcagtttatattcttgtagataacatagggacaaacatagggaaagttaatcaaaattaatcaaagcttagttcaagggtttctttgtccacagagtattctcagacgttaccagctaggtgacttttccttttcccccaacgactgggaaagtctgagaatactttgtgaagaaagagggccttgaactaagttttgagagtagaatttggacagttcaacaggcagctatgggcacccttgatagaatggaaaagtagggacctggacatgaacttaggaaggtggaggattcaatcgttcaaggacaagtcacatgtggcatgtcttttcttttacttgtttgctcagtctgaattagtatatacatagtaattagaattgaaatttttttctttttttttgagacggagtcttgctctgttgtccaggctggagtgcagtggtgtgatctcggctcactgcaagctctgcctcccgagtttaccacattctcctgcctcagcctctgtagcagctgggactacaggtgcccgccgctacgcctggctaatttttttgtatatttagtagagacggggtttcaccgtgttagccaggatggtctcgatctcctgacctcgttgatcagcccgcctgggcctcccaaagtgctgggattacaggcgtgagccaccatgcctggcctagaattgaaaattttgaaatagatttggcatatattttataggcacagggaggaaaattttgatgacctctgtgtagtgaagggcgctatataaaatggcttaatgaataataaagtagatcaaatgtttagcattttcagtttatatttttatcttgtgtgagctgtttctggataatttccgtttttagtatgtcactgacttcttatgtcactaagatatctgacagaagctaaggtaatgctgttgaatctccaatgtggacagaaatcttagacaacctttcatgctattacaactttgaaggttagacttttaaggtttgacagactagaataccccttccacttgtctggttttggctcttataggcatcacgcacagattataatctatactttggctgtttgttgttgtcaatggattttttgtgttgcagcatgaaaagcttgccattgccatcttaattggaagtagatgtttttgctaaaatatgctctttatatggattgctttattttaatacagaatttttaattacaattttataaaaatacaaaaatgagaaaattataggggcttctgcttcttaggaaatgaggtgcatgtgaaaagatttttatcactataataaaaatagacttttctaaactggccattcaccgtatcagctatttttgtaacatttctgtctgtttatttttcagcttttttaatccaactcaaatgaactaaaaacagaagatattttaaaatgaagtaatataaagattgaccttgtctcactctactcccctccttgcttctctgctcatctagcacctgtctgctctcacccttcccatgttctcgccattgttggtgcaagatttctacagcttctatcatctggatcagccttgttacctaggtttcctcaatcatctctttcttcagatctcatcctagttgtgtttcttaattggccttttattttgttttggcttttgttttgggcttgcaactaggtgctttaattttttaccataccgtgttgctcactagcctttttttttttttactttctactgtttcatatttaattttgtattacattttgaggcataacatcacaataaaattaaattgttataaaatgttttagatttaactagttgaatagttttaatccattctaaactttaaattttatttcctaggaactatagaattcttttggaaaacaaatatagcagttgcatcaagttcttttatgtttgtgctagtttaatatattgattacatttcagttgaggggtgttggttttcttttcctcgttggaatgttagccccaaagtccttttgatgattgattggggcatgtcctctgcttttgcccaagtgagctcaaaaccagttgaaggacttatggactgaatattaggttgggttaacatattaatatagaagatcaatggactctttactgaataaatattttttacacctaatttttatgtacctaaattttggtttgtctgaggtgtaatataaagacttaagaatgaataaaagagctttacgtttgggatgacaatccatgttggaatgttgaatttcttcttttttacagaaaatacacattggcaagttgagagttatcaacctgtgaaacagtatgcagatttgtgtcttctgtatcacatctgctagaagtttaatttttaatatttgtttttgttttcttttgcttaatctaatagctttgtgttttgtgtttcccaagtaatacaatgatcaataatgctctcagtgtttatcagcacaaaatttacttgtgatagagataatgccagttccccttctagtggctcttaaaacctgaatttcttactcttatccacattcttttatatgaaactgcctttttatcatcttgctaccttgtgagctttctaacatggtgtctttggaccaaaggggagttcttttaaggtactagaagtgagttttcttagggtgggaaaaacatttctaggattgtgtgattgggatttcagtggaaagctttcaggtctctcatgaatgatgttgacccagctatgttatattttagaccagacatgtactgatgacctttatgagttttgctggtatagatactgccatttagaatagaatcaatgtaaaatacgaaaattaaatatataaatgtacacagaaatctttctacacaaacatacattcagtattttgcaagtaggtttctttcaaggcatttttgccctaagaatacattatctaatgataaactgtaagttgtcagtacatttctcaattagaacatagttttcaaactctcctgcagagaatttgttttctagatttgttggtagagaacaaatttttattcttcacatttttatgctgccacatatatagcaaccagaatgttttttataatcctccagtagaggatttttctaatcattgacagaaacaaggtttattcatttcatttttaatagtactcttaaagtaaccaggatctttttcttaaaccagaaaaaattagtcacttttaatctgttttcattgcatgtcagtgtattgagggggaaagtctggaaatttgctatattgggcatgaaggacatgagtttaacatacgcttctaattccagattcttttgtgatcgacatttgatttctaactatctaaaaatagtatgtcaaatatgttttactcatatagcatcattttttaaattaacttctctaaactttcaaccttgtttttaaaaattgctatttaaaaaaaaaaaaaaaactgtgtgaaaccaaaaatagcctgcatgtgttttatttttaattccttgtggctgggattggaggggaggtcacagtttgcttcaacagtgaaaatacattgcatgccagaaaagatccaaggataaaaattaataccaaggttttaaactgattattagtatttttaataactcatatttaaaatcaataggatgtacatataaacttatttttgtttttctaggtagttggcaaaaaaggagaaagccactaaggtacaaaagacactggacaaccatattgcaatcagatctacagctcctggataattgcttgattctcgccagagactgtcaatgtttcattcattgccattaccaataaatcattgcttttgttcagatggtatcactagtgtttccattgtaatcttgacacatgcaattgtaaataaaagtcaccacttttgccaagcttaatttttgtcattctaaatcagtattttctctttccatgtatttgaaaactggttaacttctgattttagtagagacttaagtgtctggtagtatattgattgaaagccagtttctttagaaaaggagaaactgttctagggaattaagaagtacatgtgtacacattcatggcaagttattttgataagtgaacctggaacagctaaccatgttaaattattactgcatttttattaaaggacatttgtatatctgagctatggaaattactcaaattataaattagaagaaataaacaggtttaatgagatttagctactcttacctaaaacttagctaatgggtccacagattctttcttggtatatatcaagattttaatctcttctggtaaactttaaaatttgagtcagccttttttttttttttttttttttaactaatagaagaatgtggaaatcagacagttggggaaaaaatacagcatagtgaattcagaaaacaggaattggccaggtgtggtggctaatgtctgtaatcccagtactttgggaggccaaggcgggcgaatcaccagaggtcaggagttcgagtccagcttggccaacatggtgaaacctcgtctctactaaaaatacaaaaattagccaggcatggtggcgggtgtctgtaatcccagctacttgggaggctgagacagaagaatcggctgaacccgggaggcagaggttgcagtgagctgagattgcgccattgcgccccagcctgagcgacaagagcaaaactccgtctccaaaaaaaaaagggaattattacccttaatcaagtatttattacctgaactaccaaaacgtgcagtgtaaatatacagagaacatgatttaaggttgaaaatgaggtgctcaaatagaaatgtttaaaaggtctttcacaaaaggctggtaaaatatctattcgttaccttttttatcttaaaattgtaatctaaaaagtattggtagttttaattttaaaatttctgagtattttgaaaactatttttaaagagtacataagactgtaaaattgtgattcagttaaacatttgagggcattcttgtctaggaatatggtagagataccatttgcctttgtgagagcagtgtgtttatacttgtttatgaaaaaattctacagaagttttagtgttgaaagagtccctttctgaaacccaagtgtcattagatagtttagttcatttgtatatgggcacattaactggtctgtgatgatcttaacactccttaaatagaccatctcagattaatcacatctgaaattaaggataagattaatatgcagggttttggtttacagttttgtacacttaacctttctgagtaattgttaaagtgcctcatcctaagtattgctgaccttttcctatttatacttgatagtttgaaaacccagtgaaacaaatttcgtatttgtaaaggattggacatcagatttatattgtctatgtgactcttctataacaattagttgcagtatgcaagcattacataattcaaattgtaaatagtgaaaaatgaacgtttataggtaactataacgtttcacttaatgggaaatcttactattataaatgtgcataattggcatttaaaatatcaagctgaaatgctgttttctcctaaaacagtatatatatatacacatatgtatatgtaacatttatatataacactgaattttccagatgaataagagcatttgaaaaaatgtaactctagttattttaactgaagtt

SEQ ID NO: 13635 - DNA, 94077 bp, Human
cttttttggtacttttatagtattttttctgctcctccccttacccatttgccattaatctttaatttatctggaatttattttagattaagattgaattctaacttaaatttcttccaaataattgaataattgtcacagcacagttaatgaataattcatttacttactgattggaactagccatctttctcatgttttaaatacttatctctacttgagtctctttatgggagcttttatcctgttcctttgatctatctgtgttttcatatgctattagaacatgaatttaattatttggcttaatgatatattttaaaatctggcagtacgaattacctctcattctttttaaaacatgttttggtcattagttcatgtttagtcttccagatacattttagagtcattttatcaggaaaagaaaaatcctttcatgattctgattggaattaaactgaaaaattaatttggaaaaactgacacctctacacgtgaactttaccattcagaaacacaccatgtctcttcatttaaggctatgtttatatctctcattaaaggtgtttttttttttttgtgctggtcatttttaatttttttcttttctttttatttttgtaaagacaaagtgtcactatgttgctcaagttggtcttgaactcttggcttcaatcgtcatcttcctgcctcggcctctggaagtgttgggattacaggcataagctactgctctcagcctgtttttgtcatgttttaaaactggaattgtagtccggcacagtggctcacacctgtaatcccagcactttgggaggcaggccaaggcaggtggctcacctgaggtcaagagttccagaccagcctggccaacatggtgaaatcccatctctactaaaaatacaaaaattatccgggcgtagcagcatgtgcctgtagtcccagcaacttgagagactgaggttggagaaccgcttgaacccgggaagcggaggctgccgtgagcagagattgtgccactgcactccagcctgagcgacaagagtgaaactccatctcaaatgaataaataaataaataaataaaactggaactgcacacttctcatttcgtttattattagttatttaatgtttttgctgatattgtaaaaggaattcatttgctattaagtttttttactgattgtcactgatatgaagaaacactattaatttgtgctaactggtcatttaacttaactctactagctcctacttgttttcatgtttagggattattttaagggtttttatatcatttgcaaataagaatttctttctttacaaatgttgtggctctaaattatttttctttcttatttcattggttaatggcgtgatgcaaatcctcccccatgcctcttatttttctttaatgagaatgcctctagtttttcaccattagtatgatattaaaggctgatttaagctaaaaaagtttcaaggaagtatttcttctggtgctattttattatgcattcttaacagcaatagatattggattttattaaatgccatcttgcattttgtgagttgattatattttttttcttatttgaactattgatgtgatggaatgatattcatagatttctttatattgaaccagtcttagattcctagaataaaactctgcgtggtcatggtatgttatcctggtagattctgcttgctataattctattgagaattttcacagcaatattaataagttggtaatcttattttggccctgtcgggctctgttatcaggaatttgctggttgagtgaaatgaatgaggaggattttcctatttcttgtgctcctgcacactttctaggtatggcagttacctaggatattattgaacatttcagggagcaggcaacttgtctataaaatcttttgagccaagcatccttgctagagccccatccctcctcccaaccacacacaattttactcatctttcacaggaggaatcttcgagtatgcggacggccccaacgcccaggtcatgaatgccgaggagcatgcctttcgattttctgccaacatcatcaacaggaacaggactctgctgcccaacacaaccttgacctatgacatacagaggattcacttccatgacagcttcgaggcgaccaaaaagggtgagtgtgcagctcctgcctctgttctcttcccagcctggggaggggaagcgctgcatttgctgtccaagatcctgggaatgggccagagctccaagtaggttcagagccttttctacctggtttgggcttggagccagactgcctggacttgcatcctagcaactctgatattagttgtgtgaccttggacaaaataccctgtgcctcaattttctcatctgcacaatggatgcatttctgtaaagtgcttagaatagtaagcgctggcacgtaggaagtaccatataggactttactcttattgcacttggcttctttgccctccacatactgagccaccaggtcagagacccaatttctgtgtcccacccacctgcttctccttgccttgtattctggcagtcagagtccctgatatcgagagcagttactgctgacatttttttttttttttagacagagtctcactctgttgcccaggctggagtacagtggtgcgatctctgctcactgcaccctccgcctcccaggttcaagcaattctcctctctccgcctcctgagtagctgggactacaggtgcatgccaccacacccagctaattttttgcatttttagtagagatagggtttcaccatgttgtccaggctggtcttgaactcctgaccttaagtgatctacccacctcagcctcccagagtactgggattacaggccactgtgcctggccattctgacatttttgaggccactctgctgaatctcagagctgatctgcagacagacaagaggtgccccaccctggtttagcctggatcatccgaagagtgatccttcacccgtgacccctctctctgctcttgtgtctgctccctgccactcttttcccagcatgccctgcagcctaccctgtgcagtgaagtgtccatctccctgctgagagtctatgctaacaccctctgcccggccttgtccagctagaaaatgactcaactcaaccaaaactgctcaataaaaaggtcaggacacagaacaaaagcctggaatcagagtgcagaggccctcgtgggtacaaccacccacaaaaagctagactgggttttctgtctatgtttgctaaaaattactaaaataatacaatgactccctagtggtacacctgtgattcagcacagggaccttccccagccaggcagggaaccccagggcagagtttccgagccctcccggagttacttcctccaggaaattatagtcctgccctatgtgaaactgccaagttgttggtgagcaggcccaagacagaaacctagctcctgaaaatctagccctgggcttccaagtgaccaaagccacaacccctccactccccgcctccccccaaccagatgacatgacttgctttcttaaattcttggatggaacatctcatggtctttccccaaatcgtcattagagcccatgagggcctttccagtctagccccagcttggccttccagccacatccataccatctgctcccttaggccctgggttctagccaaacctgccctcctcagggtgccatgcttcctcccacctctgggcttccgcacatgctgccctctctgcttgtaattccctttctccagcccaccctctcctgccctttgcctggccaactcatccttctcttctcaaacttccagtcctcagggagaccctcccctaacccctagacaaggtcaggtctccttgctttcatcttataacactcaacttttctttcacaagcctgacctgtgtgtgtgagagagaggtcatgtgattattgtacatttcttccacttgtctgcaagcccccgtgtctttttactgctccactatagaacctggcatgggcctggcacgcaggaggcacaaaatcagtcctggtagtttgatcggatgcacaaatgaaagtgtgtcaaacccacttaacgaacattgttccttacgatccctgcaggaaaaaaggccctgccctttataggtcatgcccaaggaagctaggtcataggaccaataactataacaaccagaaaatgagagagagctacagaagtgttgtggtacaagcaggaaggcttcctggaggaggagaggtttgagttgagttttgaaggatggtgggaaagagtgaggagtgggataaggcagaaggtggagtggaaaatgcaagttgtttgaaggagccagtttatgcacttgagaagtctgttgagcgcccactgtgtgccaggtgctggggatcccaaagtgtttaagacagaggtggctggttcctgtgaccatggagcttataatctagtggatgaagcaacaggtgccatactgggagttgcaggagagagtgcaggaaagggaggatggaacattagcttggtcaaggagcatgagtttataagaaacagacacctactcaagctagatcaagaaaaaaggaactgccacccaaatcaagatatagaccatgtgagccctccagaagcccccatggccctcccagtcattcctctcccaaggtcaccaccgttctgactgctggtgccccacactgggttttgctgtttttgaactttacataaatgaaatcattcagtgtctactcttttaagccttgctctttgctttgtctcgtatccgtgagattgtctacgtggttgaatatactggtcttcattgatgtacagtgttctgttacatgaatatgccccattttaaacaaatccatttcacttttgttacacttatgtgttggtttctgcttggggctattacctgcattcctgctgtggacgttcatgtagatgtcttgtgatgcacatgtatactcatttttgttgggtatatacttaggagtggaagtatgcgggtcacagtatgtgcatatgttcagctaaacagttttccaaagctgctgcacagtctgaactccccacagctatgtttgagagtggcacttgccctacatcttcactagcacttggtaaagtcagttttatttttaaattttggccattctggtggtttctgtagtgagtctcattatatatatatagtgaatctctgtctctctctctctctcactctctctctctctcactatatatatatatatatattttttttttttttttgagatggaatttcactcttgttgcccaggctggagtgcagtggtgccacctcagctcattgcaacctccgcctcttgggttcaagcaattctcctgcctcagcctcccaagtagctgggattacaggcatccaccaccacacccaaatgattctttgtatttttagtacaggtagggtttcatcatgttggccagactggtctcgaactcctgacctcgtgatccacccacctcagcctcccaaagtgctgggattacaagtatgagccaccacgccccacctatattcttgatttatatattattgcatcctttgttggagagatatctctattgcatatatgcattacatgtgggcttccctttacattctcttaacagtttcttttgaggagtaaagttcttaatttaaagaagtccaatttatcaatattttccattatggttaatgtattttgtgttgtttgagaagtctttgtctaacctaaggttatgaagatattttctcatttttttcctagaaatgctgttgttttatctttcatagttagctctgtgatctatctcacattgattttctgtgtatggtgggaggcaggggtttgggcttattttttctatacaatgctgatgggagtaaaaccttccatttcttaggagaactatttggcagtatctactaaagcttgtgcctataacgatgtttctagccactttaatggtaataatcaaaagttagaagtaaattaaaggtccatcagtaggagaatggatagattcggatataattatacaatggaattttaatcagcaattaaaaaaagaataaactttctccactcaacatcataggtgaacctcacagatatagtattgagtgaaagaaaagagatttcctctgggagagggagtagtgtgcagtgagtggatattgactgggaaggagcaagagagacccttcttaggtgttggaaacgctctgtagcttgactgagatagtgtagcatacatgagtgcatgacgtatgaatgaaattatatgtgaaaattcataacagtcatgtgcttaacattaatgcactttactatattttatatctcaataaaaaaattaagtgccatctttctgcaaccctcaatgtccctgtgatgacatgcctaagacagataccatccctctgctatgactggcaacaccactgtcacaccttggcacattcctgctgttggatcacactcccctttgggtaccctctatccctcagggagagccccatgttccatgatctttattttttcttctcatctttggttttttaaacagcattctcctgaggcatctttaggactcttccaaggaacctggggcttggggcaaattctaattaatccagaaataattcattttccctagacagaagtcctcgtcattgctttcttcccctccagctggatccagccacctcgggccctgtggggggaggggacacagaggcataaagcctggcaccacctgccctgccagctctgcttgaattagtccttccctccacatgaggccgggggcctttccctgttaaaatggactttctcttattgtctttatcttttcatgttttgtggaaattaaaagatgagtgacttccaggcagcgccagaggcagcagcagcgcagagagtgtctgtgttttcttccaaggctgaccggagtgggcctggaattgacccagggctccccaggctcctccgccttcacttattctctgggctgctcaattccttttaagacacaaattgattgggataatttttgccataactacaattgccatggaaagggagtggggggacagcattcaggctgtggactcctgcaatgactgtgaaccattgagttactgtaaaatgaccagaaaatggatttaaaattgaagccacaaataatgtaattactgcagtgtgatcagggctgccagaacaagagttggctgctgccctggaaacatctggaagaaaagctgctgctgctgctgtaagccctgccctggtccctgtgggggcagcagtgttcttcccagctgggaagtcctcagagggtggaaggaacatggaggagacaggaaaggggaggtggagagaggccagggaaaagcaataggtgaaggccaggactgatgcttcctgctatgcaagagtaaagtctaatcactgcatctcttgcagaatgaaacccagtgtggtcatcatcatcatcaccaccattgactctactatcaacaccagtacaccagcaccacaattactgttttcaccagcaacaatggtatcatctccactcttaatatcagcaccaccaacactacccccactgtcatcacctccatcactgccatgacagcaacatcttcatcatcaccagtctcatcagcaccaacatctctgccaccatcccactgatactgtcagtaccatcaacgttgtgatcacctcctctctcatcaatgctgacatcccgtcatcccctgtcattatcaccactacagtgaaggcaccgacacatttatcattgtcagtctcatcaacaccaacatcaacatcaccatcccgccattactatcacaacatcaacatgattaatttcaccctcagcaatgccgtcaccattatcatcattggcagcctcacaatatggtctttagtatcacaacgatttcagttgcctttgtcataatcctcacagtctgtgtcaaaataaaagtcacttctttgaagaacactcttacaatcctctgcatcatcagactttgtgttggtccactctcccttgccttggtccaacaacatgcccagaccttggacatgacctaagaggccaggccgtgtaatggtagcagtggcagggaagcctggacctgactgcttcaaggcatcaatcaatgaaggaaatctaagaggcagatgcgtagaggtggtggtgggagggaatgagacattcaaatcattcaaccaagtcttcaaactgaaggtgttccaggaaaaagaatagacagataatatagtgggacagaaaccagaggcatcaggggacagctagaagggtcaaaacaaaggtaggagagagtatgagggaaacctacagggtttacagggtgcccacggcctcaggcttgggcaagccctggactgctgtcactcactgttaccatctcttccatgttggtacccagctcccatggttgcagagtgactcacacatggcctccttcctcaggaagtgcctaatctgaaggggacaaggttgtcggggaagatatgcaacacccccagacggcagaagaatagcacgaatgggcagtgagggtgcaggtccgagcatggcctccttggggagagggaactgaaaaaagaactagtcctaaatttgacaattcaccagcaaacccagagttcctgtttttaaagcatttattatcactgtggtttgtctcacacacctgctcacaccaagggctacccaaggcatgttgactcaaaggtgacaagagcaggaacaagatggtgcttccccgacttggctcccagtcccagaactacagaagcaccaggaggatgccatgcccccgttttatgtgctctcctgcacctggccttggccacaatgaatcctgggttgcccaggagataccctctgtactggcactgctgctgttctgccccgtgttacagggggctccagcagacccctaacaaaaactagccagctcatcacattgctatatctttcaccttgcccttaagtggcaatctctggtgttcctggtagaagtacagatttcaggaaaaataacttctttatataaaatctcccatttccaggaggcagtgggagtggtggatgtgagtcaacaggaaacacaacccaagaccacatattctgatggattcaaaactaccctgtacctctggatcaatctggatcaatctggaccatccttaagcccaggcgagagggaccctttcccagggcctgtgctttgatgtcttgccctctgcctcctctggttggcctctcctcccgggacaaggagtcagtgggaccaggggacatacccaccaggagcctgtgccctgcccttccagactttcctctaaggatctagaaccctgaatttcctgcccacttgcccctgagcccacttctaggacatgcgtgggcctcttccttgggtctgtcttccagagggaaagccatacttgcaggaggtgcacttttaggccctaagggtgaccaaggggcagctgtttgcagtgggtgtagacagtgtttggacataagggctggggtttccacagagaatgcaaggccccttatggttcaggatggagccagtggtaaaagagaaagggggagaatggggtcctggtgctacctctccccatgtcactgtgtaggagaagtctccattctcacctgactttccagattgtgatgaaggtacatttgtcaaggtaagagaaaaggacgtgtttcgtttaacagttttttagcttgactaacagcatgtaactatttagccgtatggtatgtaggcttccacttatactctggccctgggccctgcaaatcttaggggtaggcctgtgcccagtgggtcattcccagaggcccttgagacagccaggcctcaatacactgaatccagtgtattcattcctgcttcggtgctctgtcctgcctcctcctgtgtgcatcagatgtcatatgtgtgcacatagtgtcattcccctgtccacaggtaggtgagcttgctcatgctctgttggtggatctccgatggttgcaactggcggaaaactaaaacctaaatggcgtaagtcttggttcatgcaaattctaagtccagggttttgcctggtgggcgactcctgtgttttctctctcttggctctgctcaacccacactgactatgttcacagacaggcgcccctctttatgagcacaagatggctactgcagctccagctgttacttccttgaaggttcacttaaagagggaggtgcccctttctcagtccagtggatctcatggcatcccactggctctgactggcccacaaatgtcctctaaactcatggctgtgaactaggaaggtcagtgagtggttttctgggtgcgagccgcattctctgcaccaatgggttgacagtggaaaagaggggtgaagccccaaggaaaattagagacagttgagaaaagaagagagaatggcttctggggagctctcccacctaccccagaatgactctaagaggtcccctttctatggatcttttaggcagaatcccccattttgagccccagctgccctgggtctgctcatttgatgctctgttgtgcccactgatgttctaccatcccaggccggtggaaagcatctgctgcctcacctgcctgagtttttggacctctgcaagaacctgaactgtttgaaggcagggattcggcattcattcaacattcagatgatgattcggcactgtcgatacagcagtaaaccacatagatcaaggccctgcctctttggaacttacattctactgggaggagaaagtcaaccaatggacaagacttccagtgatcatttaataaagaaggaaataaacagggcatggggggacagggattgtgattataaattgtgcggtgaaggcctccctagtaagacagacacagaggcctcaaggaggagggggagggagtcttgaggctctatgagggaagagcattccagccagagaggacagcacgtgcaaataggcaggaatgcacttagcatgttcaaggagcatcatggaagccagaggagcttgaatgctttgagggagggaaagaaggatgggagacgaagtcagaaaagtggcggtagggacagggaagggaggagctacaacaagcaggatctctggccactgctatgactttggcttttgcactgaggagcccttgaagcaaaggagtgacgtaatctaccttatactgtggaagtctcaccctggctgctgagtgcagaatagacaggagggaggatgactgaggaagcttctgcaataatccaagccaaagatgatggcggcttggaccaggatgggagtcggggctgggagtggcgggaagtggtcaggttgtgatgtattttgcaggtgaagccacaggagttgttgatgaattggggtgtgggatatgagtgaatgagaagaatcaagacagaaccatggtttttggcatatgggtccagggacaatggagctgctgtttatggaggtgaaggaggttgggacaagaggggatcctgtgctggacatgtcagatctgatatgcatgtcagatatccaactggtgatgttgagtaagaggtgagatgcacaggtccggggtagggaacaggccgggctagaggttgaagttgaagcaccatcagccagtttgattctatttgtttctcaagtcccccaagaacagaacctggcacagagatggtgatgctaatcccaggatggtaacattgaatgtggtgatcacttttgtcatgggcacttcctaaggaaaagggacgtaccctggcactgtgctccagtctcccacaaccatgtctttccaccttcatgtggtcttgcaaggcagggactgttagaacccctgttttcagatgaggaaactgaggttcagagagctcatccattgtgcacccaccgagggttccagttgctgtttttcccacatgtttacaggatcatcagcatcactgtccccatacccacagccccagtgctgacccctgtgctgccctaccctctgttgcagcctgtgaccagctggcactgggcgtggtggcgatcttcggcccatcacagggctcctgcaccaatgccgtccagtccatctgcaatgccctggaggtgccccacatccagctgcgttggaagcaccacccgctggacaacaaggacaccttctacgtgaacctctaccccgactacgcctcgctcagccatgccatcctcgacctggtccagtacctcaagtggcggtcagccaccgtggtctatgacgacagtacaggtgggtggccaggcctggctaggctgggggcaacggttgaggggggcagaggcccaggatcaagctcttgtctgtttgttcagcacagctgccctgggggaagaggctgtgttccataccccagttccactcggttatgctgatgttcacccctgcacccactcacaccctgtgcaccccagcggcactcatatctcactcagccccagcgcacctcacccctgcctcacactcagctcctcctctagcagcacaagtgttcaaatctgcactgaacacccaccctagcagcagcacacacatctgcaagccacaccgacacctgcccatgcccttacgctcacacatttccatctgctgcaaacacatccaccctcacacttgcacactcacacacatagcttatggcgtggcctagtgttaagtgtgtacacactggagccaaaccacctgggtgtaaatcccatctctatcacctgctggctgagtagcctctttgtgcctcagtttcctataaaatgtaaatctgtaaaatgtgggattacaagatgacagtgacaagcactgacatgcagtgagcgctgaaggttggttcttctcatcctcctcacaccttcacccgccacacacacactcttctctacccacactcacacacagacacctgcacgtgcccagctctgctcgcacacacaccagcccctgccatacccacttgaccgctgaccccagccagtgccaagcttgcagacgtcagcaccaggctgttgtctcatcctgccaggacagaaagaggagatgggctctggggcccgtggctatgagctgcgggcccaaagctgggctccctgatgtggctgcacctgtcccacatgctctgccagctggagctaatgctgcccacatttttctgggtaggacccacctgacccactcctgccctgccttccaagtccagcctgggctctgccttccagaaaacccttgctccaatgtgataccccctgcctctcaagtcccaggcccttagagagggcccagagcacacacctagcagataaccaccaacaaacccagcaaacgcactctggcttttcctttggatctcattcattgctaggagctggagatacttagataaacaaaacccactctttctgtcacccaggctagagtgcagtggtgccaccacagctcactatcacctcgacctctgggatcaagagatcctcccacctcagtctcccaaatagctggaactataggcatgcagcaccacacctggctaattttgtatttttttgtagagccaagttctggctacgttgcccaggctggtctccaactcctggattcaagcaatcctcccacctcagcctcccaaagtgctgggattacaggtgtgagtcaccacaccacaccaaaactcagttcttggtcttggcaagcactacattgtagggaaacacaaacgggacaacatagccatctgcatgaacagagccatctccatgtagctctatgtacagagagctaatggtctgccataagtcacaaaaagagcaagcaggaaagggaaaagggagagaagagccactgagggcactgaccgctgcctggtccctgccttcatccttaagtcatccttgtgaggatgtgtggggcagggacagacctggagagtcccctagagatggaattcatacatgcttctggattcatctgctaaagaaggctactgtttacctgctgcgaaccaagtggtgcaagtgtgatcttatttcatttcatgtaaatctcatagtaactccctggagcgatgaattagaaatgaggaaactgagtcccaaagaggtgacatgccctgtgcactgtcacccagctagtgagtgccagagccagcatgcacctacaggcctgtttgagcctaaagtctgtgctgctagccagcatggagctgtttcttctcctctttctttccaaaggcttgagtcccaagacatttcttagcctggcctcttaagagagagtgaccttggcaagtcacttaacccatctggccttgctctgcccacatgtcaagagctgctgcatccagccttgaaagagccctccagctctcagctgcctgtgattcaatgtcagcttttgattacctcctaatggggactggaaatagtagggagagactccctcagaaaagacaattggaaagctgtttatttaactcaggcttctacaagcatctattgagttcctgctatttccaaagcacccgacagaagatccttgagagcagggatccccagcctggcttattcaccccagcatgaagaccttgccattgaggggcactcctgcccacctcccagccactccagtgtttctgctgcattgtggagttgtttcttaatgtaccactgtgaatcattatctgtctgtgagtctgtgtctgcttccaggccaggagctttcagtgtctccaggatttaacacagggtctggtacagtgtagatgtttttcattgtttgttggcactgagttggattggactggattggattagtttggattgaattggaaatcaagttgaattaaaccctaattaaatattgaaggaaagagtatacgggtgaagaaacaaagatgttgttatcctgtcttcttttgaaaagttaatcttagcatagaagaatgggtgcctgcccagaggtcgcacataattctaggccatcagagctaagaatgaaatggcatatacatttagtcagagccagaccacttggggaatggaagctctatggccttggctggtctgagctgacttaccagaggaggagagattggagcaggataggtgaatgaggagaggatagatgaatgaggagaggaatcatgagggaattacaggtggagggaacagcatgagcaaaaactaggttggactgtacctagcagcttaaccaagaggacagcctggctaggggagaggattcaggtatggaaggtgggaagaaaaagtcagattaacagagtgtagctggctatgcaaggtctctgatgtccagcctcagagttcaggttttatctttaaagcagccaaggatcattgagtattgctgagcaaaggcgtagaataatcaaagcagagttttagaaggtggttctaagagcaatgcacagggagggttggaaggagagcctagagcaaggagactagagcacagccgactgcactggtccagacaggagcaaaggaggccagaattcaaggggtgcttggaagagaacatggggccagaatggaagagaagaaagggatgtgaacagggtaatgttgaagacatgtaactggaatgtcatgggtacagagtgtcagagcagacactgacatagtctaggtggagggtggaggaagtggctttgcagaggaaaaggtgctttatcatgatgatggataccatgctagcaaaactggccagagctgatgctcaggtctgcagctcttacccacaagtgcctttagctctgactataagtacacgtcacttcattctcagctctgatggcctggaattacctgtgatcactgggcaggtacccactcctctggaatacaattaacttctcaaaaggagataggatagcaacatcttcatttttttatccttatactctttccttcaatatttaattagagtttaattcaacttcattttccatttgattcagttaaattcaactcaattcagttcaacaaatatttaaaacataggggagtcaatgggtcagtgagtttgatcaagaagacaatgagcactaggggctcaggtttggcttcagccaaataatataactttgatgatgtatagtgggtagaaagaagtgtgctcccagaatccagatatgtcaaagggcaggacaatgtatgggtcatcaaacccatggagtgggaaatactccacagtgggctttggctgtgtttgctttggagattgtgtccatcaggatgttttggctgcaagtaacagacagcccaactcacattgactcaagcaataaaccgttatctcactgacaagaattctggagatgggcctttcctgggatgatttagcagcttgacaaagtcagggtgctgggtcagtattgccacagctctcttggccttcagctcatagtcacaatagggctgctgaagctcggagcatgcagtaggtggcatacagaaggtagaggccaatgggattttcttcttcattatttttttattttagagacagggtctcactctgtcacccaggctggaatgcagtggcacaatcatggctcctggcaaccttgaactccagggctcaaacggtcctcccacctcagcctcccaagtagctggaacccaggaacataccaccatgccctgctaagttttaaatttttttatagagtcagagtcttgctgtattgccaaggctggtctcaaactcctgctttagcctctcaaagcactgagattataggtatgagccaccacaaccagcccaatgagatttttcttaatgtgactcatgcctcttatcaaagaggaagatctgtctcagaaccttctagaagacaatcctgtatagctcactgggtccatacctattattctagacattgtcagatgggaatgggattgccactgattggctcctgccaatcacgagtcatctcatgggactggtgcattttcacccaaacacaatcacagttcttttagaatgctggaagggagtgcagttgttatctctttctataataatgctgtgtaacaaaccacctcaaaaactcagtggcttaaaataataagcatttgtttaactcacaagtccacagggtcagtgatttcttgaacttggctaggtcgtttttctgggttcacctggatcactcacctgcttggtggtcagctggctgttggttgatctaggctggccttgactgaaatgcaggtatattcagctctccacctgtctctcatcctccagcaggatagccgaggcacattgtcatgacaattgcagaggggcgagagagcaaacccaatgtacaattccatttcaactgtttgcctgcatggtacctgccaacatcccactggccaaaacaattcacatgggtgagcccaattggagggccctgcaaagttacatggcaaagggtgtggttataaggagaggtgaagaattggggtcatggctgcaatctcccccaaggggaatggctattgagaaggcagccagtgtttgccccacgagctttgtgccttatctattctatgcataaagacaaactcatcttgagggtgaaaggatgggattaaacaaacaaacaaacaaaaacctgggatgaaggaaagggctacagcctaggagtcaaaatgttattgggtctctaattatgattccataatcacttaacctctgtggtgttacttaacctctgtggtccttgggatttttctctgtaacattggaatgaaaatccttgttctatatgccttctaggattgggagatggttaaatagggtaatgaatgcagaagcgctttgtgagtgaaaagcatgattccaacaaccatgattcactgcagatattttaagagagattgattaggggagcagccagaaaggaaagctcatctcaggcaaacaaagagagcctagtcctctgctggagtgggctgagaggagcctctggtctcctttgggaatacactgatgggaaggagggctgacatttgctgctggagaatgtgggtcaccatgcattacatggggcgatgtgcttggctgacaagaaggccctggtggcctctgctccagcatccagcctgtcccagtcctcatagcctgggtccccaaagcccacatgcctgctgatgctgcacataagtctcaaaaccaaacagggaggagcaaactgtgcaccctggacctcacggggtaacagatatgaaagggaagcatcattcaacctaatcaagaatttctgggatacattgggagggggatagcctgtgtgtgtgtcttgtgatagcttgtggcctctcccttctatgtgaaggtcaactgatagcctcttcctcctccccatcaagtctggtattaggaagcacagggcacctgtttgatccagaccactctgggactacatagccgtctcccaactccagcacatgggtttgagtcttcagtgggctgggggttcctgatgcccagtcatggcaaagcttgtgtggaagctctttaggaggcttaggctacgagcatacatgtctgtccccgaagcaaagtgagatgatggacaccaatcagattgctttcctgatgtccagccctcaggaatgagaataattgctaaacagactcaggggtgtgtaccagagattgttttggaaactgggattctctgccggaaggcttttggagagggctatctgagtgaggtcagggggactctttccagatagagtaacagttgattgaaaactttaatccagtgcaaactggcttaagcaaaaaaagtttgggggcagcaatttggtttcctttactggaaagtttggagctaattttagcttcaggcaccatttgatccagaggctgaagtgaagatcattaggacttctttgctacttgttctctctgacatctgtcctggtggaatccttctcgaggtctacgtggggaccctggacttacaacctccatatttgaagttgagtgaaaaagggagtgtttctcaccctctttttgtgccagttgttctaacacagtttctgagagtcaatggtattgtacctatctctgagtcaatacctattcccaggctggggccatgtgctttgcccctagagctgacgatggacccctcctgagtcacagaaactaagagtgggggagaagtttttccccaaaggaaaattgaagtgccattagtggtgggggggcaggggtgggacatgctgtgtgaactgtgtcaccaggaccagacactgagtcctggggatgactagggaccaagcaagcaggaggggatggccctcttgggacctggccgtgtgctggctcagcttcttctttggaggggaggaaggggcgggaagtatatacagagtaacaagcaggcttgctcccaggctatgcagaaagaagtcagcaaaaatggaccttgaaatagggacagaaacgaacttaattagacctaagtaagccatttgtctccagaaagtgacattcagttttccctggaagtcctcagattaagtggttttacaaaaacgccaaccaaggtagaggatagatttttcagtgtgggaggaaaaacaaaaaacaaaaaacagtaagtcagtccaattatggaaacttttgttgagtaccacctgagtgccaggccctgtgctgggggtggtgggaacccagccccagatatcaacgtgctggtggcaggatgaggggaatgaggtggggccagaggaggccattgctgagggaggaggccactgagttggaggagagggtgatcttttctggacagagcaaaagaggaaggcttcatggaggaggtggttgcactaaacctgaaaaagtgggtaaggtttaccaaggcagactgcccttagtgaggacgagggcggagacacaaatacctcctggccttacccagcccagtggttggtacaggttagtaccactgaggctggagctgccttttgtgcccatatcctggaagcagctcgctggagatgttgagggaaatcatgtcccatgtctcacaatgttgggggtgggtacagaagaagaggggtgaactctgatttaggccctgaaggctttacacccattctgggttagagagaagcagatgggtgtggtcagtgggaatttgctatctgtgcctacttttgaatctacatatgtgtgtactgcaccactgtgtgcacaggccttaatctacatatacacacgtgttgataagcccaagtgtattcctgcccatattgacatgcacgtgcgtgtagccatgtgtttgtatgtgcacacacacctgctctccagtgttgtccatgcacgtgcacaagtctctgtgggccacgtttctgcccgtgtatgtctgcagacctgtggccatgggcatgtgtgtgcacacaagtccaagtggatgcctggagctgtggatacatgtggtacacgtgtgtcttttgtgctccatggcccctcagggctcatccgactgcaggagctcatcatggccccatcaagatacaacatccgcctgaagatccgtcagctccccatcgactctgacgactcgcgccccttgctcaaggagatgaagcgaggccgggaattccgcattatcttcgactgcagccacactatggcggcccagatcctcaagcaggtgcgtgagtgctggccaccgggacagatgactggggtctgctggccacttctcccacgtccccttcccaaatgtgggtgtgatgctgccagatctaagtttgactcctagctctgccactttcctgctgtgtgaccttgggtggtttgcctctctgagcctcattttcaccagtagcaaaacggacactgcagtatttactctgtgagttggcgtaaggatggatgatccgcccagcccggcctgacacagggagagtgctgagtagacacgagtttccatcccacctctgtgctggttggaggcagaggctgccgggaggtacccacagccacacaggagcagagcactccaggaagcagagaggcctcagattctcaggaacagcccccagaatgcctcaccgcctcttccagtgactaattccccgtagcccacggcacttggtgttactctcctattactgggagctttatcaaggctctcgtaccatctgctcagctctgcagtgacagagggggaggagaatggctctcagtcctggatgggccttcgttcccaaacacagctcagcatggcctgctggggacgagagccaagctccgccagtcacctaagaaaataaacagtgaaatcgcctaccacccgctccaagggtgccacagcggaaaccaaaaactgatttgagctggcgctttgtgtaaaaggcaattatgtcatcccagaaagcatttctggtgactggaggaggcattctgtggggctttgacacatgacccctcagggtccaggtgatttaaggggtgcaggaggagacacgctgagccggagtgttctcgaggccttgaggggctcaagtcccatcctccagttgggccccatcgggggtgccaggcctgaatggcagcctctatccctggctcctcacaaaggaagctcctttacaccgcacttaaaaggctcatttgagggtttgagttctgcttctgccctttcacgttgtgtgccctggagcaagaggcccaggagtcattcccctcctctgtagatgaggttcataatccccatctcataccattatggaggcttcagtgcaacaaggaaaacatcaggagtttcttctgacacccagcaggcagttgacacccagcgttgggcatctttaaagctgctgtcgaggaaacacacatgccccagaaagcctataacccctagcctcccgatcagctgtgcccagtgcctcttctttcccccctacccccacccccaccacccagacagcatgtgtaacagaagaatggtgacaatcacagctttggtttactcggcagttgccctctgccgggtccatgtagctcctcatttatcaccacactgggaaacagggagaattcttgtgcccaatttataggtaaggaaactgaggctcaaggggaaagtaatggacccaaggtcatccaggcaggaagccagaatggactcccaggtctgtctgattttaaaacttctggaattagaaatgaagattctgagctgagccaaagccagatttaaatgaagttaagccaattagcttcttgcaggacttctctgagactttaacgtgctgaggtgggctgtgactcttcaaaggcgggagggaatgggcagcatttgcaaagtgtacttgaaccggtgacattttccccagagccctctgtgggcccagcattctgaggaactctgtagaaaatgcattatagtcattagtataatagattataggcttctaataaaatacataaactatagatagtgcagacttcatgatggcagacggtaagaattccacagtggccatgtggcctgctttgtggtcagccaggactaagggagcagggatgcctcagcccttcttggggaggctgaagacagacctcccagctcaggcctggctaggccagggggttagcagggttggggggaaacgtactgcctctggatccaggacagggagctcagctgagtggagtccagggcacttgagaagacagcctcagactgacgccatcagcatttctctaagtgtggcaggccgggagacgcttactcaaaagaggcagctagaccccacgggccctgcagaatttggaatctttgaagaatgtgacccaaaaatctgcattttaatctgtcccaggtgactttacagcacactccagtgtgaaatccactgctgtctgccaggcagtcattgtcattgttcagaggtggtctcagaggacaccttactccaagcagccagccttccccaaccaactgccagccccattctcagccctgggtggggatgcggggagggctgcccaggggttccctgctgatcactaacactctgcttttctgcaggccatggccatgggcatgatgactgagtactaccacttcatcttcaccactctggtaatgtacctctgggtcctggcacgggaaaggggtgggactctcatggatcaagttcattgtggcttagcctgggccagcccactgaagacaattgctgcagcttcctcaggctgtaggggtggccccaggtaagggcacaaatatgtctttgtgacctgcccacttgtgagaggcagcatcatgttataattaaggatgtgaactctggagccaatgtgaacaccagctcctctgctcaccactgtggttccttggctaagtcacttaacctccctgcctcagtttcttcctctgcaaaatgggcttctgcctcctaggattactgtgagcaccaaatgagttaataaggtaacacgcagtgcctggtacatgaggagctctggaagtattcactattatgattatcatggccctcggttcctagcccacacttccccacgcatatctcgggcctcacgggaattgtcgctttggattctgtccacattcatactgaagtctgcccactcactgtcagctagcccagcccacctacaggctccagatgggtcctgtccaaactctgagaacatttagggccatttaaacccattaggataattagctgtggcctgagttcagcagaataaagagattcctgtgccaaaagggcacccatcctgagcctcactgccttgcagatagacaccttcagaccctgctggggccctgggcagactattccacccatcccaggtctggggtgagtgacagcctcactgaccatcctgtcgcttttcaaaaagcctcctgcagtatgtgtctgcccagccactgcagccctgtaggcctctaaccatattcattcatttatccagcacccagctagctctccctacccagcatctacgaccccgtaggttctgagggtctggtggaaggtgggaagtttgaggcagtcttacagaaaaccagatacttgaactaggcctcgaaagatccataggagttcaccaagggagaaagaggaaggacattgtatgcagaaggaacagcataagcaaaggccaagaggcaagttagttcttcatggtatgcaggagctggcttgatccagcgggcgagagccaattgcattatctcctcctaagtccatgtcatgttggtagcttgaaatcactgtgacgggaacgcttacacaatggaagtgagcaaatgctacaaataagagccgcctcccccagagagctggttattaagcacttatcctccctacagtccctccctctgcaccctgtgcccacagcagagctcaggagccaccctgcgattctcctgatccagggctcagacctggggacctgccaggagccatgctgggagaaagggatcctggaagctggtgaatgagatcaggcagagtgaagccagctcccctgaatcccttctggatttccgcccacctaagctggcttcttcctgccatgctgtctcctggaaagtcaatggaggctaccagacccctgaaactctacctctgtccagagctgggagcagggcagaggagcaagactgggaaggtggggtggggcacattccaggggtccacaactttctccccactcatggcagccctccccatcccatcctgagatcttagggtgctgagagcaactcctggacccggggacactaggatcctctctttaagaccttcgatcttgaccccagtggccaatggcattaacgtggaaggtactggggtcactggggtggtgccttccccagagtcttgtcctggaaggtcagccaggctgcagggctgaggggccaaagcttcaggccctgccattttaccaactcaacgaccccccaccccggccttggaatgaggcttgagccaggcagagatgcttttaataggatatttacggctgggacttggagcaaggcccagagggggtttaatcacaagccctgtgcagacagagtgggtggcgagggcagtactcagggtgggtgaaggagataggaagattttgttcctgctctgaccccaattctactgaaacctcccaatgtcccaaggctttctgcttggtggctctatcttatattctgtgttggatccatctctgtacacccctcccacccaagtgcctagctcagtgcccaggaccttagagagcattctttctctctacccatgggcagacctcagctgattggccaagaagtagtcgtcgtctgtcccaagggtggtttctgcaatcttgctggtgacacaaccctcaccctgggagcatttagctatatgggagctagtcatttatttgtcaccaagactggaaattagtgagtggggatcagggatgctagacattctatgatgggcaagattctggagatgagttgtccagccccagatagctatggtgccccattgagaaacattgactgatgctcagccagtccacaattggatctgggaaagtgggtgataatcagagaaagagatggtgagaagaggcagaggaggaatggatggtcaactgggatatgatgtacccagggtagctgtggtgtgctaaagtctctagggaacagagactagccccggccagtgtccatttttcttcattttcttaatcatccattgattcatttatccagcagccatatacaaatgctctccaaggtcctgggcactgcactaggcacttgggtgggaggggtgtacatagatggattcaacacaaagctcacaagctggtggcttccttcatgtatataagaaacaagaactgtgcccagttaacctctctgtccccagcacccacatagaagctggcacatggtaggtgctcattaatgtctggatggatggacagatggatggacagacggctggatggatggacggatggatgactgcaatgcaatgtggaaagtaatccgtgaaattgtcaacacatcatcatagcaacagttagttaaaaccactctgatcccagttggcctgagttagaattgagactcttccactcccttgggcaagttacttaacctctctgtgcctcattttctcatctatacagtggtgacagtaatattactacctcacaggattgttacgctgagtgcattgacgtcataaaatgcttagaacaatgcttggcacttattacagtgtaagtgttaaataaactaaacatcctgcttttgttttctgtgtgctcaacataccccatcccatccaaaattcagaacaactttccaagggagatagactctcccagttttatagaaacgtggaaactgaggctcaaagtcactctgcaagaaaggagcagagcaaggattttttcgcagcagggagctgtccagctccaaagccctctgctgaaacctatcatgctgaaagtccacaccaagtgttccctggcctcctctggctggctcagattccacacaatgcctgaccatgttggttcaggtgtggtaattgaggtcaatggggaaacggagcctcctgaaatcccagcagctcccatgctacaccagttccaaaaccctctgattttagggctggacattgtggctcacaccagtaatcccaactctttgggaggccaaggcaaggggatcacttgaggccagtacaagaccagcctaggcaacatagtgagaccctatctctacaaaaataaaaatattagccaggcatagtcgggcaggcctgtagtcccagctacttggaaggcaaactgaggcagaaggattgcctgagcccaggagttagaggctaccgtgagctaagattgtgccgctgcactccagcctaggggacagagccagaccctgtcactttaaaaaagaaagcaagaagaaagccctctgactttcctctttacacatttgaggccagcaacagggcactttgcactccccattgactggtggggaaacctggcatcaggcacttcctgaagtttcatagcagatcagtgacaagaggccttggctcctgactcctggtcctgtccttggctgttccagctgactgtccttcctccccacacaatctgagggtcgggaagaatggacccttccagggaggcatagcccttgcaatacacacagttctgcagtggagtatggggcggggtctcccagagtatctcccagcagaaccccatcggttggagcaccagctgtgctcctggtcctctccctcagtcatatcctgcttccggtcttcaggatccacttccggccctgttgccgaggcctctacctcgtgatcctccctctttgtgcccattggtcagttgtggcttatttgggaggacagtggcatctggcatttatctccttccctttaggaaacccacatcaccaactcttcgcctctaaaaaaaattctccaaatttgcttcttccatgcagaagatattttaattaccccagctgccattatctgttccaaccagctttgagccattcccagataacctcgcattaatcagccccagctgagcccctggtacatgtcatgtgtaggtaaaagcctggaggtgaaaaaagaattataataaattaatagataagcaatcacaattaatgccacttcctggcaataacagtgatatcatggggaagatattttcatctgtcattccttaaggcgatgttttccaagcttcagctcctacccattcagacccatggggtgctaatgaattagtttattatgttatgctgaatgtttctaaaaggtccctcgtcgatactgaattcagtgtgtcaacatttggcatcgagaacacaactttttgccaagcagcaaggttgcacacagttcacagtgtacagcacttggggtcttggccctgggcagtctgaattaaaaaaaaaaaaaaaatggagctggacaaaagagcctcttcaccagctccccattgtcattgtcctcgtatcacggggatgggggcactctgtgccacaggccctacaacactttgcagctaagcccaggctcaggggttacagggaggaaggtcatcccaatcactaccaccccaacctgccccctcccgggctgtgatcagctgcagcctctgtgtcagtctcaacagaccaaatgctgcctctggagaccagaagggctggttccaccagcacccaagctcccaccaaggccagagatgctgcccttcacactgagtcaggttggcctctggttacctagatgagggtaaatcgagtcatggaggccctgggcagtctaaagctttggcatctttcaagccttagatatcaggtcaacactgaattggagaagagactgaatgccatgcaaggaaaggtgaggagggcgccccctgtaggcagagctcagcttctcttccatggtcgcagcaggtcagccctggccccaaacttgcataacaccactgtccaaaacgaaatccttccagctccccagaccctcctggttgaaaggcagtttggggaagatctcatcctccaccccaggcagtttaccaaccctctcctaaacttccagtctgtagataaccctgagttaattagccccagctgagcccctgctacatgtcacatgtagataaaagcctagaggtgaaaaaagaactattataataagttaatagataaacaatgacaactaatgccacttcccggcaataacacttatatcatggggagggtattgggttggtgccattaaaataataacaaaaaccacaatgacttttgcactaacctagtattttcatctgcccttccttgaagctgcccctgagaggaggatatgaaacacttgtcgctacattccaggctcttctcagtgatgcttaagtgccccaggagccactcagctggctgacccttctttccactttgggtaacaggaatattcagcccatagctcataggggagacagacccagacacaagcagttgttaccagtggcatgaaagcccagaagtctcaggataagagcagaatcgcgtctgacgcactctgttgtgcatgtgtacaggagcaatcaggaggggcttcctggaagaggtgatacttgagctgattcttggagaatagctcacccaagagaggtcaagaagacaagcattcttgcctggaaatagaaggcatacaaaggtgctgaacagagggacgagaagcaggacaaagggtacaggggccagcgagactgggaaaattaaggcctgaacttgcatcctgggacaaaaaaattgagagggtaggaaggaaagtgagcctggaggggtggagagctttggaaaactgtactaaggaatttgtaccatattctgaaaagactacaaggagtcatggaagtatttgaagtgtggaaatgacaggcttggatttataccttagaaagatccctctagtccctgcccagagggtgactgccctggcagtgggcatgagttgggggctgggcaggtagagcctctcggtaggaggagatgcgtcatcataaggaagagggagggctctggagctgggtagcctggtgttgactctgtcactccccagttacagaaccttgagcaaaaggcctaatatctgtgtggttcagttctttcctctaaaatggggtgataataacaccatcctagtcgtgtgcccatgtgaatcaatgagttaatacaagtaaggtactttgaacaatgcctgccattctgagatttgtaggtgctcagtaaatgtgagctgactttgcttgttctgatattgccaagacgagtaaggtaggaagacaccaacctatgtctgccctgggggctgtatgtacccagtagctgtcacaacctcctgccagacgaggcagaacataaacatgtgtcaaacacatacatgatgtttgatatgtcccagacatgttctaagggcatctacaaactcacttattttccttgacaactctatatggtaggtggcactttcaaccccattttgcagatgaggcaactgagatgaggagagagggtgaaactcgagcccaggtggtctggcccatgtctggccacctcagggagccgccctggaggagctgagggagggagacttcttctgggatatttattctctcccctctttgctgcccttctctgattcgagaggcatcctgatctaaacccagacccatctgtgtgtgtttctcagtcacaagtaatcgcttagtggcttctcaaaacacagactccaggctccaccacagactatgcatcagcgttatctaggtgtggttcatattctagaaaaataaaatccccaaagacagctctgatgcatgtcttgtcctggacacccaccgaggacatagaacatagagggtttggagtaagacaatcaacgatgcatcagtcaatgtttaacaaccagctctctgaaagggagaaaaaagacaaaacacagaaatcctgatttgtaatgcctgcaaatgtccatggtacaaatactcctaccatggccaataccaagctagccatgtaatgtcactgaaggcagagttgggaagaaatgctaacattcagctcccactggccagtgtgagccagtggcagcacaccattgaaatagacctgggtacaaattcaactttgacttgtatgagctatgtgaccttaggtaagtcacctcacctctccaactctcttttctcatctataaaaatagaatagagtgctattcaatgcctacttcacagggggctgtgaagatgaagccatggagtccttgtgcagggctgagcactgccaccccccactccctactgacactggggccacagagacaccctctggccatctcagagggaagcccgcatctgctgaagcccctccctcctctgtcacccagccccttccccatcccagatcctgacctggaatcaaggccatatttatttgggcaagcttgggaccagactttcttgcctgggctcaagtctgctccaaaccccttccctactccccaaatcattgaagaggaaaccaacacagtgcattccagaaggaggccactttggggatgcaggaggaacaggataagtttagtgcccattagagacatctcagagaccggaggaagccagtccagcatgaaaggtctctaggctttatcactcatcatccttccatgagtcattgttgatttcactaaagctgcggctgtgatggggctggatgttccccatgacggtggcagtcacagagagtcaagcacaccccaagtgtgtccccagcctctccttcccagcaccagatggagtgactaagtggggggcccaggggagaagacaggctgggggccagaaggagggcagcttagtgaggggagagtgtgggagagtatagacagtagacgaggaggagctcagatagtgacctcaagactcagtttccccactagtgggatagggccaatctagactgtgcaagtatatatttcaaaaaatcaaaaccatgagtcttatgcaaatatagaaggaacatgcgtcagagatggattcaactcactaacgagggaaccagtaggatggaaaagctgactcaaggagcatttgaggaattgggtatttataggtatttcaggtagggttgcggggagcatagactaagacttctaggttggatagaaaatggattaatgtcctgtaaggcaataaaaccacaaccttggggagtatctcctctatttgacaaaattctgcaaattaacccagagtctgagcttttaacaagtagctgacaatgaagtcaaacccaggtgcattctccagaagaatgaagtaatactggagggcctggtaaactatgtttcattgtcatgttggaaaaacgcaccgctacccttctgcctgatttccaggtttgcgtggttttcaacaggacagagctcagctttgttcctcactcccacctgccacgtcctctgccgccatctctcctagcttagggacacctggcttctccctccacctgcttcccctctctgcctccttccttcaccagcccaccctgcccccagacccagagctgcagggcggggctacagccagcctcacctgcgttgagaccctgttctcctggacccttggcaggacctgcctggcccacgacagacaggctgaccgctgctcagctgctcctaggaggcaagggatgaggaggtcctggctgggatcgggggaaaagggggagagaagagggccatactttttgagtcctaggcagaaaagactatttttaaatatcctcttctaggggataaaatgctcccttcagcctccctctgtgtaacaagatgcccagaactagtaggtctccccttttgaaaggaagcagcctcattaagcttcctctgcatgtgaggctgggtattttatgtgaactatttcactgggtcctagaaaggggattgaaccccatttgtggatgaagaaacaggctgagatcccctggttagcatggaggatcagttgcccaagttctgagtcagactccaggtgcagtggtcctatgggtgctcctgtgactaccccgatatcccgcaccccctctgcagggctttgcagggagctgcgacctcaggccctggggcggccctgattagggagtgggtaggaggcggggctggagttctcagcagtgagcatgccttggtttacacagacctctctctatccaggatctctacgctttagacctggagccctaccgctactcaggcgtgaacctgacaggattccggattctcaatgtggacaacccacacgtctcggccattgtggagaagtggtccatggagcggctgcaggcagctccccggtccgagtctggcctgctggatggagtgatgatggtaaggcggctgggtgaggtgaattccaggggcttcccacctgcctcccttcttttcttctctccttcctcttgtttctttcttccctccaccacttctcttcttgagaccttccatgtgtcagccagaccccaggctagggattggggacacaaacgtgaaacagacagtccctccccaagggacccatctgatggggatccagacatgtaagcaaaaggtcacaaagaacaggaataaggcccagagatgcaggtcacagaggaactcaggctgtgacacacaggtgtgaaggccgagaaggcagaaagaagaaggtgtggtcagggcctaggtagcaggggtggggtgggtgggcaggagaaggtctaagctgcagaggggggtgctcaggatgtttgtagagcagcagagtcagccaagcctggccactcctcagaggcgtagacagagtcacctccagggcctctgggcctgttcgctcaccaggacatcatgtacctgtggcaagggaggagaagggggacagggcagggtgggctgaggactggagggccttgggagccgctctcaggcaggcccttccctgcagactgatgcagccttactgtacgacgccgtccatatcgtgtccgtgtgctaccagcgggcaccacagatgaccgtgaactccctgcagtgccatcggcacaaggcctggcgctttggcggccgcttcatgaacttcatcaaggaggtgagtgccccacagcccccaccagtgttgtctccccgggactgtgggccctgtagagcagcagagtggtctgggagtcaggaaggattgattctcatccatgtgacctcaggcaagttgcctcatgtctccgagcctcagtttcccgtgtgaaaatgggctccataggaccaaacttatggcatgattgaggggcatacatcttgggcatgtggtaagtgctcagcagctggtcagcattgccagcaagatgcagcgtgggcttgaaagtacaacagatgagggtgtttgcttcctcgctgtatgaccttgggcgagctggagagccttgctgagcctcagtcacctcatctgtgaaatgggtatatgaagcataacctacctcgtgggcatgtgagatgaagttagacattgcgtggaaagtgcttagtgcaggaggagggtcaatacataataatcagccccacaaactcatcttcacatcatgggcccactgaccaacttcccagccagcacccccactgggacccacctctcctggtaccagctctcctgtggaaaaccccatcaatggagctgattctagagaaaccagagaatatggaaactgtcctgctgcctagaccatggaacacacagtgcctacttttatttcaaaggcttctccatctgccactgtccttgtaagctttggatggcagggcttattgtccccattttatggatggggaaaattaaggcctgaacttgcatcctggctctgttacaactagctatgtgactttgggtgagctgattaactctttgatcttcagtatgatatagtgagtgcctgcctgaaggcggtgttgggaagacagtgaaaaactatgtgcaaagcacctaacccaggacctggccagagtcaaatcccagcagatgatagacaaagaaaattggggagtatgagatctaggcagagtcatcctgggccagagggagtgaccatgtccaaggcaacaccaagggcagtgggggaagccctctagaaggactcgggatagaaaggacaaatgagctctctgtaacaatcacagcgggccggaaatgaagccagctgccttcttaggagcacactcatttattcaatcccactttgtgactggcagctgggttccaggctcctagctatgccctgggggcccaacagagctaaaacagactcgcctgtgcacatgcagatcctagagagggaggcatcaggtcacagcactaaaggagagaatcccatatgtaaataaaggcagctctacgagagcaaacagcagagaaactccccaccttggatgggggttgagggagggcagcttcccctgaggtcccaagttcaccatcgctgcttccagatgaggccaagtacagctcctctcacacagtagaacaataaatgtggataagatacaggctttagggcaccacacatgtgcctttggatcgcgtctctacctcttcccagctgtgtggcttcagacacgttatgggacatctctgagtcagtttccacacccggcaaactccacctcacagttattgtgagggatgaattcagtgcctgactggagtcccttgtagttccttcacccctagaagggactccagtcccagatgttttggcataggagggcctgatgatcccttctcatccagcttcccatccctcaaaactgcacaggacatcccactgtccaatgccctgagcagggccctggctgggcaatcatccgcttgctctcagggaactctgagacctgacttctggccccctgtacccccttcctcagcaggcctccagctgagcagccactgtgtgaggccactgtgagggtgtcggtgtcccaggccacacctcgatcctattgctcctctggctcaatcgggaaatttgggagccttaggagccagacaaaagtgacttggaagcttcaccactttttaactggataaccttggacaagctactgaagctttctgtgcctcagtgtcctcctctgtccagtggagataaaaatagcaccttatcatcaggttgttctgaggattggtgagttttggcacgtgtgtcgcactagggacaacgcctggctcgtagcaggtgctgaacaggttggctgccatcactgttacttccactatcgctactgttatcactgtgccttcctgtttgctaatggggttccactaccaggtctccaggccacattgtttcagggacacccaccctgtttacactttgcccctcaacccttggaaattttgaggctcagccgtgagtccctgaggggagcagattcaccactgcccaccatagaaagaggagctccattctccttcccaggcccaacgagtgaccctcactgctcacactccctcacagaaccctttcagaaacatttatcctatctccattttacatccatggacatggctaaggcccagaatagccccgtggtacctgtggtcccacagctggccacaaccgaacctcagatgcctgcccgaccccagcacagtcctccgtcagaccatttccaacttgcccgtctccccatctgattgcatgacagtaaatcattttaaagacttggcatttccgagaggagctggaaaataccaggccggagttcagagcgtgtgaagcatctttcatttagcaagtcctgagcggtggctagagggggcgggcagcgcaggaaatgtcactgggaggagctgcctgcactccctggcctgccctgtccacccgcccacagacaggccgtgcacctgctggcattttatacctctgtagctgacaggcaggaaggcttccctcacagtgcaggtttgaaggcacctgctgtgatttcccctgggggccaagagatagcctgaaggcgtgaggccaacagaggagagaaggcggagggactggggagccagcctgagggaagctgagtttccctgtgaagtcataaacagtggcttttaccttctctgatgcatcttttaatctctgttcccgacccctcggtccccagctccctaggcaccatgtaagcttccccgactccaccttaggtgcctcgaccccaggactttcagcactgctactgcaacgaatctgtcttgtcccacccaatacttgagacctgcatcattcagtccctctttgagcctcagtgtccacatctgcaaaatgggggcaatgctgatgcccacctggcagggtcacagtgaggactgaatgcgctcatgtggggaaggataatagccctctgtgaccagctttctactggagccttgggccagggcccaagtgactggtcctcccttcccagccaagggccagccctaatctaagggagctgcacagatggaagccacgaaggagaaataataacctctgtcacatccttgtgattgtgtatgcaggcactgtgctcagcgctctatatgcctttttatacctgtgaagtaggtaatttctctcttcctgaagctcagagtggttgctttgtttgtgcagagcccactttctaaccactttggttttatagcctccctctcctccaaagcacagccccactgcctgagtttgcatatgcacatttacccaactacccatttacctgtaaaagtaccttggagctgcccatgtgcttggagatgtctaagggttttcatttgggatttgtcaatgaaactccagggaactgtggacccctgaccttgtgggttgaactgtgagtgtatgcatgggtgctgggggcattccgcagggagaggctgtggagcccgattcagaatctgcaagggagcatggctcggagtggttaggaacccaatgcggcaaagcaaggactgggagccaggctcccactactcagaccttccattgccccgtgcctcttctccggataccctccctcccctaccctctctctggcccaatctggctgtgtgagctcccagattttctcccctcctcttgctcccaagtgcacatttgttcccaaggactccaggatgtgtgggccttgttcttgcccctgacacagaaagctcgggtatttaactgtgcaccagctgccgtcctaagttcctggaggagggaaacaggtccagaccgaggggtcctgggatcacgggttctagtttggctctgcctcttgttcactctgtgagcttgggcgacccatggcccccttgaggtctgcttcctcgtctgtaaagtgggaaccatgatccttgcgtggccacctcccatggctgctgtggaggttgcacggcatgaacagtgtgaaaggaccacgtagactcagtgctctcagcccgcaggaaagatgttatctagaatcaagttagcaagctttctctgtaaaggggctcatagaaaatagtttagattttacaggccacacagtctctgctgcaactagtcaactccatagttgcagcacacaagtaatatataaacacggggggcatggctgtgagctaataaaccatttacagaagcagccaggggccaggttgacccgctagccataggacgccaacccctgatgtagaagatggagcttttcccactttaggtctgccccaacctctgccttcctctctctgtgttattaatgacgctaatgacgatacaaaaatgacaaaaaagctaccatttatccagtgttcatcttgtgccgggaccgttctcagtattttatatgacttatctcatttcacccttatagcatttggtaagatggacacaatgattagttccattgcacagatgaggaaactggggcagacgggtaaaatgaaatacccaaggtcgcacggctaattgtggttggacccagcattcagacgccagagttcttaaccacagcacacatggggctggagctgggaggttggggggtgatttcggtctcccctgcctttcggggggctatgccaagcgtctggttctacagccaaggccagcttggccctttggcttttctgcttcttggcaggcctcacctgccctactctgcccgcctgcctccctacccatctcccaggatctgacatgggctcccccttcccatgacttcagggcgggggctcatttgagcgcatccaagatcgatgttgtacacgagaaggtgcaaatgtaaagctggctaaagagcataatagaatttatggaaatcgctggctcacaccgcagcccgagcaatgatggaggtgattattaattaatcatggtcttgggggaacagtatcagtgcaaggagtaattaaaatgaagcattgtacagttgtaccgaatgatgatttataagcccgaggaattgccgctctgccctctcccctccgcaggctcaatgggaaggattaactggacgaattgttttcaacaaaactagtggcttgcggacggattttgatctggacatcatcagcctgaaagaggatggcctggagaaggtgcgtggtctcaggagagggagggcaggcggaggagcaggggcttcttaaatctcctagggcagacctcagtcagaggcccagaggcaaggggcaagacacagtccagctgcccctcagggattgacttggtccagtgtagcctgtagctcttgggggcccatcagagaacaagaaggcctggttggactggagggtacagaagccagtggcctggctgcagcagacacccacactgtcactctgtgagtaagggtcattggggatgcctaacctcggaagcataacaaaggcccatggggtggatggactgtctctgagtccctgcagggctgtcatggagcagaaggacagacatgttcttgggtaaaaatttaagaatataaaaaacataaaacctttctaaccagagagtatctcccctgtgagtagtgagctcactgtcactggagacatttaagcaaagatagagcagttgcttgtctgggagactgaaggtgattctttcccttggaaagaggttgaagcacatggattctgagctccttcgctctgggcttctaaggcctctgcgattccagagagtttggaccaggaaagcgggcctgcctggggctggggcctcccatctggctaacatagagatgttttaatgaggccaatcccagtccctgggaaccttcagcatattctgtcaatgtcaggctgctgggccaagaagggagatttaatacgagccctcaattcacagcatcccctgggacctggattctgggggctcagccacactctgtccccagcaagtgggtccctgggagccacaagggcacctccccaaccctgcaagttgctgtgtatgaaatgtagtgagcagaagccagcagagtggaggggccacttcggatgcctctggggctcaagactctgatttcggtcctctccaccccggcagtgccctggttcaagcattttatgtggattattttaacatgccgccctggttcttgagccctccagccatccagagtgtacacacagatgaggcttccccaagcacagctctgccctgctctgaaactgcccatggctccctagtgccaagtcattaaacttcagctctccaagaaatgcaccaactggcccttctgggcctcgtttccacatttccctgaaacataccccatggccccatcatgctccctccctcctggacctccaggccattgcccacacaattgccctggttgcaggatgtgacctctgtccctcaggcaaaggctggctctgcctagctcaatgctgtcctccttgtacctgtggccacagttattccagtctctcccgactttcccacctactcatgggagccactgtgcaagggaggaggtggctggggaagcctccctattactctgtaattatttcacaccatatatagcatcagtcccttaataacaggggctgtggcctcccctcctaagatcacaggggccagtttgctcaaccctacacaaactctatgagttctcatcaagcgatcttccagcttctatttaagctcctgcagtgatggagagcacccttcctcctctggcagtgctagagtgaatgcagtattcactcaagtagctgtcccacttttgctctctcagctacccatctctagggataacctaaaattctagggagggcaattaggtggcacatatgccactacttcccaccctgtgccataaaaggcatcaataatccgtcatttgagtactctttccacctgatcccacctgcaacatccttctccaaacagccctccaggcagctggttcaaattggccgtagctaatactcaagaaaaactctattatccctgggcagaggttagcctgccagaggcactcaccaaggcaccgggtcacagccacccggactgtgagcacagagcctccacaggctgggtcctcctcagtcctaactggcctcacatctccatagcacctggtatctaacagagcatgcagttggagctcaagtgagggtctgtgctcttcatgtggcctctgaacagatgtttgccaagcacctcctgcacccaggtgctctgctaggcacgctcaaagtgagcttggctctgagctcagcccacttaagagaagagcctcttcgatgccgtctaccactttcctctcctcaaggccctgggtggtctatgtaggcagggatcccgccctgagaggatgctgagctcccaaacacagctactctgcctctcatattatcacttgtttgctaagccgggtcatagctgatccagccagctccaaccggtggctttgggaggattaaggcagaattacccaagcataattacatgtctctctgctgtctgctctgcgcagctctcttaatgggatgtttgcattcagcctctctgtttaattgattaagtgtcctgagtagcccccctaactgggccaaggacagagtgggcatgcagaagccttccttgagtgagaggagctgagaccaggcagagctggccagagttgggtcaaaaaggatcttcaagaggcccagggctttaggatgatttctaaacttgacctttccttctctacctctagcctcaggcccgatatccacaaggacgctgtagagagagagattattctaccttagtctgtgtgtctgccagttttaaatgtaaaaccacaaagcaaactgcctttaaacccagcagcatttcccagtgaggtccatcccctccttgtgctgccaccccaaaacagccacaaagactgtgtcccagggcaagacctggcactgaccatagacccctgattccctccagcccctgattggcatctgctcagccctgagacccctggggctgccttcgcatttgctgtctctctctgcattttccccttcagctgtgatgggcttgccagcaagggaggtggcagaattcagagattcgacaccctgggaccctcgtcaggagaggagggagagctgcagggatgttgtccagaacggttataactggaaacacaatggcagtggtgatgatgatgatgatcatgacaatgaggctcatgatgaatgggaatgagatgaaggtcttgtcgatatggaggaagatgggtagaccaaggactcggcaccctgttttctgtctgtgtccatccaggttggggtgtggagtcctgccgacgggctcaacatcactgaggttgccaaaggccgaggccctaatgtcaccgactctctgacaaacagatcactcattgtcaccacagtgctggtaagagcctgcagcccctgcaggaaggactgtccgacctgggggtggggtggccgttcgggctggagagtcccctctatcccccccacccagaagatggaggctgcaggtaggtggagacttttagagtcagcaggaagttctcagagagcagctggagcgcagcagcgctgctcgctgccacgggcggaagccgctgcgtttttgtgtctcactcccactcactccccaagtccttgatgtctgagtaggaaccatgctggatggtggaattaagggggtttgacagcccattgcaacctgagtgaggattcgcctctcccaccccagttcccaggcaaaagcctttcccacaagtcaccccagctgtggtgggtgctgtggccacacctcgagagcccagcaggtgctgggagcctgtacacatgccgcattctatagtggcccttccgagagccgtcagccactgccacaccccctgcctggaatcacaccccatcttctctctattccccaactgaatagcaccgccttctcctgacctgtttcaaaccaagaagcaactctgggggcctcccatgggctctctgcacctttgagctcatgcgggggcaggaggacagacccaggctgctgacccccttgtgctgccagggctgtgcccactccacctgtgcctgtccctcctggaaggcctcagaggtgtccagagactcaggacagatcctctcagggacacagccctgcttttgggggctcaagccgagccatcttggggagaggcagcccagtcacagcctggtgaattatgactgaagaccctttgaggacaatgctagctctagtcagctctgactcataataaagcaaatatatttataaggaccatatgctggggtcattcctctacacaaaagggagttcaacccgttttggatatagtgaggctgccttggagcagaacccaggacagactggtcaccctatacctggccccttccacggtgctcagatggggcttgttctcacccatgtgccctcagaggcagctgaaccaggccctactgggtggccctacctgggatgattcaccatatatgtgcttggtggctgggtggcagatgtcatggaacaggaagggaagtaatggggaaaaaaccattcttccaggtagcccagtgagtggcagataccaggcatcctgtcggcatccagagataaatgttagcctgtgagtctcaccatcggccctcggggttaggatgattgagaggatctgagctaaagatgatggagatctcacggtggctccagacaagctgcccacagagcctgaagaggtggtcttaggggacacctgtccccctctttggggcaagacccctactatcttcttccctaaaacctcacatcctgctggcctttattgatcaactttttgttaactaaacaaatataaaaatcagtctgctaaaaccaataagcaaaaatatctcaagaggaacagggttaaaaaaaaaaaaaacctgtgatgtaaaaatgtaaaggatgaaaataaacaaataacaagagcaaagggattagggtgaagactaatgggcaattaaagggatattgatgtggataaaaatagaaaagataaaggagggttaaaaagagaacaaaataaaaaggttaaaaggaaaataacaaagagaaaatgaagataaggaatgagataaaaaggaaagatagtaagaaagatgaaaaattaaataatttatagctctgactagacaaggtaaaaaatgtaacacccaaatgtcaaaaagcaaaaggataaaagtgtgacaaagctaaaatataaaagggtaaaaataaaataataaaaaggtgctaaaagattaaaagcagagctgcataaaatgtgagatataaataaaacacttttcacaaggcaagattaaaaaaaggtaaaactaggatgatttaagagattaggaagagagatgattaaatgagctaaggtgagtcagtcacaaaacaatactctgaacagtaagaggcaagctaaaggtaatataccaaaaggatacaaaatataagcaccttgaaagatcaaggggttaaattttattaaaatggtagcagcctgatttcaagggcataaaacccttctgcaggggcacaggggatttttgctacataagcagaggcagaatccaggagacaccccatgctctcgacctgtgagtgcttacagcttctctgtcaatacttgcagcttcttgcaaagatccccgacctgctgtgctcactgaatccccagaggttgcattcccagtatcctgctggttcctaggtagcccagggctaggaaagcagagaacccctcttggctcatagcctggtcacagctccatctgtcccacagcctctcagctgcaaggcatctgggcagatacaaccccagagctctttgggacatgcagtgccaccaggacatgaggaaagaacagtttgatgatcaaaagcacagacctttggggtggagtcctggctttgatgttgatttgccatatgaccctaagaaattgcttatccgccctgtgcctcagtttctccacctgaaaaagggaggtgttaataactgcacctacttcatagagttcagagcatgaatgattaattaagtggcacagagtgcggtctaagtgacagctgctattgttattcattattattgattacaaatccagtccccagtgagctcagcttgaatacagcatgctgagtgagagatcttgagaaaatctccacttctgtccacaggcagagccctgaacttcaccaaagacccctgcccatggccacagaggtgatctctagcacaggctgttctgttacaaacttaatttgcatttgagtgccttccagtttcatggccattccctggctcaccatagtcccccactctgcccccgagccctccctatttgtttacactgggctgcttcttatagttgtgtttctcagctggccattggaggcattagggtttgcagcctcatgggtccctcatagtcctagtctcctactgagatatagaactccagatcaaccaccacctcaccttctaccttggccacggtctcagctcctgaagcagatatcccaccgcctatggatggggccactgaccatcttaaccccatcatgtagtatcaaatactcacatggcctgggggtgactgatgattcagctgtctccatccccactgcccagagatcaccggagggtgaggtgtgcttccccctatggggcagtgagagaagcctactgtttcctggaggcaggggaatggagggaatgacctctggagtatccctgatggggatagaggatgtgacacagtctttacatgggcttccaagaaagtctgtctagccagaagtgtccttggagtctcctgaggagagatgctcgctcccatgcaaggactggcctagggccccctgaaactagagctgctccagatgctccagagaatgttcccaaaaggctctgcatggtctgcatgtcttggagccctaggggatgctctcaggcttgggctctttgggacagctaaaaggtgacagggagtggcccagccccagccactgtggctgaaaatccaaccccatgcttcgcagcctgaatgtagggccagcacctcctgctgagagcacagccccagcctgtctgggaggatgttgtcagggcaacagtgctttgagtgacaggcaggtcccaaggtaccagtacacaacatcaaactgctctgcctctagggaacagggcctggatccaagacccctgataagggggagtttctcctcccctttctttcccaggaatctggtgtggcagaaagcagcagctctgtgtgagctgccaccaaacctacctgctattctcccctctcctaaacccccagcgttaggtgctaaagatgccttaccctggacagacagatggacagagccctggcactgccctttctggcccctcagagccactggcagccttccccattcctgagatggaaacagcagcagcaggagactggacgcctgccctcccccgccctctcaccgcccggccccagcctctgttctggttccgctcttccacgagctcatgaaaaattcatctgcccaaacctcagctcacacactgagaaaacacacccggcccactcttgggggcccagcttttgaaggttcaagactcgtttggctgccgatgtgagccatggtgtcacggtgtgggcatgcgtgcgggtgtgtgggtgggtgtaggaccagctacacacgggtatctggatactcagtgatgggtgcatttgtgccgtgtgcacatcgtgacccacataggctcaattgcctgccaggcaagcccaacactcagcacccagcagcaggagaggggaaaaacctggggctagagtgttggctgggagaactatcccaggctgggaacgattctaggcccctcctgctgggagaataggactcctgatactgtgtgctggttctaactggttgaagccaaggcctcaggtccaaggtccttggcctctgtgtctgagaagggctaggcagacaggacatctgaaaatgtggtgcatttgtgccaaggacattgtatatacttgtgcgtgcatgtgtggctatgggctgacgttacctgtcagaaaggagcttcagaacccagatatcaggtagctaatccctggatccttcccaaattggggataacccccaagactccctcttccaactccatggaccctgtcacactgggagaggcttagcgctaggcctggcttgcacgctggggtaagtgatcggagagaaaccggaccaagagccctgacaacggaaagtcagaaacggttatttttctggacccctgttttccgtgacttgttgaagagaaatattacccctgttcctatggctgttctcccagagcaatagaagagcgtgaagttatgaaattgagggcaccttcactgagcaatcgattagcagccgagagagcttgtgaattggctgtctggacatttccagtaataaattgtgaaatagtccatgaataagtagttggcggagttcagaattaccccctaggaaatgttgcaggtctagagacacattactaaggcgagcaccattttaatgctctgggctttggctgttaaatatgtatgccatccgcaaagcacttcccgaaattaatggcattttacagctgctctgaaggcagcgtatttatatggagatgtatagattctggggctgtggtggcttcacaaatgaagtgctaattttagaggatcaggccagggaggggcgtgaagacagggtcaggaagtgagctatctcagggacctttcctgaaatggttttccgctatcaaccatgagttttaacctttgatgcattgggtgtggcctctaggctgcaaaggtcactgcagtaacccgccaaatagcatacaagaaaaagataaggatgataatgattaataataataataatattggcagctaacagttgccaggcactattctgagtgcttttcgtagactgactcattttatcctcacaacaaccttgtaaggcaggttctattattttccccattttacagaaggaggtaaattttgcctaggattctgtgtgtggttggtggatcctctgggaaagatggtaccttctctctgatcctttccatcagctaaagtcagggccaccaggtgcagtggtgcaacttgtccattgcacaagagcatcaaccaaaagaccctgctcgccaggccccatgccagggtgcaggagcattgcccagagatgaatttgcatgaaggcagtgcatggaccagccgatgtcctccttcctccagcctcagcacttttcccaggccccacgtggactcttctccaaccttgttgagctgcctgcttggttggaaggcgagtgagagaggcactgagattaagcatggcgcctagccgagggtccagcttcctacccagttagactcagaatccctggctagtcgggaatcccttggggattcagagactgccccacccccaccagttctttccctgaagcatcccaagggactgttgaaaagctccagtggatcaagcatggggcaggatgggatttagagaagtagcactgctgggagagagggccaaaggctcaagcttgccgccacagcgggagcccagcaggaggctactggtgagcatctgctcctaggacctctgacaaaggtcttcaccgggtcttccactgcccatcccaccctggggctcatgaggtcaagggaatggccccgccagttgagtgaaggatgaggcacctccatagttaagcatgtgccttaatctgggcatgcagacatgagcttcctggtttcctgcattctgtcagctaaccatggtcacacagccactgaaggcttgagacattctgtcacgttggggtgctgaggcaggtctggggacgtttggctgacagaaagaggcctaggagctataggcaggaacagggcagggggcgaaggaaggaggctcaggggagtcagaagaagactagagttgtccaggaacaggctctgggatggcagccctttacctgatttggggatctggaaaagcagattaactccggaaggtctgaccccagggaacagacaggagagccaagccagagagaggtgcagctgactgggaaggattggaactggatcccatcactgtagttcagttcctgtgtgattttgggcaacttactgaccttctctgagcctgaatttcctcatctatcacataaggacagtgttactatcttgcaagctagtgaggcttaagtcaaacagtctgtgacaaagagtttaaatcagtgcctggtgcagagtaggaactcaattgtgttgaattttctgggagttcagcgcatccatcatggacacgggatggggctttgtgagtgaagccagatagacggtgccggcaaaagcgtggacttgcgtgttgacctggattcggacttgctgcatcggagcccacagttcctcacactgcatatctcgactggatgaagtggatcgcctctctccactggctcttctgcctcttctcccagttattctttgcagggttgccaggggtttgtttctaaatgagaaatcagacaaagtcatgctctgttcaaatccggtcccaggctccctatcacccagaaagaaagaagcctgtggcaggtggagggggtggatggtggggggtctggcatgggacaggcatctctgacccacaagcaccttcctggggatcgcctgcccctgagggaggagcaccatgggcctcaggcacagaactcgcactctggggtcacactaacctgaattcagatcttctctcatgccggctaggggtgcttgcacaactcacatatcctcatgaacttcactttctgcatctataaaatgggattattcatacccaccccagagggctgacattaaggtgaaatgaggcgataccagctcctgtctgctgagctctgctggactctgtgctaggccccccatgggcataaactcatttgctaattgaccagtgcccggcacagccacctaccgatgagctgtccctgttaccagtaatcactcccctgggatcctaacacaggggactgaggaggttcttggaaagagagaacggcatccaggagcatgtaaatctaatcttttaaattggagttggaagagaagttagagcagacggctttctgaagggctttttacagcagcgtcctcagacttgagtggacatcagaattccctggaaggcttctgaaaacacagatcgctgggctctccccagagtttccggttcagttaggtctggggtggggcctgagaatgtgcatttctaacaagttcccaggtgatgctgatgctgcaggtgcagggaccacacgctgagcctctattactagtgcagcaaagagaccatgggccttgggatgggtctccagttcaaagccctgctccaccgctcactagctctgtaaccactgggccattaaatcagtaagtgcctactgagctcccgccctgtaccaggtagccattcatgaggcccccagctggctctcaggacatgtgctttcccgctcctgacttcacgggccctttgtctaagccactccaaggggtttataaaaacatgagcagaggtcctagccctgactctccagtgcaagcctgcctccgccctagctgctcagtcttcgtcacaccctgcccatctgtctctgcaggaggagcccttcgtcatgtttcggaaatcagacaggacgctatacgggaatgaccggttcgagggctactgcatcgacctgctaaaggagctggcccacatccttggtttctcctatgagatccggctggtggaggacggcaagtacggggcacaggatgacaagggccagtggaacggcatggtcaaggagctcatcgaccacgtaagcatggatgggagcatgggagggctcaggaccctggggagacttggcctagaactgtctgcaccacagggctgggcagcctggcagaaaaaggccctggggacaggagtgatggagatgaatgctgcaaccttgaggactggggggcctcagctgaaggaagtgcaccccagctctcatgggctgccttgctcatactcccaacgccattctcctccgtacacacacagatgcactggcctccatctgattcagagccggccccactggcatctttgatgaacttgctctggaggaggcctgtggcttcttggtatcttctgctcctttaaaaaccaccagaggatgccccagctatggggcaaggcacccacatgagacacttcaccaaattcttggacacagagagaaacccgtcactgcattgagtaactctgggtctagtgggagtccaggaagctgagagctgggaagaagggatgagcagggcctggctggaagcaccagggagtcagcctcttcctctgcctgggatcaggagaggactgaggacagctgggagcccaagcaggcaggtgagggggtggggggtgtacctgggcttcttgagacattgggaggaagagggagaagccacaggctggagacaccaccacaagggaggaattaggaggccctgggctcgagtcccggttcttcctcattagctttgtgaacaagggcaagtcactcaacctctctgagcagtttctccctctgtaaattgggcatgttgacaccccttcctcacgcgattgttgtcatagtggcagaagactgggcctagagtaagttcagtaagagggtccctggtaagatgctgtgagcaaacacatcatagttctcagacgcccaggctgtggcccagcaggtctgggttcaagcctcagttttgttgtgtgaccgggtaagttcatcaatctcactaaggctcaatttctttatttctaaaataggagtaattgttgctgttgttagagacagaatcacccaaggtggagtgcagtggtgccatcacagctcactgtagcctcaaactcctgggctcaagtgagccacctgccttagtctcctgagtagctggggctacaggcacgaggcactccacctggctaatttttttttttttttttttttttttttggtggagagcagggtctcactttgttgtccagactgttctcaaactcctggattcaagtaatcctcctgccttggcctcccaaagtgctgagattacaggcatgagccaccatgccctgcctaaaataggagtcattagcaactaccgtagctcctgtggttgttgggggaattaaataaggcaccatttccacaggcttacctggcacacaataaacatgacctgccttccagctcagggccctcaacttgactgaagcattttctatcaaggagctgctgctgaattcaaggacctgatccatactggaccccttagattccttctctcatttatccttataaaagcccagtgaggtaggtactgttattaacacccattttacagatagggagactgaggcagaaagagatgaagtggtggagccagaatttggagcctccctgcctcgtagccctgtgttccagcttctgcaaagaaccatcctgaccccaggggccaggacagagggaggttcatgcagagatctttgcaacccacagagtatcagccaaaggttatgacttcacctctccaggatgggagcagacagcatcagggacttcggttaagcccccttgcctcggtctgaggggagctgcctacagagaccttggaggtcgcaagtggggagggaggctggagctcaaggcatgaaggctggagcctggcccagtggagtcacttcctagtccccagcaaattgggctcctgtggaagtctaataggagactcaaatggtcaagagcatgaactcgagctcagtttgattcaaactcttccgcttgctagctgtgcattcctggacaagtttcttaacctctctgtgcctcagtttctgcatctgtaaaagggaaaagatattaataggacctacttcataagattgttaggaggactaagttaacatagtgtattacatgtcatcaccatgtcagtatttactattattatttttatttttatccttacaactattccttggaggctggggagggggcttcaggaagtccccttatctctctgagctgcactttcctaacctgacagtgagaataataatacctgctccacattcttcacagcttgttgtgagcctcagaggagacaactggtggggaagcagcttctagattatagaattcaatataaacggaagggagtggtgttgtcaccgttattagtaataactataattattatggaaattagtcagcaggccccagaggcatctccatcttatccattcccctgcgtttatgagtggggcttggagtctggggctctgggtaggctctgaggctgtcatttgcagaggcaagctgggcaggggagaaggaagatcacgtggaaggtggaggctgggtgcggaggtgagcagggctgggccaccctcaccactcacaacatctccagtggccccacagctttgaagagctgtttgcaagggaatgtgatcagagaagcccagcatcagcctgatctccctaagctgaccctcagctgggaaaaggagggagtgtcgtccacggcctccgagcagccaggcggtgctttgggaagcccagtattcatcagggttacaggcctgacgagacatgcaggggaccttgttaagcccaattccctacaattgatgagcctattaatcctagcttggtgccatttttaataacatcataaccatatattagtgtcgtcagataattagtcttctcactagcccatagaaagcatgcaaaggcttggcaatattattacttccttattagggatctgaatgtaggcgtaaagatgatgaatgcccacctttgtaagtgtccaccccccggggcccatttggaggccctgggtggagcctctgaccaacaggacttaaaaagcccttcccagatactccctgctcgcctctgtcccgtgccacatggtcttccaagggttacagaggaagatggggtggctagaggatgcatcgccttctgctgacacactcgcctgccgcaagtcaccttgaactatagggacaacaataaacacgatcagacagagcagtgattataccctccatcccccatctctcatctaaatttccctctgtctatatttactgcctacttgtctgtttcctctttcaaaaatcttctactcacatccgtaccttaaattattcccatgtgttttgatgactctggaatctaaccgaaatgggttcaaattctgagtctagcacatttcagctgacagtgggaaagttattccatttctccggcctccatttccatgtctacaaaatggggataacaaaagagcctcctgcctggcattggtaggaagatttaatgagatatggcaccaaaatgcttcgccaagttcccagtgctcagtaaatgctcagtacacagaagctgtccctctcatcactgttccttccagggacagcctccctgtctaaagtatgtccatgattaaatgtgatggtggtgggagggtggcccctcagccgtggtcatcctgccaggccacagtagtccaggacctagaccttacccccactggatccaaacagggagcctcgaggagctgactcacattgatcagacacacagggaactgaggcaccaccaaggtgccaccttcttactttacttggggcactggacttttctgacactgggagtccccatctgccatccagagcttctgtgtcctggcaccaggtgcccaggagcccacttggggagtgcagaggcagaaccccaagagtggagagcctggagccaagaggagagctgctgctggagaagggggaaagaggtaggcattgaagagtctcgggtgctgaaccgaggaactggactttaatcccgagggctatggagaatctgaacccactgaagtggagccagggggtgacatcgacttggcacttgaggaaggtcactctgctgctgtgccaaacctgagccagtatggaagccatcgctgggacccaaacagggcgagtgctgctctaggaaaggagggaagtagatgcacagccagcagacaagcaggagaactgatgaggctcccgattggttggatagaggaggtaggggaaagcgaggagttgcggacagggcatggaattctactctggacagttaaggaggtgatggtgtcctgctcacatcaaaagccccctggagaaattgaggatttgggaaacatagtgaggtccatttgggatgtgttgggattggggtccctgtagatggtggccctgtggctgggcacttggaggaaggagcagggctggaggctgagctctaggagtcatcagcacatcctgcagggagcctgggaggtggagacgacagctgctcagggagagcagagatgaggacctggggtgggaccctgaatggcacagatgaaagggtggaagccacaggatgcctgggctggcaaggctggaggggaaggaagagaatcaggagagcatggggtgaaggaggcccaaggaagagaggctactagaaagggggggagggtcagtggcctcaaggaggtcaagggaaatgaggaatgagcatccacgagttggcacaagcgtgacctcctgggggtacaaggtcagccccagcagggtccttgagtgctcctattctcaaatttcaccctcggagacccagaattctgtcctggctgctctcccagccccctgcatcagagcaagagggaggctaacggggatgcataaaatctctgcaggccacgggaaatggattcttttctctctaagttgtcacatctcactgcagtatggatggccagataagaagttttccctgcctcatagatggggctggaccaagatgaagtatggaacacaatggagacaaagagtcatcactggtagccttagcatattgtatactttcctatggagaagttgcaccacccacacatccgctctgcttcccagtaacactgagtgcagaccagggagggtggcacagctagaagtgccaatttccctgtgtgactcttcttaccgacggggagcacttgatgggctaaacttggctgctgtcccaacacctggcatgggctggacgcacacagagcagcctcgctgaatgagggacacgtgggtgaacacatggacttgcatgctttgcccagaggcatggttgttgtggggtcgtgactagctggcttcccagccatggtgtgtgagaggagggccttatgtcaaggccatgaccccagtgcccaccatgtccaccatcttctaaccagaagcagatctgagttctggcccgcatgcatgggtgtcaggaggagcctcatacccttgtttgtgtggccaggaaatgctctgcccaagctacctcctttgggctgggccagcacaattgcaagtaaagcatgctgggagctcccccagggcaagtcagaatcctggaggggacagggcagttgagggcaggggaaactgcaaagctggactcctgttggagcagccaggttgcccagagcaatgactgtggagccctgggggagctcgggatgtctccagggtctgtctggggagaccagggaagcaggtgaggggtgcaggagggacttggggccccatcgagagtcactgcagaactgtcagctccagaattcagtgagcagagaccagcctggggaaaggcttggaaagagcctggcaggggtccaggtccggacaaacaggtgtaagagagcaagagggcttgagggatgaagggagtattgggggaaaccgaggtcagaaggagcagctgaaacatgcaagctcccctgctgaggatcattccttccttcatcaattgcacgaaagtttattgagcaatgtctcagcctgggagcctgcagagcagaacctgaggcaggggattatgccattactcaattaggggttgtgatgccagggaaagaatgagtgccaagggcaagggatgtggagaaggaaggaggaaggcaacacaaggatgtgttattgagctggttgccatagagggtgactaatgtctcagtctgtgagtctgcaccctggaaaaactttataaagtgtgtctcaggaccatctcttggggtaaacagaggaagggaaaacaggtttatccaccagctcctgactcccatgcattctgggtttggcttggtggccatgggaaccaattgggatcttgcagcagcgtctatgagaaaccacagggctggaggccagaggtggccagttgggcaggcattgagatgctgtcagattggacctgcatgaggttggccagagccagaggatctgaaaggctgcctgagaggggtctgagcccagacccaactgatactgtgccagacccagagcagtgactagggagtgagggtgacccaggcagacatggtccttaccctccgggggcaaacaatgaatcagacaagtgatatttcattaagattttgatcagtgctgcaacgggaaagatagagggctttgggagtataccccgaggaaaaggcctcaaacttccctgaggaagtgactattaggctgctacctgaagaatgaggaagagatgtcccagacaggtctaagacacatgtctgggtggatggcagaggctgctgaagtctccacctggtcagggcctggctggggctgcagctgagtgcgtggagtcccggagcactggcaggactgtgctagggctagccctggacagacagcacccttgtggacatgcagggggtggggacaggattcttttggagatggcgatagagattgtgatgcatcctttggagtgcgccctgaagcagggaaattccactgagccttcctaagaaataggcacaggctggtccccgtggggactcaggaaccaggcagttctcccaggcttgggagaggcacacccatcctttctcactgtcagacatccatcagctcaggaggcctgtgtgccaaccacagagacatgacccactggttgatacttacgaattttctagcacctgttccccatctatttaaatatatgtgggcttttcatggtgctgttttccaaggttatcgatggccacagtgccaagtgttaagattgacagctagctggcaggtcatccacagatattctctctgacttgttatcccccgacccctgctcccctttccctgcccccaccaactgcaggatggcactcctgagacagcgcttgctgggggatctcttttaaacctccagtgctcccagtgactgatttattcatttctgcaataaatctatcaagtcaggccccatgctagcagccgtggacacagcagtgaacaaaacaggcaggatcccttccctgatcctcaagatcctacattctagtggaagaaatgggcaattatctatgaacataggaatagatataaatattcaatgagagcaagtgttctgggctgggtggaagagcttccctggttcccagactggggcctgggctgacaggtcctgtagatcagagagcagtggggagtcactgtgacccatcccaggaaactttgggggaagatcttggagactcgagaggtcagggctagccatgccctgttgccttcaccagcagcagtcaggggaagccaggaagggcaactggttatgcagcagaaactggtgatgagggttgggtgaaggaggacatggatttgggaagctgtcccccaaccccagttatggccatggcactatgaactctggtttcccagcctccaggtgggttggcaggtgtgacgggaagatctgttatcaaagacacactaccattgcccccgctgtgtctcatcttcctcccaactaggaactagaccttggttctggcctgcatgtgttggccccaacctctgtctgcaatgccagggatggttccgcccaatcccattgccccagcctggagcagggctctttggagctggacatgctgggagctcacctgggggcaggggaaagagatgggctccaaaggtggagcccagccctcccccgaccagccaggttgcccagggcagtgactggagagctctgtggagctgaggattcaccaggacctctctgaggtgggaatgagggcaggtgagggctatcggtgctagggtccactgacaggtcagaaggaagaggggtagcaatgttcaggtgggttcatccggggccagggcacaagcagcaggctctaaactctggagagaggcaggcaggggacaggatcaggtgaactggcgagagttagtgcaggagacccgacgccagagctcagcccattaggctggggtaaggggtaagcaggactcttgggggtattttgatgctcattcttccagcaaaatttgattgagcccctacattgtgccaggctttgcgttaatccctacagacacatcagtgagtgaaacaagctcactccccacactcctgggctgtatatcctggcagaggagctgggcgtcccacagtgacttacaaataaaaatttcatagtgataaagacacggaggagcagtgcgggggctatgggagtgtgtaaccaggacctagccttgggggcaggggggcccactgccttccgctccgttgggctgtgctaggtcaggccctgccctgtctgggctaatacaactgtcagggtatgaggtgtggggagagaacttgactgaagggacacggagtccatggtgcctccaacctggggacccctatggggtctatgaagcagggaagacctgcccatccttcccaaaggacagaggcatagggatggagcttgctgggcctcagaaattgggctgtcctctcaggcccaggaagggtacacacatctttcctcactgttaggcagtgaggctgctgtcagctcaggaagctggtgaatgaatcacaggtactagtagttgacccatcggttgacacttatgaatgggctagcacctgtttcccctctgttcaaatttgtggacccttcagggtgttggtttgtcaggttcatgtccaaggcccttgagggacacagtgttttcttaagcttggaggctgtggctcagcagcagacaccgtctgtgacttgctttatcctcttgtaaacggccatgtgctctgtcagctgacccagaggacacgctcgctgggtgcctcgtctaaaccagcaacatcctactcattcattcccagagtctctatgaaaggcctactatgtgccagacactgtgccagccatggggcacacaacagtgaaaaggtgacaggctccggcctcactctcctgagctcgtggtctgagggggtggaaacacccagagaatcggccaatgcctctaaaatcacaactgtgatcagtgctgggagtgacaagtgcctggtgcgatgagagcagtcgccagggagttctgatttcctctgaggcttgtgtctgtggaagtgatgattgggctgagatctgaagcagaagtcggcattcactagacaaagagtttggggaggaagaggttccaggtggagaacagttcatgtgcagcatccggaggtaagaggaggggctggatgaacatggatcagaggggctgcagaaagcctgggaggaagagagatggggaggacagtgtaagaaatgttggagtgcctttcaatgcggcagccaccagccacacggggttatttaattttaagctttaattaattaaaattcaattaaagtataaattcagttcctcagtcttacaagccacatttcaaatgcttgacagccatgtgtggcccgcagttgccatattgggcagtgcaaacagagaaccttttcatcgttgcaggaagctctgttggacagcactggactagatcacgcatgactgtaagcaaccctagtaagaattttttatcctaagggtattaggaagtcctgacctactttaattagcaccatggatacggatagattcaaagtggtgattcccaccactttggggaaagagcagaaggtgaattctgtgatgccacataccaaagatgtgggcaggatgccagcagagtcccctgggaatagtcccgtatgcatggcaggagtgaggctggtttacttaggcagctgtggaagcagcagagggacctggaggtggcaagggtgtaccagcagctttctgcagctgcagggctcccaagccaggcaacgtgaagtatatgccgggaagccccatggtcaggggccagagtcaagttcacgtctctgggaatgcaacactgggctcaggacaaggcagggtgggtccagccatgatgcttgctcttcagagtgagacaggtgctggggtggggacagcagcaggctgtggaaggagccccatgcatcctgcacagggtctaagtggcaggaatgttagttccctagagctgccacaccaaatggccatgaactgccagtgctggaggtcagaaatgagaaatgaaggtgtcagcagggctggttccttttggaggctctgaaggagaacctgttccatgcttctctccagtcttctggtgtggccggcagtccctggtgcttctggcttgtatctgctattccggtctctgcctccagcatcacatggccttctctgtgtgtatctgtgcatcctcttttcttttttttttttttttttttttttttgagacagagtctcgctctgtcacccaggctggagtgcagtgatgtgatctcggctcactgcaatccctgcctcctaggttcaagcaattctgcctgcctcagcctcccaagtaggtgggattacaggtgcatgccaccatgcccagctaaattttgtatttttagtagagacggggtttcaccatgttggccaggctggtcttgaactcctgccttcaggcaatccacccaccttggcctcccaaagtgctaggattacaggcatgagccactgcgcccggtctcctcttttcctcttcttatacggacaccagtcgttggatttggggcccaccctcattcagtataacttcattttaactcgatttcatctgcaaaaaccttatttccaaataagatcatactcataggtaccaggggttaggatttgcacataattgggggtgggggggcataattcaatccactacatgtggcttgcatggtagagtggtaaaatgttgggctttgagatcacaatgaactgggtccaagtactggctcagccacttaccagtttaaacaagcctcctagcctgattaagccacttgtccccatctggaatatgacgaggatgttgaccacctggcggggatactgggaagatggcataggcataggcagcatacgcaatacactgagtcatgcttggcttgtctgatggggatcccaactaagaggtggagaacggagatgaggaagctggtgggaactatacttgggaatccaagcaggcagcttccagcagggacaccagacacaggcagcaagctgggagtcagaggccagatctcagacccttgggaggacccctgtcctaagagaaggctgatcagtgacaagttgttagagctgaggccacagtcccaaccccattcctggtaggaagatgtccaggttttagtctggagtacaaggcaggattcaaccagcaaccagggcatctggagactgaggaacaaaagatggagctatagcaggttaaattgttcttaccttcagtttggggagctgggggtgtggtagaatgggtgggggccaggtgacctcatgcaaggatagaggacactgggaggaggagaagccaggagggtcccaacagattcttggtaagtggaaagctgcttatggggatgaagtaatgtcctgggaagaccatcctgcctggtccagaggtttagaaatagtacagaaaggtccttggtgaggcaggagggctgacaaaacactcgttagaccaatgaaagtgttgcacaagtcaagggtttgatgtcattcaggacatgattgctataaatattatagcaaagaccaaggagcttctctccgagcctcagtttccttctgttaaaaaaaaaaaacaaaaaacaataaaaaccatggggttggaatagatgtattcctcgaatagacttgaagttctctcatccagctctgacagcctatgattttatgaatcatcctcaaagaaaacttgcacaagtgggaagagcctgccaagattgggcctttcattctgagtaatgaaccgaaacagcaaaggcttgacatctgttcccatctttcaagggaagttggacaaaataatgcctttctcagggaaatcgtaactaacggtgaaatgtagtattttctgccttaaccagaaacgcagtggagaactccagccttcctgaagcccaagggagaacacagatccaaactcccagtgaaggtcatattggccagttgtcttgccaccgtaggtatagaatgctgcggatgccttggtctcctgaccccattaaaaccaaagagcaggaagaatggcagggaggtttcaaaggctctgagaggatctgggggaagggctggccagaaggccaatcacctgtggccatgtgattagctttctcaccagcccttggaataatcattggctacaaacagctcagtcccccagccataactctcttatccaacttgccatcaaaagttaaaggaagattcatcaccgccattgactttgaggttcttcccaagaatccactccatttccagagaccagttccaaaggcattttgagcaatgataatgactttggagtgaggacagaacctcccaaagcaatatagagtaaagtgtcacttaacaacaggaatacattctgagaaatgtcattaggcattttcatcgtagttggaacatcataggctatacttccacacacctagatgatagtgcctactacacacttcagctatatggtatggcctattgctcctaggtacaaacctgtgcagcatgctactctactgaatactgtaggcatttgtgtatgcaaagttatctaaacatagaaaaggtgcacagcaaaaatagtattataatcttatgggaccactattgaatacgcagtccactgttgaccaagagagttaggcagcacatgactggactttgaagggacaggacttggggacgccaagttctggaatcaaagaccttctacatctctctcacgtcaacattacagagaatcctagaacttgaggactgaaaggaacctttcagggtatctcactcaggctcccaccccaccaagggatcctatctacagccccagcaggggctcactaactggaagctccatgataccagggactcggtctcttgctcaccactctacaccctccctgagagtttttttttttttttctgctttcttttgtatataccctgaactgaaaggactccaggagctggggtggcggcagcttgccccattcctccttctgccttcagccaggcaaattccaactcacacattcagacatttacaaaagaaagaccatttctaataggctcctcctccctatctttcccaggttctgaaggtcatcaaatccttggactccaagtgtcagtgatggggtgtgggggctgcctttagaaggagaaacattgggtaggcagtgtcaaagttgtatttcccagctgctcccagccgggagcacctgcagagctgtccagaagctgtgattccatccatactagcgcttccctccttgacatctgattttgactggattgctagttcctgttctaagatgagtgaagtcagagctagtgttagcaggtaccctttagtaaacagtttgattaatgcccatctcccctactagactgtaagctccatgagggcagaagtcatgtctgtttgggtcagctctgtatccctggtgtctgttggagttcatgacacaatgagtggatgaatggagttggaccaagttaatggatggacacctggaggcattgccttggaaaggggtttcagagggaggtccccccttgccagaaaggtctttaacctttctgttgttaggccccagcctccctttctgtcctctcctacttgaggaagggaagtgataacttagttcacattctgagatgtaaatatccacagaagccccaggggcagcctctcagaggggaaggttattaattaacaaatattccagaggctgagatggggcttggggatggagaaaagaagcagagactccgccccagctccagccgcactcagaaattcacaggcaaataagcagatcagacacaaggtcgcatggagcacagactgccattcaagcaaagcagagctggcttcatggaagtttagagatggaggctgcgagggagggtttctggaagaggcaagatgtgcagaggaaggcagacagtggtgggaatgagactataagaagaggacatcctaaacagtgtggaatgtgcagaacatggggctgaaggagggactgtggtaagcaggaagtggtttcattggggcctcatgggggaggatgccagtggggtcctggaaagatgggatgggaatgagggaatctagttttttaatcaggaaaatctcagaccaaaaaattgaactttaattcttccgcttattaaaattgtgatgggctaaaatttattaacacagcattcctagaattaccccacccccttcttttccactccgcaccacctcctattaataaaggccctggatttgcttcttttgtttcttttctttttttttttttttattttttgaaacaagatctcactctgttgcctaggctggagtgcagtggcacgatcacagctcactgcagcctctacctcccagcctcaagagatagagatcctcccacctcagcctcccaagtagctgggactacaggcacgtgccactgtacccagctaactttttaattttttgtagagatggagtctcactatgttatgtaggctattctcaaacccctgggctcaaactatcctcctgcctcggcctccaaagtgctgggattgcaggcatgagccacaacgcccagcctgcctgtctagtttctccaaaggagggtattatctttgcccaacttgcatttggagggcttttaggatatatagaaaatccagaatgtggtgaagcagtcaagaagtggatgggagaggaaagcagaattaaataagcattgtggtgcattctgtgtcctctttgtggttttgaaagacacaaataaaaagcacaagctatttttgaatgttcataggttactgaactgtatttatttgacaaagcaccattttgagaagggagcacatgggttacagctttaatagagttccattctctgcatgtttattccaccaccctcttcttcaagaccatgagctcttagagagcagaggttaagttgaattcatcattgtctccccagcaccctgagctggccctgaaggagggttagtaaatgtggaaacagaagagcggttagtgacctggggctgggacaactgacttcaccctcatctctcctccagcaatggtgttctgtctcccgctattctgagactttgctcatagtctgtctttctctctctgtctggttgcagaaggcagatctggccgtggcccccctgaccatcacccatgttcgagagaaggccatcgacttctccaagcccttcatgacacttggtgtgagcatcctgtatcgaaagcccaatggcaccaaccccagcgtcttctccttcctcaatcccctgtccccagacatctggatgtatgttctcctcgcctacctgggggtcagctgtgtcctcttcgtcatcgccaggtaaggcaattccttggccagacatcgggcccaaggttgaaggtctaggggttaggcaggtcctcatctcctcagcccctggcacagaaagcccaaggctcaggccactgctgtacccactcctcttccactccctatggctcagattcctttgtatccctcaaggaacattccatgccttggccctccccacccccacgcttgaatcacctggtcctcaccctcgtctgtgtctataactctgagatgaagcagttgcacctcaggtcccattggcaggctcgtagaggtcaagtggttgcccaaagtggcaccacatgagctaggcacctggtgcagcagactcaggacattgggtggcccagtgggtggcttagaacttggaaaacagggtgtgtctatccaagccacaacagcagggggaacagtgcccagtaaactcacagccatccccacatgcagaaacacggcacacatacacacatccctgtctgggctccctgctagcaacatgcttgcacatttggttgttcacataaagtagacatagcgcaccctggctggtgggtggtaggaggaggtcactatgggacaggtttcgcccagtgtttggcgaacacctagtgctcgccaagcactgtgctctgcactttacagctgttatcttatttagttcttccagcctcccttaaagaggagacacctgaggctcagaaagtctcaccacttgccaaggtcatacaagcaataggtgaccttacagcatttgaccatgggggtcaccaagccttttatctatgacccacatctccgtccggtggtccgcccctgccccgggttggtggctgctggggcccgctccccacccctttccagcggagccctctgccttctccctctgggctccagccccagcccctgatctggtccttttttttctctaaatcctaacaaagtgcaaagagagacttctctggagaggcaatttgagatccaatgacttggcgttttcagccttttttttctccagagccttctttaaaagccgccctccccccacttcactcccttccgctccctcctcccacgctgtgagagaccaaagggaaggctgtgagtgatgaaatgtccctgctccccaggccctgtgctgccagaggcctgaagctgccatggccaccctgcctggtgggcgcagcagccgctgagcctgccacagagaggccttcatttatgcctcttgtctctaatggtctaacaagcctttgaaagccaggagccactctccagagctcgcagcatgattttagcggctccaggggtctctcagctcccaccttctcgggcttttctggcatccgctctgcccttttgatgtgtgtcccatccccctctcattcctggcccttcactagcaagccttcttcccaccctgcctccaggctcggaaggtgggagcctccttcccaaggttaggctgggagactttctagaagagatgggtttcctagagctgctgtaatgataggagacccctgagaagagaggagagggacaagagttttggccgccgagctaggaagagcatcagagtgcacttgtcacctcgcccaacaccctcacaccaccactcacacctctcttgaggtgggtataattatccccagtttatagaaacagaaactgaggcttggagaggttaagtcattgcccagaatcagaaagcttttctttgacagagttgggcttcaaacccagaccagatataaagttcaaattggacttcaaacccagaccagttgggcttcaaacccagaccagatataaagttcaaatccaactttatatcaaggatgacaaacgcaagtacctgccagggccaaagggagtgaagcaggcatagtgataggcagcggagagttggtagggactaaggcaccccggagagctcacctggctgaagggggcagctgctgctcagctccaacaggttgtaccaggcagagatgccgggccagtgttgcagagctcatgatcctgagagagagatttggatttttatgtgacatctcacggtttttctgtgtggccactagtttaattttttttttttttttttttttttttttgagacggagtctcactctgtcacccagctggagtgcagtggcatgatctcagctcactgcaagctctgcctcccgggttcacgccattctcctgcctcagcctcccaagtagctgggactacaggtgcccaccaccacacccggctaatttttttgtatttttagtagagacggggtttcactgtgttagccaggatggtctcgatctcctgacctcatgatccacccgtctcggcctcccaaagtgctgggattacaggcgtgagccatcacgcctggccgtttaattttgtataacactggcagggtcaagcacaacatatctgtagggtgaatgcggccatctccccttcactcctggtgaccatgctggctgctggagatctggacacagctgcccacagttccaagaaatggggcctgggaagggaggacaggtccccaggtccactctggggcaactccaggttggcataggactgtccatcttgcacgctggcctggcctgacctgtttggcccacaccaggggaccaggcattgtgcaaggcctttcactgccaccaagatattctgcttcatgcctggtgaggtaggaggaaacaggaagggagcagggggtgctttctcaccacagagatcaggacagttggcactcgtgacaggggatgatcctaagtgcctgacccaggaggcagggctgagggtgagcagcccatctacttcctgggggccacattgcagccaaatctgggttgagtatcccaaggaagcaagagctttggccatagtggatgccctgtctcctcctccacactccagctggggatggagtgtagccttctctgtggagacagagtgtctccaggtcaacttctaactcctatttactctcaagactggagaagcccttgcaaccgcaagctacaaatccaagatctgccattaactccagatgacaccttccctcctcgtcctgcgaccatcccactcctcttctctcctgtggccgaggagggttagagcctggacgctctgtcccactgactgcaggatcctcgtggcctccacatctgtaaaatgggcaccgtgcatgctttcacctctcgggaggcgatgaggaccccaacctgtaacggcatttgatagccaagaagcccattctagaagcggttatttttatcatgataagcagttccacccctggaacttcatcctgttgaaacatcaccattgagccacactttagcattctcccaaatctagaaaggctttgcagccaagccccagaagacaaggccacccttgggcatcagggccgacagagttgtgtccaaggatgattttccagcagagtgcaccacagctggaaagagaggacagcttaagtgcccatcagtcaaggcatggttagaaacacctgcggagtggtcacagagcatgaggtagatccggaagaactgacctgaaaagaggttggtaacattaaatgaaaaaccaagttttcggacagtatagtggtatgataggggattttttggggttaaaaatatcatatatgttatatatttgtgtatgtgtgcctggtacatgtaaagagcaggactcgggagatctcaccagaaatcagctttatgttgtctccctcccaccttccaggttgttcagaggtgggtgctcttccagtggccccctctggcaaggcctctcttcatggcccactccccacacagcccctggtcctccagcagcctgtgccccatggcatctccctgttggaatcccattgccttctaggatgggagtcaaagtcggcctgggctggatctgtcttctgcatgggtccatctggtccaggggaagcactgtggacccagcatcctgggacccggtggtgtctgggcctgcaggccaatgttgtgcagcagggactctcctggttccaccgacagagcacccatcagcccgacccctgcccttcacacttcccaggtccatccgctcagttacagagccaggcactgagctgcctcgccccctgggaagcccctctccctagatgtggtagaggaagcgggggctctggacacccagctctccaaaggctctctccaaaaacccttctcacaatagcctctaatctctgctttctccattctagatctcttccctgtggattttagagcctctaaccagtttgtggtcatttcctttgaagatccctgtcttggtttgaaacctttctttagaatttcctatttgagggatcttcccgcttcatgaaaataaaattctttccacatgaccactggtaatcaatgtataatatattacagcttttagaagggagacagaaaagagaggtcacaacatcacacttaaagggcattgcactttaaaaaatgaaacaaaattccactagacttgtctctccttccagatgtgtcctctcagcatcctaaaacctcccccacaaatctagagaaaatgtccaccagcctgggactttttctagggtccccccaacctctcgagcttctttaaacatacatatcctcaactggaactcacgcagtgaacaaaaactcccttcaattcaataatcaggactcctcttccttagaaggcagtaggtggctttaagtaatcattttttccctgtcatatatatatttgtatattcaaagacaaaaatctaaaaaattatataacgcattgttctctccgggggataggatgctggagtacattcactttcagattgtattcatctatactgtctgaatattttataaaatgtgtcttctgctttttttccgttttaaggttttttattatacccaaaattcaaaagcatgttctcacttttaaaaatttatgtaatgcagatagagcaataggctcctgaaattccttctgctattttgatgcccctccccagaagtaaacactgatagtttttatctagagaccctttcagaccctttagtatgcatttgcatatgagtatacataaagcactgaatagttatgtctttaggagtctgtttatttaagtgtggtcatattgttcttattttctattgcttttaatacattgcttttaatatttttattgcttagatcttcaacaatatgtgttgaagatctttccccaccagcacatctcaagtatctcattctcttttaacagctgcataatatttcacagtatagttgtggcatcatttatttaatcattcctttattgaaggatattttggtggtttccaggttttttttgcaattgcaaacaatgctttgataaacacccttgtgtgcttctcttgatgctcccgtaagagtgctttttctgggatggataatgagttgcagaactgggagcctgaagggcatgtgcacttttaattttacgagatgctggtgaattacctttataaccagaaaagggcactaacaataaagaacaagaagaaattcccctgccctgcctcccagcagaaccatgaggatattgacgctgaggcggctggcacagctgtgtttgctaaaccactgcctgctggggcgtggatgccccttgcttcccaggctgactgtccctctcctcctgtggcaggttcagcccttatgagtggtacgatgctcacccctgcaaccctggctccgaggtggtggaaaataacttcactctgcttaacagcttctggtttggaatgggatccctgatgcagcaaggtatgcaccctctcccagggcctccccttccagggtctgctttccccaagcggtcttcagcctctttggcatcagcagagccagcccacacctctaggggtagcctcagaccctgatgagccggcagaagtttggagacatcgagatacccaggtgtgtgcccttgccccagacccctaacttccaccttcactctggctggagctggctcagggtctaaagctaagaaaaccacccagcccagggcatgcgggacgcatcccccacctcctgctccagctgaggtggacatagagcaccctgctggctgcggctgaccctgcccatggcctcatcaccacacaatccagctgagcaagttgggctgtggatggaaggagaccagaggcagggagtctgggtgggaggccactgcaggaatgaggtgatgagacctgaacctcgtggtggccctgggagtggaaggcagaaatggactaagagagcttcaggatacactgtggatgggactccgtggccgcttggctgtgaggtgcctgggagtaggaaggatcatggctgagttggggacttcagcccgagtgcttcaaagatgaggtacacaaaaagatgcaattctcttacatcctctggagggagggccaatgtgctttggaactatctgcagcagagcacctgctctaactgccaggagtcagatgcagagacagcagggagcaggagggcaggcacagggagaggggaccaccagccaggaaaggacaccgccccctggtcctgctggccaccagccatgtgctcactccctctgcaggtggagtcccatgtccagagtctcttatcttagggagtgcagacaagtttttgctgttagagtttcactgagggacctgcttagggggcaggcagggaaggggcttccagggacagagaaaatgtccttgtccctcagtcatctgtgtataaccttcacaaaccctggtcctcagtagatatccatcagtaaacaccaaatgaatgagcaaatggcattatcccaatgtgtcctgggcacccactacatgccaggctctgtgctgggcacttgaatgaaggaggagaggaaaaaagcaaatctgtcccacatgcgagaaacctcttggccatggcagaggccagggcagggacttgggcagaggtctggcaaggctggcagaactcagcaatcaagtgactcaaataagctgctctccctctaagagcagcccaaagcctggtttggagcaacctggggaggctgggagtggccagttggggaggggacacagagccccagtggtctctagcagctaggaagtgacaggcagctttcaagggaagtgcctcaatctgtccttgctattaatgagtgtcctggagcctcaccttgtttttttgtccatcgtctttgttcggtgacagttgggaaagacctggaagcccctcaatgcagtaatagcttctcctcttccacctcctgctgctattcaaagcactggcccttgatgtattctccatgtggttttgattaggagggagaaaaatagttatgtatttgaaaaactctcccttgagtgacttctttgagaaaaaaaaacatcatatcaaagcagacggttttcagattgcaggtccaaatattctggaaagttcaggagtcacttgcaatttaaatctcttgaaagccacctagttaattacttcagttagaaggtgtcatctctattgtgctccccacctaaggtcggggaagaaaagtcatatatttcggcaaagagcttcaaaaagtgttgatttttttttcccctcctgcaaagcactgcatagcaatcttgtatttgtataccatttgtatttccaatgcaatttcttctcaaattatatcgttgcagcaccacagtatttatgtgaggctgggacagaggaaggacaattcttcatgttttgcagaatcccagagaggggaagtatcaggcataagatcacactgagagttgggagcaggattcactcgagaacccaagggtcctgactcccaggtgttcttaagctgggaccacataagtggtccatggttaggcatctgaggttttgatgagcctgtgaaatgtgaatgtatatgttgttctagaagagcgattcttaaattttagcctgcgtcagaatcatctggagagcttactcaaaacatattgctggttcccaccctcagaaattactgattcagtgagtgctggggaagggcccaagaatgtgcatttctaacaagttccaggtgatgatgttgctgccagtccagggaccacacttttgagaaccactggtcttgggaaagggccttagctttcattagagtatcagaggaatccatgacccaggggacttgagcagcgctagtctggatgttgtaagggactgactatctcctctcttcgcccagggtctgagctgatgcccaaagccctgtccacacgcatcattggtggcatctggtggttcttcacgctcatcatcatctcttcctacacggccaacctggctgcctttctgaccgtggagcgcatggaatcacccattgactctgctgatgacctggccaagcaaaccaaaatcgagtatggggctgtcaaggatggggccaccatgaccttcttcaaggtgaggccctctccctcctattgcagcaccgtgagctgatcctctccggaccctttactgagcagaagaggaaagggggtctctgtccttccctaaccacgcatggccaatgggtcagaagccctctcagccccaccgtgtttggactagttgactttggggagctgtggtgatgtgggccaactgggttggcctcgacacaaatcctagaagtttctgtgcctgagatgagcaatgtgaatgtgttatgattccttaagtcatcagagggagacagatgaagagaggggcctggagaagtgggaaggaggggaagagccacccagacacacaggccctaggggcttcccgcccttggcttcagacctcaatgccgtccatctcaaagaagctaacctgaggttggggagacagcagcagggccaaatcttgagaggaagggaggaggcttagaacttgaacaagtgtttacagacattactgagcatgttacactctaggaatgctggtgtcagcagataaaatccctgtcacctgctcaagtgactgctctaatgggtatctggccatgatttcattgctcctcctgctctgtgaagtgttgctgagtgccctaatgttttccactttctactggagtagctgagggcttaggagactctggctggccctgagaaccagaagctgcaaaggttctcccagaaattaaagtagtaatagcagtagctactgccactgagatctcacagtaggccaagagctgcgctaaatgctgggcctcatttaatcttcatgacaaatcctgggaggctggtactcgaattatttctactttacacgtgtggaaactgagtcccagagcagctaagtggcttgtccagggatgcccagctggaggaaccaggtgcgacccaggcctaccttcctcgagggccctgttttaagccagtggttcttagatctgggtgtgcattcagatcatctggaggacttgttgaaacacagcttgcaggccaggcacggtggctcatgcctgtaatcccagcacttttggaggccgaggtgagctgatcacgaggtcaggagttcgagaccagcctggccaatatggtgacaccccatctctactaaaaatacaaattacaggtgacgtgcacctgtaatcccagctactggggaggctgaggcagaagaaaggcttgaacctgggaggcagaggttgcagtgagccaagatcgtgccactgaactccagcctgggtgacagagtgagactccatctcaaaaaataaaaaaaagaaagaaagaaacacagcttgcaggccccaccctcagagtttctgactcaggaggtctagatggggccgagaatgtgcatttctaaaaagttccaaagtgacgctgcagctgctggtccaggttctgtgcttggagaaccactgttccaaaggtttcccagaaatgattaggatttaggaactctgtggctgcaggcccacttatttatatgtttatctattaatcaactgctctcaatcaacctggaatggaagcctggggtattttcctttcctctgggctctaattccccatctcccagccgctgcctcctcctaggctaagcctccaaatgatagatggagcctccagtggggcctgagtgaagagagaaggaaggggttgggtgggaaagccttctacctcctgggcactgcagccccctggcactttctcccctccccgctgcccagcccccaccatgtccctccttgaggttggaaacagctttgtagtgaagagacagtgagtgaggaaaggagcttccctcttggatgttgccaagagggatgttggttgacttgcctaagaggtcactgctgtgtatttagagtgaggggaagacaacggcattatcaaaggcatgttgggaacactatgggactctgtatgtgttcctgcctatgagtgagtaggtgaggatgtgtatacatgcatggcttcacatgtgcatgtagcagcatataatatgtgggaatgtgcacgtgtgtgtatgtgcacacatgtgcctgtgcacaactctgcctgtgtggggacatgtgtgtatttgtgcttggacacgtgtctgcatctatgtgtatgtgtgctgaacatatgtgtgatgcatctctgtgatctgggcatgtggacatgtgcctgtgaatgtgtacaagtgtgtacccgagggtctacctgtatatgggtacagagaaaatacatttgtctgtctgcttggatatcctcatgggtatgtctagataagtggagggcagatggacctgtgtgtgtgtaatggcctgtgcaggcatgtgtgtgtatactcgcctttgtgtgtgtatgcctgtgtaatggcctatgcatgcatgaatctgagtgtgtgtgtgtataatggcctgtgcatacatatgtatctgtgtgtgcatgtataatgatccatgcatgtatatatgtctggatgtatgtgtgtataatggcccatgcatgcatatgtgtctctgtgtgtggggggggggggtctatgtatgtgtataatggtccatgcatgcatatgaatgtgtctctgggtgtgtgtgtgtataatgaactgtacatgcatatgtgtctgcatgtgtatgtgtgtgtatgtgcacacatgcctgcctgctcctgcctatccccaggctgtggcccagccctttgtgccagagcatctctcatgcataacgcatgaacccatctctaagcagggctcccgatcaaagtgaaacggcataaataagcctggtgcaggctcattgccgctgattggatgtccctgcctccctccatgctaagatgctcagattggcttccaagaagctagccccagctccccaccgagctgctgccctcaccatcaagcagcacctcccacagcctcctctgccctcacccaccttccgtgcaaatggcacagcgaggagggcagaagagacatacaaatgctgtcacctgtctgggatgctggggcttcatgggcccatgctcacaggagtctgtgggtcagaaacaacaactccacaccccctgcataactaactccactttcttcctgtccctatggtcaattaattcctctttatgcctggccacattgtctcctgccttaattcaagtgaagctctccttgcccagactccctgtcatcagcagcagcaatgggactgttacatattggagaagagcctgaatgtagatacattaactgcccccccacctcagatgatgagctagaagcaccaccccccgccccgcccccgctgaaggtccctggatgaaccaattccctgccttgtcacccctctgccctctgtagttggacttcctaagtagaccttccccccgggccaggtgatagccttctggttagcacagaatgtttgcaggttagagctggaaggagacctgagattaacccagagaaacaggcccagcccattatcacacagcagatcagtggtggagcggggtacaaggtcagacatgctgtcttcatgcacagtgccctctcccacatccactctagggtcttctcctagagaggtggtcttcccctgaccatgagagtatatggcaaggctgcactactgttgaacaggaggcagctccaggaggagccatcagatgtctaggagacattggcaaagtcaacaataacagtaacacttaatgaacacttactttgtgccaggcaccattccaagcattttacctgtatttgtttataacatcctcaataacagccctggaacgtagattgttattatcatctccatttgaaacatgacgaaaggaaggcccagagaggctaactgacttgcctaacatcccacagctagtgaaatgcagagctgggatttgaacccaagcaacctggctctagtgcctatgctcttggtcactgtgttcatatggcttctctaaggacccagccacagtcctcaggaggcagttggggaaaagtgaagccacagtcagttgaccacatacccagccctgcacagccctggcacgtcgtagttgctctaataatacgtgttgagtggatactgttattgagtgaaaggatgggatttaaagatggcggcagccaagtggcacaagtgcaggagataatatcgaggactaggaactgagtgggcagcctgtattgaaggtccagagtgcaggacagatgaacttgatttctgtggttagcatgttcctgattaggaagcacacagtcttaaaaaaacgccctgactgagagtagaactcacaagggagggaacctgtttctgtccaaagacgacaacagcaggaagcgggatgctgggctctcggggggctctcgatccctcgcccccaccctgcagacccatcattccagaggaatttcatttgaagagttgtcagggagcagcagacatcacaaacagcgtctcctgtgttgtcctccctccgtcttggaagataaaaattaattaggagatgaaaaaagaggcctttgaaagcactgtttggctataaaaatatgtaggcaaaatgtaaaggagaacgttgggaaagcgtgttctttgcagggagggctgcacagctttgaagagagaggacatcggaagacagcttctccaagcacttagacctttttcagtgctgggggtgggagagcacataacagatgagagggatagcggcttaggaaaggagtgggagctgggagcccgagaatgccaggttccctgggcccctggtcattgtcaggccatcccccttgcacagcctcggttcctagcatctgacctgggcatgctgtcagagaggtcacctggtccacaccctgcctcccagctgcatgacagacccttccttgagctggagggcctaggaagatgctccccaaactcagcttccagcttctcctgacccatctgctggcctctctcacatacagtcttagccctgccttcaagcagaagcaggtagggggaccaaaatgtaatgcccaggcagaattcagtgtgatgccgcctgtcgtcatcaagttacatcagttttaaagtcagacagaccaggatttgagtctgggatgatgtctctgctggtgaccttaggcaagtcacttcacttatccgggcttccatttgctcccctgtacaacacagatacttattttcaccatgcagcaattagcaagagggttcggtgagctcctgtatgtacagtggttagcccagagccaggcatacaggaggacttaggtcaaaggctttctcttccacacagccctccagttggctgaacagaaaccaaagaggcaggctggaccctttcctcttgccccgaaattccctcctggggcagattacttaactggagcacactggagatgaccagctaaagggcacccaccttatggagccattgagatgattaaatgtgataattcatgtattcacctcacagcattacctggcacaaagtaggcatgcagtgaatgctaactttttattgtttattgttgcaaactggtgatacacaggcctgtgcagcccatagacgtgatttggaggggccacacatcgcttatttatatatgtatattttttaaaacatcaattgcagcaattctcagcagctgagaggcaatgtttatctccagtttacagactccccccagccttctttagttacttcaataccctgcctggaccctgtcagcatttgagtttttacccctttaagtgccatagcaactcagcactatagagatttttctccccagtttctagatgagaaaactgggccttacagagaattaaggagccttaaagggaaagagtgactccggccacctatggagccttaggggcatgctctgtgttaaacgcttcacacaccttgtcttgttgaatgttcacgataaccctaagtagcacgtactcttacaacacccgttttacagatatggaaagtgaagctcagagaggtgatgtcacttgcttgtggtcacaaaaggagctggcatttgagtccaagctggtgtgacaccagagtgcagtggagctcacccctctcactacctccacccccagcctgtagccccccacaagcaagcctcaggcatgtgctgccgggatggggggaggtgaactaggagctagactgtccttaccagggagcctgtagcagtgggcagaggccatggactccaaagaggcctcctgtccccacagaaatgacccaagaaaaatgataaactgctcaaatccatggatccagtaaggccaaagattccacactcagagataagaaagccaattaatatggaaaaaggtcttctttccagtatggaaaacaaccaaggtcttgtatgcaatcccattgctactgcatctctgcacacattctctgaaattcagctccctttggaattgctatatatatatagacttacatacattctcttgtacagaaatgttaaattctcaagattaagtatcttcagtcagggaaaatcaatttgcttctttgaggaggctggaattgaaagtcgtgagcctgaaatttactttcttgccaattttgctgataaaaaaagcatctctgtcctggcacaccgccgtgtattggttgttccagatgattccattagttgatttgggtgactagccctgaaacaatctttattaaggttccaaccagggccgggacaggcaggatgacacaggagctgtaggtatgtgagacttcgttccctagggtggtgatgatagctctggccagtgatgggaactcaggcctgtgatgggaactctcccagagatgggagagagggacctgagagtccatgaagggctctggatttatctatccctgcttagacaagccacaaggaacctttacagggttgtgccccagaatcactcaactgctcaaggacagaaggacagcacttaaggggaagcagagaccatgaggagatggggttgagaaggggggccccaagacagaagacaaggacagtggggaccattctaggaaagcagatttcagacacatctacctgaaggtgatggaggtaataatttagttggtgctggagccaggaggctccagaaccaggaacctcttaaaattaacgtcacagccagcttcatgccttgttttcaccttgcatcttcactggcccaagctctctggtgtcctttcccatcttcctcattcagttcctttacccactggtgcctttcttgtgtctttcctcagagcccatctgcctcaacactcccttcagcccccaactgaaatttctgtctccatctatggtgttgtgttactggaaagagcatatggtttggtgtcaggcaggcctgtatataggaggaataaagtgttggggtgtggggaggatacaaggaggagtttagagaaagagaagaagtgcttatcccattctgagacagaaggagtaggtggggcttcctgagtgattcattgtcaagttacttttctcaggacttgagatttattggatggatgactgagagggtgggtgacataggagagtgggtgggtaagatgggtgagaaggagaaagggatggatgattgggggatggataggtgggtaagagaacagacggatggatggatggatagatagatggttggatagatggataaatggatggatagataagtaatagataggtggatagtcagattagttgaattaactagtatgtacatggtgtgtggatgatagcatgatcagatacaatagtggatgggtgggtgagtggttggatggatggatggatggatgatgggtggatggatgggtgggtggatggatggatggatggatggatgggttgatgggtaattggaaggatagattagatgggcagatgcattaggaggtctgattgcttcatctacctttggttctcacctctagtagtagagggagaactgggaaagcagaagagacaaggatggaaaggaactgaagagctgcaatcactggagggagaaaagtatttaggttccaataaccaggatggtagagtatcaggaacacgtgtatctggcaaagcagagatgactggactaggatactttgattagaagaatagttggaattgatgattatctgaaaaagcaaccatactgggagcagaagtcgcttatgtgactatgtggttgagagggtgtataagttatctattgctgcataccaaattacccgaaacttcatgttttaaaacaatatttgctatctcacagcttgtgggtcaggaatctaggcagtttcgctgagtcctctggctcagggtccctcatggggctgcagtcaaggtgttggctaatgctacagtcatttcaaggcatgttctccaaactcactgcatgcttgttggcaggactcagctccccccaggtgactgaactaagggcttcagtttttcactgatagctggccagaggctgccctctgtttcttgccctgggaacctctccatagggcaactcacaacatgacagccagcttccatcagagtgagacgagccagagagagtaccagtcacagtctcttgtaacctaattttggacatgacatcccatcacttttgtggagagttaaaagcaagtcactagtttcagctcacattcaagaagaggggattacacaaaggtgtgaataccagaaatggggatctgtaggagccatctagaagctttctacaacaggagaatctggggagacagcgtagcagagtaagaaaggaacagagggagtaaaagaggttggaggtgggagaatctgcttatcagaaattttctagaaaataagaaacattgggggaggcagaagagctgaacaccaggaagatttttaagggcaagaatattgcgtggggcacagcctgggccacaggaagcactgaggtggaagaatagctgaggaagtgggagagcggagagcacaaaaggtttggaggcagggattgcagaggtaagagagtcatgcagagctggagtagctggagagtagcaatggctgaaagaagggcaggctgaggactaggaggggctgggagaggccagtgagagctgcaggcatctgggcccttccatgcctttggctttggggcaggtaaatttgtaggttggggagtggctgcttatctgtgaaggtgcccccagccctgtgcccaaagaaggcatcactggcactcaactgatatggtgctcagatgtaattctaaggggtcctgcctgtggctttggggccccttcctgtccccattgctcttcctcaggacatgtttgggtctctagaagccagtttaggaggggacagcccttgccagatctaggaagcacctggagaatagaaagtacactttcctcccaggctccttagctccctcccagcaggcatggcttcttccccatccccctgcccatgccccagtcctgcgccagcctgttcaattgcacccatgacatcaggcatactggagctgggccgggtgccagtcaggcaggttgacatcacagacagacacagctagacttggaaccagccgggctcagtggggcctgcagaaccacctgttcccctgagatcagccaggacagggctgatccctgctgggagcaggcagttggcaaagcactaagttcccaagaaatctcatgaatgccgtgcaccctggtctgcacagtctccccaggcagcaagggacactcagcccttgccctcctctctcctggccccagtgacctctctgcgtctccccagcataggcattgcatcctaccaactggacctggtcttagggattctgattctgctcaagcaacagtgtccagcccaggaccctacagccctgggctctggtgtagctgaagggggtttgcagaccacctaccctgactgcccttacttttctccccctctgcaattcgcaccctgctccttcctcacagtaatgaagtagaacatgtctgaggcaaaatcttcccctgaaacaggacataaaagaggcctccattggttgaagtgaaaggggaggcccaggacccactcagctttgccccgatgagcagctgtctctccccctccaccctcacagtggtttctgtgaggcagggcagctgaggggttaggggtatggactctggagccagatggcctgggtttgaagcctggctttgctacttagtacctgggtaaacttaggcaagtgacttagctgtgcctcaatctttttatttgtaaaatggggcttgtgatggtgcctgcctcctgtgagcgctgtgaagaatcaacgagttaatgcaggtagagcacttagaacaaagcctgaacgtgctaacttttaataaattttagagaaagaaaatccatgtttaaaaagtcagcttgaagaccacttgtgccatggccagggtttccaggaagcaggcctgagtctacatttccgttttatcattggccagctgtgtgtttggggacctttgccccggggcctcaatttctatatctgagcaccgtgtagcacttcctttctctgaagattgtagaccgagttcaaggccccaacccacgttgtgcagggtatgcggtgcttggtccctggtgcgcctagtaacggtgtgtgcatcaccccttccctcacggcccagaaatccaagatctccaccttcgagaagatgtgggccttcatgagcagcaagccatcggcgctggtgaagaacaacgaggagggcatccagagggccctgacggccgactacgcgctgctcatggagtccaccaccatcgagtacgtcacgcagaggaactgcaacctcacccagatcgggggcctcattgactccaagggctacggcatcggcacgcccatgggtgagcgaggggctgcctgtgggaggggtgggtgtgtgggcagagggagggctccacccccgcgtcccctcacactccgtctcacagctcattccatggggctgataaaggtgacgttttctcttttttttctgttcttttctttttttttttttttttttttttttgaggtggagtttcgcttttgttgcccaggctggagtgcagtggcatgatctcggttcaccgcaacctccacctcccgggttcaagagattctcctgcctcagcctcccgagtagctgggattacaggcatgtgccaccatgcctggctagttttgtatttttagtagagacggggtttctccatgttggtcaggctggtctcgaactcccgacctcacgtgatctccccacctcagcctcccaaagtgctgggattacaggcatgagccaccgcacctggacaaaagtgacattttctcagcccagaagcagagggatggagctgcatgccttgtgagggtggccctggcctgagcaatgagagctgggacagacgcgaggtttggggacagttcccagaggccattcctgccttccctctcctgcccctgcccctgctgatgcagctcaggggcactgggacttcagggagcccacagggactgatacacaatgggcacaacctccctgctcaaacaggacatttccactcacccagataccatgcgtcgatttaaaggggactcacagggatagggaccccctttcatgagctgatccagagggctagtggtggtgacctgaccagggtgttggcagagccaaacacagaatgggccacacgccactgatggctaggggtcccttctccctgctcaggctccccataccgggacaagatcaccatcgccatcctgcagcttcaggaggaggacaagctgcatatcatgaaggagaagtggtggcggggcagcgggtgtcctgaggaggaaaacaaagaggccagtgccctggggatccagaagatcgggggcatcttcattgtcctggccgccgggctggtcctctctgtgctggtggccgtgggcgagtttgtgtacaagctccgcaaaacagcagagagagagcaggtaagccttagagcttggagcctgcacaggatgggaaatggagattcgcgctgatttcactcctgtatgtgccaggcacacagtggtgtctcatctcagcctcacaacagctcaccctgcatccagtcggccagcaagccctgccactctacctctgtcctgacctggcacttttttccatcgccgttgccccaccccaggccaagccccatcacctcctgcctggattatgccgcagccttcaaactggccctccagcctccatgcttccccaacaccatccacaattcacacagcaactggtaccttgtttaaaacttaattcaaaccatatcattttcctgcataaaaccctccagggtaattgttgaaggtgggtgatggttgcatagggtttcattatactgttctctctacctttgcatatatttggaaatttccataatcaaaagtttaaaaaggaaaagttaacagggttggcccaagcatatagacagtagaactaggctcaggccttctgattaattcaagcatggttgggcagtagttctgggtcccagtagcaaattagaatcacagggagaaagttttcaagtgctaatgccctggactcactcccagagactctctgttttaattggtctgtggtggagccagcattatgcttttacaaaaccctacagggtgatttaaatgtgtgcccgagatgagggccgctgggctgggggaagcacaactcacagagaagttcaaggatattgcagttaaattatatatagaagggcccattataaacaagcaacttacatatccgtaaaaaacgaaatggaatcctctataaccagcaagccttagtcaacaaagaggagggggaaagataatactcgatgttggaatttgcaagggtgtaaccgaagggacgctgtccagcattgctgagggaagtctatgcaggtacttttctggaaagcaacttcacggtatgttcagagtcttccacagcatccatacattttggcctgtcaatttccacttttagaaatgtacactgtgtaagtggtcaaagatagacatggttttatttacaaggaaatttgctgaagtgtaaattataacacgaagagatgggagggaggggtaaacacctaaatgtctaacaacagagaatggttctctgttgatacaaaattatgatacatcaaaaaagaacaacaatcaaattctctgagaattcccattacagttaaaaggagctcccagccaggtgcggtggctcacgcctgtaatcacagcactttgggaggccgagtcgggtggatcacgaagtcaagagattgagactaccctggccaacactgtaaaaccccgtctctactaaaaatacaaaaattagctgggcgtggtggcttgcacctgtagtcccagctactcaggaggctgaagcaggagaatcacttgaacccaggaggtggaggttgcagtgagccaaggtcacgccactgcactccagcatggagacagagacttcgtctcaaaaaataataataataaataataaaaaaatgaaaataaaaaagagctcctcattccaccaaaaagcctaaaggatctgtctactccacttctctgcccacttccttccctcactctcctcccctactctgctccactcctgttcagtcctgaacacaccaagcacatttctgccttaggccctttgcacatgctgctcctaaaatgctcctcccccagagggtgtgttcttgacatcttctggtcattcttgtttcagttccaatgttacctcctcaagtagccttcctcacctgcccccatttccagcccctctctatcccatttcactgcttgattctcttcctaatggctgtcactgtctgaaattatttatttgttcacgtgttcattatctattccatctcatcgttagaccgcaagctccctgagtgggctatggccttatccgtcttcttcactgctgcatgcctaacacctggaacagtgcctggcacatagtagggtcgcattaagtatttgtggaatgaagaaaaggaggcaaggagggatgacattctgcatgtagtaggtgaggaaagggaagcctggagggtcacagctggtaggaggcagagcaagaatacaaagcctagtccccagcccctgcacacaagtagtcctggtgctagtgccctggcctcactaggtaagttgagatatcagcatcccccactgccttccatgcaagctgcaggacaacctctggaagccaccatcatcagatacctgcgggaaacgctgcgctcttgatgttcctcttggctatgtgcagggacccaggccaaaagaaggtcactgccacccaacagccctagagggacctgcctcccagttttccaccttgagaaacatgtgctggacttccctgagtgggaagacactgattcttccccttagttggaagcccttccaggagaaagtttatccatacattcgtcaaatgtttcttcagtcctgaccctgggccaaagctagtgctttggtcagggctcgaaagttgggcccatggggatgaaactggctggttcctgccctccgagtctagtgaagaaaaatggcacaggtaaaccagagctcctcagacgttaatgtgcatgccattcagaacctcagtttgctcatgtataaatgaggttaagatgatgccccacctaccttagtctccaaacaagaatgtcaggttttgtagactgctgcacaaactaatcatcctgcaggtggcagagggatgggtggggtgaaggtgtgagaaagacgggtaaccttagcacagactctgggagaaaggggaggaactggctggagttgcaagaccgggcatcactctgtgccccttttccgacccctctcctccaccctcctgcagcgttccttctgcagcaccgtggccgatgagatccgtttctcccttacctgccagcgtcgagtcaagcacaagcctcagcctcccatgatggtcaagactgacgccgtcatcaacatgcacacattcaatgaccgccggcttcccggcaaggacagcatggcctgcagcacatccttagcccctgtgttcccctaggcacagctggggtggggacctcaggcctgggggctgggcagaggaaagcaaaggagattggaaggaacgtcccctgtccccgcactgggcttggggaccagagctgccacctgcctgttgggccaggagcctcctgcccttacctgccaggaagccagcaggctctcaggccagctgcttgggcttcatcctcctcagatcttctgtgggtttctaaagctgccagccgagatagccaaggccaaaggaagcacatgcctctctcaggccaaactcacctgcccctcaactctcctccagagtcagaagtttctgccgcagccctgcagagggcacagaaaatggaagacagctcttatattgccatttcttccacaagagcccaggcctcctacagcttgaccgtgaggccagagacacaagccttcggcgccttaaggatgttctagcatggctgccaatgggagctcatggtgagggatacccatcccatatgcctgggcagaaggaagacttcatccctctggggctgttcacgtggtcctaatcttctgaacttggcgctgcccctggcagcccctgttctggcagagttgaagacagagctacacaggggaaaagaggagtttggggtatgggagagaagagaatgcacaaacagaggccgccattttggattcttatggacaatgacccagtggttcctaatcctctaggaggtctctaagaatataagtgggggagtggccacagaaaattcttctccactttctagccagaggagagaggaccccctgaatttctcacaaaggatgcccaaagatgcagccggtatttgaagcccagcagaggaaaagcagattccatggaagtcccaccggctcttgtgccaatggatctcactttcctggttagcaagctgttgtctaaaccctgttcacatttggaaacctgggctctttgccatcttctcatcaacaactccccattcctggctggttgaccttggcctcactctgtctttttgaaagaagagttggttgaagtgaaagtcaagttgtccctcctcaaaaaaggagttagtgtcctactacacagactaactttgggctaggtgagggaaaccagaagagaccaaaagaacttctggtctcctggacttaccaaacctagagatgctccccaggaaaagaaagtttccagggacataatatcatagctggcagaggccccaagggtggggaggaagaagctgcctcctggagaattaaccaaagaccccacacagagacatgaggccatcctggccccttgtctgttgtccagagcagctatggcattgtggggcttggggaagacagcagagaagtagcagcaggttgggtaccagccagggggtggacctatgagttccagcttgctgtgatgaatgctctagaggtctgtgactttaagagtcttggaaaagaatgagacatgaaggattaggaacaaagtgtccttaaagagaacatgatgggccagcagggttaccatggccaaggatggaggggcaggttttgaacaggggagggaggttctggggattctggatgagaactggggcataccagccactcccctcccacctctgtcccatgctgcttgggaagcccggttagggaagagcttcatttggatctcaagggctttctcatctgggtgaagggcaatctctagcaaagcaggagaccacagtgggctcatgtgataaacactgtccctcctccagactgtgagctgcaggaccaaaccagcaggttcccagaatcctagcagctctgactggctatgtacattggacgagggagaggagggctagacatacaccaaagccccatgcatgtaatgttaggaaaagccatgctgtcataagcttcagggtacagagggcgtgtgcatgtgtgtctgtgtctttgtgtttgtatgtgtgagcttcgggggctggggcacaggacagatctggacatataacatagtccagggcatgcaataataggtgaatccttggggatctgatgtgtgcatatgcgtgcgtatgtgtatctgagtgaattggggacgagggagacaaatatgtgaagcagcaaggccccatatatgtaaaaacaggagaagccatgtcataatggggccctggtgggtatgcatatgtaagcatgcatgcatgcataggtgtgtgcatgctggtgtgtgtgtgtgcacatgtacactgaatggcataggatggagatcaggatcttacctgcagctagccaaatatgcgtaaaaggagaagccatgtcaccaaggggtccatgtctgagtgcatgtgaacacatgtgtacaggcatgtgtgcacagtggggagcggggggaaggccaggaccagagagtcgtgtgacatgggtcaatgcatgctgtagacaagaagccacgtggagttgaagtttccgagtgtgtgggacacacacatatgttccaggtcacagtggaagcaaagacagacaatcaggaaggccgggcaccagggtctgtttgcacttctgtcatgggagagatcatttgtcacagagaggttccaaggttgcatgggcacacttgccaggagacgggggcacaacccttcaggggctcatgctgctgatgcctttgctgtggacatcatgtcctgtttgaagggaaaactcttttttgtaattcccaggtaacaggattctaatgaaggtatttgccaatttgctgtcagcaaacacaatcattaagcgccgtcttactttgtccagtatagtttcagagcacgtgcctcattcttgctct

SEQ ID NO: 13636 - DNA, 14754 bp, Human
gcagtgagctgagatcacgccactgcactccagcctgggcaacagagtgagactctgtctcaaaaaaaaaaaaaaaaaaaaaaaaagtagagagctctgcttgagcccaggaggtagatgctgcagtgagtcacgatggcgccactgcgctccagccaacagagcaagaccgtgtctcttaaaagagcagagaactttctctggctaactgtagaagtgaaagagagactagaagtatgagaaggactcagtgtgtcattgctgctttgaaaatggaagggctctaggagaagagaatggtccctggctgacaccctgcaaggaaacagggacctcattcccacaacctcaaagaaatgaattctgccaacaacccaaatgtgcttcgaagtggattcttccccagagcctctgggtaagagcccagcccagccagcaccttaatgtcagtttcgtgagacccagggcagaggacccaactgagcccactcagacctctgacatatagaagctgttaaatgataaatgagtactgtttaagccgctaagtctatggtaatttgttggacagcaatagaaagctggcacagcgacctttctaaggcctcttcattggtattccagaaattctatggctggtgatcactgtgactctcattctcctccttgacacaaagccttgccttccctgattcattcttccccttcctgtcttccttcgttctttttgcaataagtgaacaaatgctagaaagctagctctctttcgggcatggtgttaggctttaagaataatcatgaagaggccaggactctgcctgtctgcctccctggtgctgtgatgatagagtcatgcatgtttctgagaaactggggcttgtgctcacccagatcatgaggtcggtattggagatgtgtaagggctgttaccctggtcttttagaagttccctgcatttgtttagagcagattctctttttgttattgatatttttcacacaaatatctaactttatgaccagtaccacttatataaaaaagaattcgttatccatatacttttcctataaaagacattcattttggaaaaatctcataaacctttgcccaagacattgcttacaagccagaactccataattaccatgaagcaaaaaccactgaaaatccggctggaaaaacatagaatacactctgctggtacacagcacagataaacctcatgttcatcgaacaacaaaggtggagtctgacttgaattctggcctaccagaatatgaaaggagttattaagagaaagttatttcataaaagacccctgtggtgattactattgtaaagttaaaaatccttggggaaagtgtaaaatgtttaattttgtaaattgccctcctacttgtgttatgtaaatgtgaatgtttatatgtgcctggtttctttgaaaaaggaatcacctgtagtggtgtagagatttcaaatgtgtaaaaggagactcaaaggaaggcagaaggttctagactcagtatttaagtggacatttactttcatgagcttcagcatcataccctgcagatcacaaggccgaacagctgggtggaaaaatcactgattgcgggaggaaaagaggcacaacctatgctcagtctcctttagggacagagatgtttctaggagtacataaacgatggactccacaggcagtaacagtgaatggtgtgagaactgagctgctgggggaggaggaacagcagggaatatgggaattgggagaacctttagcagttcacactgtgctatctgccttcctcatttgtgtgttttctgagtcagcattagctaaattttccagaaggccatccacaaagtacagcctgggcgttcaagggacgtcattcatttcccccagtgaccttgacaagtcagaagcttgaaagcagggaaatccggatgtctcggttatgaagtggagcagtgagtgtgagcctcaacatagttccagaactctccatccggactagttattgagcatctgcctctcatatcaccagtggccatctgaggtgtttccctggctctgaaggggtaggcacgatggccaggtgcttcagcctggtgttgcttctcacttccatctggaccacgaggctcctggtccaaggctctttgcgtgcagaaggtaggtttctcaccagatttccaaactgaagcaaggcttcagtcctaagcctcctaagctgttgactatggatttctgggaatgagggtgaccctcagtgtcaacagcaggtctaattggtggtactgctctgccaaaaatgtaccaccatattgtcaacttcaccaaaatgattgacatttacgtttgtatcatctggacttttacttttggttatggaatatttttaatgaggacattttgaaataaaacactgaagagaaaccatttgatttttactcttttttgtatgggtggtatttaaattttttgtagcaatgggatctcgctttgttgcccagcctggtcttgaactcctggcttcaagtgatcgtcctgcctcagcctaccaaagtactgggattgcaggcatgagccactgcatccagaagtaataatttttttttaagtatttcattgaagacgcaaaccatgattgtaaaaaatttaaagcaatcactaagcttgggaataatgggtaactttcactaaaattggcctgtttttatgttttttgggagtgttagcataattattttaattttgattttatcataccatgaatgaggtgcaatgttttaaaaaaatattcagtaaatagcaaattagctgaaaaaaatctgtaaaaatataagtttgaaaattaagccatcggctgtctactaaaggaatgacttaaagtgatcgctgggcttttgagatgcctaaatggaaacctcattttgcactgtaggcaaaaaaattgtaaccacaaatcactcattgcagctctgggcaaatgaaaatctgagcactttaataggaaaatgtgtgttcctatgctggaagatgacctgagatataaaatatgctagaaacagacattcagagttgatttatatgttgttgcattacattttataagaaaggtcagagttatatgattagttttttaaaatactgttactttcaaataagtttggtcctctttgaaatcctctggggagactatttttccccacaatgctgccattattcaaactattggacactgttttttgaaaatgactccatcacactctggactatcctcagcaagggaaaaagattttctagggaaattacatttttggaaacaaccaaaagtcagcataaccatgactgcagaataaagtagttgatgaaggtaagtgaataggggtgggaactatatttgagggccaagtatatagtgatccagagctaggtgtgtatatacaatttcatttaatcctctcaaaaagacagtttataggtgaagtgacttgcccaatgtcatgcaggcagtacataataaatattgggtttgaattcagccctatctgattcctaagcatatgctattatctgattccacatccttatatctaactcctaagcatacactatttctactatgtttgctgtttcctgagaaatcttaaggaaggagttactggagtactcccttaaattccagctccctcttttgatccctaaatgaaataggaaagcataaaatgactaatgttgttgacttcctactgggccccgcctctgctaggtacaagttatctaatttaattctgataaaaatcatgtgaagaagatatatccatccccattttcagatgagaatgctgacttgcctgatgtcgcaacagccagttaacaatagaaaaaatattcaaagctaagtctatccacctagaataagtctatcactcctctaaataatagtatttagagtacaaatgacatatgatgagagggtagtaagaccaattgataatgtgacaaataaacctctgcaatccattcccaaagaagtagctataagagacctgagcaatagcaagctcatgagctaaaagagccaaatttcagagcaaacggtgtgttcagggagttcagcctaggggtgtgtgtgtgtctgtgtgtgttcatttccttatagcactgtgaaaggtaaaacagtgtcattgttaagaactgggggccgggttgggcacggtggttcatgactgtaatctcagcactttaggaggccgaggtgggtggatcacctgaggtcaggagtttgagaccagcctggccaacatggtgaaaccccatctctacaaaaaatacaaaaattagctgggcatggtgtctcgcgtctgtagtcccagctagtcaggaggctgaagcacaagagttgcttggacccgggaggcagaggttgcagtgagcatggatcacgccactgcactgcagcctgggtgacagaacgagactctgtctcaaaaaagaaaaaaaaaagggccaggcacagtggctcacgcctgtaatcccagcactttgggaagccaaggtgggtggatcacctgaggtcggcagttcaagaccaacctgaccaacatggagaaaccctgtctctactaaaagtacaaaattagccaggtttggtggcacatgcctgtaatcccagctacttgggagaatgaggcaggagaatcgcttgaacccaggaggtggaggttacagtgagccgagatcacgctattgcactccagcctgggcaacaagagtgaaactccgtctcaaaaaaaaaaaaagaactggggttcttgcttggccatactggtgcacacctgtagttccagctactcagggaggctgaggtgggaggattgcttgagcccaggaatttacgaccagcctgggcaacatagcaagatccatctcttgggaaagaagaaggaaaaaagaggaactggggttttagaatcaggcataattgagtgtgtgctcctaatctgccaccacagcaaggttcatatggaggacttagaaatgctccttccatgttttcaaaaagaaacttccattagatatcaacctaggaagtggtcaaagcatttgactgagcatccaatacacagagctgcgtacaagcaattacttgagagatttaaatgcccttttatggatgtttgtggatgaagcccagtaggaataatgtatttgaatacaatacaacttggcaattttatacaggtctgtacatcccagaacccagagaaaagggttcaaaagaattcccaaatccattagattttgagtagaaatattattcatatcttacctattcaacagcctcagcttctgtggggtaatcaatcattagcagaccaaaaccaaaatgctttaacgataatgataatgttatgtggatttattaagcacctaccatgtggcaggcactatgctaaacatttgtattagaatttactcacttaactttcactaccctattcagtagacactgttactcccttgaatttataaacaaggaggctcaaagagctgaagattaaagagatgaagtatctaggctaaggtcacagagctagcaaatgacatatgctagatctaagcccaagtctgactctaaaattctgctttcttcatttagtttttctgccattcaaagtttactgccagctcctccaggaacttctgagtaagcctgtcccccagtggccaaaagacctggaactgagagcactcacattcttttataacaagtgtgacattttcagcccatctcacaaatagtagtgtccccaaaccacattggtttggggtattgctaactattctatgaactagagccctgaattctatctttctcaaagtctcagatgcttcattttacagactccagaaaggtttgcagtaactgcatcccttagactgcaccccaacaacaggtagccaaagcccctatatggtgagcaaggcatcttaatgcagtgggatgggatagattttgattgggcgacatttacagcttggacaagaacaagcatccatctagcccagcagatggtccttgtggaaaatgcctggtctgtgtcctgttattctaaaccccagtcccagccagatagacctccctgcgcatcaggacgatatactctgctgggaaggagagtctaagggctggaaacaaggacagcagcaaactgaggacctatgtgattcctttgcagagctttccatccaggtgtcatgcagaattatggggatcacccttgtgagcaaaaaggcgaaccagcagctgaatttcacagaagctaaggaggcctgtaggctgctgggactaagtttggccggcaaggaccaagttgaaacagccttgaaagctagctttgaaacttgcaggtgagaaaaagctggtttcactgtcactgctggagttcttttttagctctgtgttcttgttcagcaatagagatgaagccttctaatcatttttctgttcaactagtgtgtattcttttacagctatggctgggttggagatggattcgtggtcatctctaggattagcccaaaccccaagtgtgggaaaaatggggtgggtgtcctgatttggaaggttccagtgagccgacagtttgcagcctattgttacaactcatctggtgagtctgatctgcaacctttccacgtggcattctctgggtatctctcactctgagacctgtctgggaagagtaaccctgagcagcagcagaagcaatcacagccacggccatctaattctcccgacactgtctctctggccaggctaggggtggcaatatgcccctcaaaggaaaaagttaggagagatataactgaatggcaacacacgagaagacattcaggaggctcaattaccactgccaccatccctgcatcctataagataagcaggcagaagggaaggaacaaaggtacagatgtatgtaatgcatccattatggacaaagtgatgcacagtcgtccctcagtgtcagtgggagattggttccggcaccccatcatatacaaaaatctacagatgcccaagtccctgatataaaatggggtcatatttgcatataacctacacacatcctcctgtacactttaaatcatctctaaactacttataatacctaatacaatgtagatgctatgtaaacagtcattgtactgtattatttgcttttttattgttgtattgttatttttctttttttcccaaatattttcaatccaaggttggttgcttccacctatatggaatctacagatccctatgagatatgctttatcatccccactttgcaaataaagaaaccgagttcaggccgggcacagtggctcatgcctgtaatcccagcactttgggaggccgaggcgggcagatcacaaggtcaggagattgagaccatcctaacacggtgaaaccccgtctctactaaaaatacaaaaaattagccaggcgtggtggcaggcacctgtagtcccagctactcgggaggctgaggcaggagaatggcatgaacccaggaggcggagcttgcagtgagccaagatcatgccattgcactccagcctgggcgacagagtgagactccgtctcaaaaaaaaaaaaaaaaaaaaaaaaagaaaccgagttcaaaggatgtaaacacatttgtctaacgtctcattactgtaaaggttcagactcaggtctaactctgaaaccgcactctttccactgttccacattcctttataattttaagaaccagacccagtctccactttatgaaggaaaagattgacacctggagggcagcactgatttgttcgtggtcatgaagtcacccactaaccttgcttgaagaccttggctgccttagcccaagtgcttcacctaagtacttctcctaaagtttttcttttactaaatactcacttgctctcagtttgtcataaggacccctgtctgattattacttttcacacatactcatctatctgaccttctgaaggttaggtggctgagaggtcatacacaggatagatttcaagatcattctcgaagatccgagagataaatgtgcaccagccaatattagcaaaaactgtcccagaaaggcaatataggatccaagtagttccctgatccagagggctttggcacagaaaaggcccatggagaaactttgaccagttccctcacttcatggatgaaacaactacagttcagaacacgggcttagcttgttcaaggtcctacggtcagttagtggcagaatcaagactgaaacatagggcttctcctaacagtgtatttcccatcttccttcccttctctgcctctttggtctatcatcactggctggggaattggtgagctacatatgcctgcatacctcatagccagcccatgcctgtcaaatggctttgctttttaactgccttcctgccagctggcaatgtgatgatacccagccctctgactaaacagagaagagccagaggaagaggacttggatttgtctatttcctcatggtttcatttaacttgtactcccatcccatgtatttcttttctttttttccagagataattttattttattattttatttttattatactttaagttctgggatacacgtgcaaaatgtgcaggtttgttacataggtatacatgtgccatggtggtttgctgcacccatcaacccgtcacctacgttaggtatttcttctaatgctatccctctgctagcccaccccccaaccccagctgatgctacccactgccacaaataattagggacttaaaatagatgcaaatttatattataatatattgcatggctctgccatttactagctctgtgactttgggcgagttattcaatttctctaaacttcagtttcctcctgtgtaaacaagggtttagtaatattgttcaatgagatacctatttaaacacttactgccatggtcaactcagattaagatgctttaacaagtgtttcctctctagcacatgcaacagattggaaagcaaacccttatccctctcctggtccctttttgttcacttctttttttaatgagcccagaaatatcaggtcttagcatatctttgtcctgaagtgacaccacatgtgtatatttggtcttccaatctatactttccttcctttcccttttccttccttccctattcatcaaatagttattgagcatgtgctatgtaccacacacagtgctcataccatgctgaccaagacagacggggtttctgctgccagagagcttgcagtccagtggggaacagtgtaatgagaactgtgacaaggaagtacaagaacatatgccaatcaagtcaacaagtctgcctgagaaagacagggtcaatctgagacctgagggatgagtcagagtaagctaaataaagagaggcaaagagtcataaaggtgaataaagcatcgtggtgcaaggcttggatgtaagataaagtgtatcaaggaatttcaagtaatttcagtatggcaggggcaatgagagaaaaagagcagatgaggctggcatgttagcaggggccaaatcacagaaggccttgtaggccatacaacaaagatagccactgaaggcttctaaggaagaaagtgatatggttagatttgctttttaaagaccattccagctgcggtataaggggtttggaggtagtaagactagaggcaagaagaacagttaggaggctgttgcaatacttttattccatgtttccctatcccaacagatacttggactaactcgtgcattccagaaattatcaccaccaaagatcccatattcaacactcaaactgcaacacaaacaacagaatttattgtcagtgacagtacctactcggtggcatccccttactctacaatacctgcccctactactactcctcctgctccagcttccacttctattccacggagaaaaaaattgatttgtgtcacagaagtttttatggaaactagcaccatgtctacagaaactgaaccatttgttgaaaataaagcagcattcaagaatgaagctgctgggtttggaggtaaatggtttctgtgtctatgttacgtgtgtatgtatgttcatgtataacagataattcatagaatcctgcctgtctttagatgaggcgctcaggacctgtcaaatactaataaaagcttaacacaaactcaactttcatgaagtcatagaatctgagagctgtaaagaaccttagtgattaagctaaaaagtgtaagtataaaagaatttcactgttgaaaactcaagacttttaaaaataaatcactatctgttcctatgcataagttctttttaaaatatataccctaaaggcctatgactttattctagtcatctctttctcaggcaggcttgttgactagagtaggtctcaaggccatggaggagaaatgaactctgtcatattgcaactgatagaattgagagtgtgagaagcaaggccaatgattctacaagcatgaagcaaagaagctggtgtgggcccaatatcataaagggctacagagaaggtttttctcctgtactgtctactgtctcaatcacctggatcatgcaatgagcattacacacaatgtttaagtgaaggaccaacaggccttgtctctgttccttgcaggtgtccccacggctctgctagtgcttgctctcctcttctttggtgctgcagctggtcttggattttgctatgtcaaaaggtagggttgttggtgcactgctagtcttgtaatctttgtcatgtttctatcctgtgctttttcagggtcactgttggcattttgctgatcaaaatggagatagcagtcctctgatataaatttctccctcatctcatctctttcccttcagcccaatcttttctatttcaggacatgcatgtcgtccagccatcagtcaatgactgtcctttgaaaatcaagaaattaaaaaaaattgacatctggggaaaatttatatgctttatttgatttttggttctttgtttttgttggaagagttatgtggtcagcctaaagtctggcctgcaaacatattgtccaatttaaatgaatccattaaggtggtgatgtcttaatgtattagagcatgcatgtgctggcatcactctgaaataaaggtatccagtgtactgtgccaatatgtaccatggccaaaaagtgttatctatcgttatgtgtgagagtctctcactttaatttcatgtttctgcctaaaggtatgtgaaggccttcccttttacaaacaagaatcagcagaaggaaatgatcgaaaccaaagtagtaaaggaggagaaggccaatgatagcaaccctaatgaggaatcaaagaaaactgataaaaacccagaagagtccaagagtccaagcaaaactaccgtgcgatgcctggaagctgaagtttagatgagacagaaatgaggagacacacctgaggctggtttctttcatgctccttaccctgccccagctggggaaatcaaaagggccaaagaaccaaagaagaaagtccacccttggttcctaactggaatcagctcaggactgccattggactatggagtgcaccaaagagaatgcccttctccttattgtaaccctgtctggatcctatcctcctacctccaaagcttcccacggcctttctagcctggctatgtcctaataatatcccactgggagaaaggagttttgcaaagtgcaaggacctaaaacatctcatcagtatccagtggtaaaaaggcctcctggctgtctgaggctaggtgggttgaaagccaaggagtcactgagaccaaggctttctctactgattccgcagctcagaccctttcttcagctctgaaagagaaacacgtatcccacctgacatgtccttctgagcccggtaagagcaaaagaatggcagaaaagtttagcccctgaaagccatggagattctcataacttgagacctaatctctgtaaagctaaaataaagaaatagaacaaggctgaggatacgacagtacactgtcagcagggactgtaaacacagacagggtcaaagtgttttctctgaacacattgagttggaatcactgtttagaacacacacacttactttttctggtctctaccactgctgatattttctctaggaaatatacttttacaagtaacaaaaataaaaactcttataaatttctatttttatctgagttacagaaatgattactaaggaagattactcagtaatttgtttaaaaagtaataaaattcaacaaacatttgctgaatagctactatatgtcaagtgctgtgcaaggtattacactctgtaattgaatattattcctcaaaaaattgcacatagtagaacgctatctgggaagctatttttttcagttttgatatttctagcttatctacttccaaactaatttttgtttttgctgagactaatcttattcattttctctaatatggcaaccattataaccttaatttattattaacatacctaagaagtacattgttacctctatataccaaagcacattttaaaagtgccattaacaaatgtatcactagccctcctttttccaacaagaagggactgagagatgcagaaatatttgtgacaaaaaattaaagcatttagaaaacttctttgctttcttatttacgtagatgcattatacctttcatgtaaaattaaagtgaggaccagatcatatcatattgtttgcaaaaataaaagggacaatgttggttgttaaaatacaagcatatgtcaaccaaacagcatatatcatatggggctattcatgctccaaacattttattttgagttggccaagtacatacacattaaacagtcctttactagagatgctggccctccatttccatccatttcagaattcaccagggagccggagatccaggatggctcattcgtctcacttttgaccgccctgcttctctagttttctctttccctcccgcttagactgctaattgtcttcttcccctcaccagtgaccccacagctccgtggttccttcggcccagatgccacaacctgctggcataatcttttccggttggcccacggagtataatcttaaaatttgatttcatttccaggcattaaaaatcaagagatttcacatggttacatttctgggttccctctaaaaatggaaagatctggaagtaaagaacccatgttccctcatagcaatcattatctgatactgagtagcagctgtcccctttcaatggggtctgctctttttgtttcaccacagtcctcatgactctctgttgcacactcatgccaaagtaaaggtgccctttcctatgaactttgtaacactgtggccttttcttcacacccagcccacgtccctcatatatatcacctgcctgccccagtaggtctatgagtttgaaactggtttgtcagtccttaagctttatcagcttcatccatttctcagggagtaaagaagaaaagagggaaagcgcctaagtagtgatcttccctctgtgtgttagctgaaaaaaaaaaacagatctcccacaccacatctcccatcttgtgggcatctactacatattagaatgctaccaccttctcctgttaaacaggtttgtgccgtatccaggaggaggaagtggggaggagaaaaccctgcccagccacataaaatcactcaatagcccaaatatcatgtgcaaacatactgataagaatgtaacttccatgattatggaaggaaggaggaaggaaggaaggaaggaaggaaggaaggaaggaaggaaggaaggaaggaagggtgggctggctgatttatggagcatctactaagtgacagtcattttacatgttgcctcatttaatctctacactttccctgagaggtgaggataattactgccatttttattaattagaaaactggatgtttagagaagttaaatcactttctgaggtcacaggtctagttaaatggtaaaggtcagagtgactgcaaagcccatgctcctttccctactccacagtgcttctcttgcaaatgacaatatagaaatgtaaactattccaatatgcaagcttgagattggacacttaacacaaacaacaggggtgaagtaaggaaaacaacttaggactcctgtgtcaacttcacagaatctatcttaaatccgttggcaatgacaaggagaaaaagagaaccactaaagaactttgagaactgcctcctcattgatgtagacaccagcctcaacaaagacctacctgagccagttcatagggtcagaaaatataaggctcagaaggatccagaataatttcctctaaacccttcattcacagagtaaataaaatgaagctaccaatgtcacaggtagctaaagttagggcttggtctagaaatctcctccttatttaaattttctttattctccactgaacaaagagaaattggaagaatgcaagagatctccccacttcagacctacagtccacctcgccacagccagtcttcaaaagaggcaggtggagagccacgtgatggcattttcagctggtgcaaaggatcttccctgccctttcagaatgccccttcttcatgcctgcctccctggctcacac

SEQ ID NO: 13637 - DNA, 79787 bp, Human
  misc_feature (1)...(79787): n = A,T,C or G
gctaaaagtccctagttctttaaacataaatcaacaatcattctttgctgaatcttttgggtacctaggatgaatctgacaccttgcctagctcaaggagctcagtccaggagtctagaggtatgtgtgttggctgggggggtctgtcagagctgggctgatggcagctcaggccttttctccagcgccctgactctaggggctttccgagccctttctgaaggacaggaagaacaccaagtattatgggaggtggcagggctttccggttcttcctcctacagcctccagcagtcagcagtaccttccagaggacctggaacacagttggtgctcagtaaatgacagtgtccttcatctccacccccacccaccatgtcccatcagccaaaggtcacctcactatgttatctgcatggtggtcttaatctactgtgcagtggagcagctccttcagggaatctctaaaagttgcagaaccaggccagttgttagttctatagattcctgaaggtattgcccaccccactaataaaagaaggagggagtttaaggatggggagaggccaggcagagcccttggagcttcggccaagcttcctgggctgcagacccccgtgcaggtggcctctgtgggaactactgtgaactgagtgtgtttcatccttggagcatcctgcttgggaggcattcttatctgttttgacaagaaaactgggactcagagatgaagcctactttccaaggccacatagccagtgagtggcaaagtgaggactcacaccgagatatctggttccaaagcctgtgttctttctacattgctatcctgcctttccctatggaaacctggcattgctagtctcctcttctaagaggaagcagaggagctagacccattggctcaggtctgttggcaggatcatactcctaggcatcttgacagacaagaagcacgaaagagtagtggagcatgttttcagttacaaggaacaaaaacccaacacaaagtgatttcaacaccaagaggcttaattgttcatgtaaccagctagtccagaaagtgttcaggcttcaggcacactttaatcagggctccagttctgtttctctgcaggtcccttcgctctgccctcctctgtgtgtatcatttagattctgtctggctttcctcatggaagcaaaatagtgtccgtagcaccaggtctcatatcttcacactccaccactcagagcaggagaaagcatctggtcctagaacaccactttaagctcatcgatgtaggctgggtccattgtctatccctgagccagtcactgtgggagatggatgagattatgctgattgcagtcccaatcagcactgggaccccagtgcccccaggctgctgcaccatggggaagggatagcctggcttctgggagtcaatctaaggttgccaggggtgggcacagggcacatggaattcaccctgcctgagcccccaggttttagtagggctggtgtagtccccataagggctgaactcaaatgagagagcctgtgctgagggtcagaagagcatgaggggaggtgtcagggaggaagtcaggaaacagcacctcttactccccatccacatggctgaggaacactgtgtagtatagcagaaaaagccccagcctcaaaatcaggaagatctgggttcaaattattggttctctgtatgatttggggcaagtgactttcactctctggggcggttctctcatctgtaaaatgggaatattaatgcctacatcagaggtcatcttgaggattcaatcagatgatggtgatgctcctaggacagggcctggcacccagtaggtgctcagtaagtggtaaacaactgccaatctgatctcaatggagtatcttccattagctacagctttgaggagttcgaagcacatttctcccttctgggatagctgtgtttactgtaaagaccaaattagatgcaaaatctctaaggtcacctctgactttgtaaacaaagccagagagccggaggaaatgaaattccaaatgccctctcctagcctggtttgacctccggtgttgatgcaaactcaagccggctctcactgtggcttgtggctccgggaaatggaacccagcttgggacagggatgggaatggatttgacttgtccttttggcgtctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaagtaagtgccccctccctgccctcagctagcctggctgggggccaagccaagcaccctgggctgaggccacagcttttaggctggccagagggtttgctgacagctcatgtaggttgcagtgggtacctggagaaggtgtgtggcttccatactgaggaatcaattactctgagttggtttgaattgaccgaggccccaaatattctgggtatagaaccaaccatctaggctgtgtctgactgaggcctcagaagtcaaaccacaaaccatgcaggctccctctgaaaccggagaaggacttatatgagaaccattagcactgagaacctcttatgtcaggtgagtgggcacgagaaaaggccacttaaagtgaatccacttaaaatggagatcaaaattgtatagtaaatagcaaaaaaggttttcagtgaaattttattatagaaaggaaatgatgaaagcagattaatttaaagagacatcaagatttttattgtacaaatgaggcattcaaaacaagctatttttagctatacagattacaaaatataggttatgtgctaattttcagattgaagaaagaataaaatgttgattttggtgtgggtatatttatttattataccagcaaagtgatctgttcacatagtaactcgctcttcacattttactttacagcacctaattaagagtctacgtctgtttaatacttaagggcttcatccatttccccaaggatctctttcagtccctcgatattcaaattattcccttttgaagaacctatttgagcatcatcctcgtcgtattttcttcacttaattgataagctctatctgatctccttggtcaaagaccttgcatgtaaaattctccatcactgttttctttgacttcatgaactttgcagttgatttgcattgaaatggtattgtcctgttatatcggacagtcatccaaactgacctgagccaggtgggatagacgctttttaagtgagggaagaatctataagtggagcattatttttacaaaagggcagattcttagtgagtattttcatgttatgatggcatttgttttctgacacattacgactctgggaacttagatagtaaacacttagaaaagaatggccctttgtatctgcatatcccaagctcatcggattaagatgttgcagaacttggcagccttaggggtgagggggttgtccttcccttgaatgtctaagtgacagtgggccaaccccctagcccttcagcctcaggcagcccagcccagggttttatcaagtccaggcccccattctgggaaatagtgggtcctgctgctgagggtgccaagttccaaaagcttggggattaaggaaaggagagacaaaacactcacaactgcattcaaatgcgactgcttccagaccctcaggccatgactttcttggcctctgtctccttagcatccctatttcctcgccctggactcctctgaaaatggccatccctggccccttctactttactaacaatggtagtacccttgaatcagattctcaggcaaaatgtagctcttaaatcctgggcaactcccccaaacagctgccccaagactaaaagcattcctaaaatataagataataaaagatcagcaaagatgcacccctgctgtcagtgaagacaggcttttatattaaattcttcctgcttacaatgctttataattaaaagttctttcagagtatatcctcaggaaacataaaacaagacaacatagacacctgtcacttagacattcaagggaagggcatctccccacccacaagactgccaagttctacaacatcttgatcccatgggtttgggatatggagatccaaagggccattctttttaaagtgtttgttacttaagttcccagagttgtaatgtgtaagaaaacaaatgtaatcataacatgagaatattcactaagaatctacccatttgtaaaaataatgttcactcatgcattcttccctcatgggtccttctgctgggccccaataatgcagaagctatcagtacctgcaaacattctctctatagtcttgatttcccatgggcacagagagaatcatggcacttgaagggccttcagagaccatccgttatttaataagagtctggttctggctcagggtcacagggagactgaacttgtggggaactggaatttggagctcccactagccaatcagggatcgcttactctcaactttgtggcaggcaagctcatggaaccctccccccattgtggcaacctctagaaattcatcatgccaacctaatggcactgtacctatatgcattttgaagctgtgatggttaggaaggccagcaggaattcaggggagccgggagccgagaagcccaggtcctatcagggaggatacctagcacaggatttaagaatgtaaactgtgcagtcataccaagctgggcttcaatcccagctcctctacattctggtcaagagaccttgtcttggccaagaaactttgagaccaagtctgttaactttgctgtgctgctggtttcttatgtgttacccagtacaagggttagttgctgcctcctagactctgcctgttcagcccagccctcaagtgccttctatagcctgagggaccatgaagctggggcagttcagacccccccaaccaaaggccacatcaaactcaactttcttttaccctcttcccttactgccacgccctggacatttcaaagcttttcagaaggcaaccaggcatggtgagtaaagtgcttctcccactattgcacccaccagaccacccacattgggtttctcaggtagtcacggcctcgggagggtcaggcctcaggagctggcctggagccttcagggggctggaacctgagtccctgggagcatccgaggccaggcagccaaggaagcggggttggccaggatgactcggctggaagtcccaatcctgcctgaattcccagtctgtgaagcaggcaaagaacagagcatccttctaagtttacagctccccggggtccagccctagttgtgattcctcaggtcccagcccctatttcccatcactggcatgagcactagccgaggccttctcacacacaaacacaaaatctgtaggactagatcctgtttctctttctgcacgtacacacgcatacacacacacagacacacacgcagatacacaggcatgcacagacagacgtactcttcaggtccttaatcagaagctgcaatcaaataccacaaaaagccccccaacaatgcactttgtaaggctatgtcctgagtggggttttctgcattggcccttgaacagggagagactcaaagggaagagtttgtagccaaggggttctagcaggaatagaagctgtcagaacacaagcctgggacctgaggggaccacagaatgacagactgccagtgctagaagaatcccaggtcacatctaagctccgcccaggcaggcaaagctctctataacgtgagccccactcagtcaccctgggaattttttgaacaccagattcctcagccatccaagacctactgaattggaatctcttgaggtaggtcttaggaatctgtaggaatatatctttgtatttttgagacagagtcttgctttgtcacccaggctggagtgcattggtgtgatctcagctcactgcaacctctgtctcccaggttcaaatgattcttgtgcctcagcctcccgaatagccgggactacaggcctgcaccaccacgcctggctaatttttgtatttttagtagatatggggtttcgccgtgttggccaggctggtctcaaactcctggcctcaagtgatctgcccacctcggcctcccaaagtgctgggattacaggcgtgagccaccgggcccagggtaggaatctgtaggaatatttctataatgaaaagctcaccgcctcccaaggaagcctgtgcactggttggccagctctgtcctggtcaggctggaatctgcctcccccaagactctccctcggttctgccctccatacaacctatagtggggtgaaatcctacagatgcagaaaggcagttctgagtcttctcagagtctctttttctctagtttcttcagtctttgctcccatgacagtgttcagagccttcctaacctccgctcaggacacataccagcccatctccgccttactgtagggccccagacctggccccaggctccagatgcaatcttacctaggcctagatgagttcctggactgtgaccagcagccacagtaggaagctgactcacccggacagtgcagcatcctctgaagtgccttgtaaacctgagggtacaaagaggctcacgttagctgtaagagcccaattttcaccggctctagcttccacctgaacaactcccatcctcctccaaagggttttagaagcccccaggggcaggtcagtgtgaactcataagcagacttcacctcttcatatcacccattccagcacccagctaccacctcccctgttcccctacctccgctgcacacaaagccacttaataataatagctaaccctgtgccagatactcgtctaccatattaactcatttaacatataattagccttacggtaggtattatcattcccatttcatagctgaggaaactgaggcacaaagaaattaactaccttcctccaaggtcatacagctcataagtggcaggcccaggatctgggcccaggcagcctgaccccaaagcccatgcttagtccatacccgcactgagcactgttactgcccctgggtcctcagtgagagctctgggacctgggccaacagtacgttgtcctgtgttcccaaagccactcacctcagaagggccaacttcagagctcgctgtcaggggaatgccaaagcaccaccaaaccccttctgcctgccagcccctcaggagcacaagctcgtggggccagcaaccaaagctgcatgtcacatgcctgtctatgccccttcctcattctccttcagtcaggtaatcaaacagcccaactttaacttgagtgggctgtctgattgcttagctgaaggagaatgaggaagggacatggacacattgaggaaggggaagggcacattaactcctagaaacacaggccaccatgctattgcctggtttaggccacatgcatgaggcactctgggtctctccgagcatccactttgtgtttcattcgttgatgctctaggcagacatggatgctcagccctgttacgcagtagctcttgtgacttaaggtcactgcagcactccactgatgagtggcatctgcacccctcccctcccgtaacttttaagtaactgagatgtggttggagtgtgctctggagaagcagtcttgtttgtgtggcccttataggaagggatctgcttgtggagcacctagaacctctggctatggaggtgctggccttcctcctgttttggctcagaaatagggactgatgtaagtgccaccataacaaatctggggttgggtagataattggctggctagatgattaaatgactgcactaaagggcagaagaaatggagggagggctaatgttaggaagggaggaaggaagggaggatagtagatatgatggatgaatgactagctgagttactctccttggaataaagctaacacatactgtgtttttccacactcccaaagtctgttggcatgagagtaaaaacagtggacaagggttgtaggaggcctatcctggcttacaccctcagtcagtgggctgggctcagagccaacctgtctgtcctttaagaagaggaggatgaccaagcagccagggagttccagaaggtacaggaaaggctcatagaaacgtaaggtataagcagcatggcagagcaggaagaacttgggcttcacatccttgactgctaccttggataagtgattcctcattattccttgccccagtttcctcatctagaaactaagagttataggaatagccactaacaacagctaacctttatggagaacttactatgtgccaggtaccatattaggcttgttttatatgttacattatctcatttaattcttgcaatactcctgggaaaactattagtatttccagtaacagataaagaatttaagcacagaaaagtaatgtgcagtgggtgacatagctaaggaagtggttgaggctaaattcaaacccaggcagcttgactttaattaccggaataatatatataaagtgatgagcaaagtacttagctcacaataggcgctcagtccctatagcacaaaacggtttgcaaaaagtttccacatgtgtcactgcaagtgcaatgacattgcaagtgcaaaaccactgtgaggtagacagagcagagagagtcacccccatgaaagtgcgaatttagagcagttaggtatcttatccagatgaagggaaagaaactaacacacaggttcctagtgttttctagcatttaaccttcagaacgcagtcgtacatggtagtgatgactatgcacatttcacagatcaggatactgaggcttggaaaggttaagccagttgctgaaaatcacataatagggaaatagcaaggcccggattccactgtctcatggttgtaagctgaggaaatgggctataattaattgttttcctatttctattccaaaaataccccattatatgcaatagagtttgagcacagaggcaagggatgattattcacatacacatggtaggcactcaataaatatggaatcgaggaattgaagtacatttactcagtcaatgtttattgaatttgctcaataaatgtttattgagcattaactaactaaggtcctgctctcaggaagctcacttcctggtagatttactaccaaatgccagttctgtcagatccaatttgctcttgtgttctcccacggccttctcccatcaggacctggaggagacttgttctgcgctgtctatgggaatatctcgagtttagccatatactttactgctgaaggcagattgccagcttctctatccatttgactccttttggctgttcaagccctgtcctcactggccaacagaggggttctgcctgtacctccctggaaactccttgggaaccgtgtgctgcccgactagagaaaaggtgtatgacccaaaggatcaattatctgtcaggaatgagatgaagaggaaccagataaagcatgtaaaacacttggaacctggtaaggactgtgtagagtagggatccccctgccccccagcttccccagtgagaaccctcatacggtacctcccatgtgccaggcactgctctaggcactttacacatagcaacctcacgacaactccaagacacaggcatgatggctatcccactttatagatgagaaaacaggcaggtaagggcactatactcaccagaaaccaggaagtacttggatgctcccatcgaggattttgaattcatcttctctgagttcatttctacttatctcatcacatcctttgcaagaacagcctcaattaaggccttcaataaaataatttaaaataaattatcaataaaatattagtatctggtatacaagataatggtagcaactagtgggcacctggtatgtggtctaatccctccaaggtagatattattatctctattttttagatgaagaaatggagtctctgagagtttatgtaattgtcaaagatcacctagctgtgctgtggtcaaatagagattcaaactcaagtttcccactgatgtcatcctgccaggttttccttcctttcctggccctagctaggacaccagaggccccatgcatgggaaacaggtgcttgatgctccatcattataaaaaagagctcaagaggacagttccaccaggctggcctctagtggttctggtcacagggtaagagctgtgagaatttagcgtggaagtgcctaaaacaaggcagaaagtgttttagaaatgttgacggttacagacagtcggaaatgcatataaaaattgttttcccttagttcctattgtgagcaatgaaacagattgctgttctttgtttttctgtctccacacatcaggctatgtgtgagctacttgcgggccacagactgtgcctttcacatgtgtatctccacccataagcataggctccagcatgcggtcggagcttagggagggagggagggatggatggatggaaaggtggatggatgcttgattgtgttgtgataggttgggtagataattggctggctagatgactaaatgactgcattaaaaggcagaagaaatggagggtggagtagtgttaggaagggaggaaggaagggaggatagtagatatgacggatgaacgactagctgagttactctccttggaataaagctaacatatattgtgtgcttttccacactcccagagtctgttggcatgagagtaaaaacagtgatgaacaaggcagttgttctttatatctgacttctagaaataaatggacaatggcaggaaagaggatccaccagaggcagagcaggcccttggtgcaagggagggcctatagggcagacaccggggagcctttggggagccagggaactggccctctatgcttggcagggaggagccccatgtccagcagaactcagcagaggcacttctgctctctcctgtgcccctaggacttgccgctgggataatcattttctttcaagtccccagagagtccttttttttttttttttttttttttttttgagacggagtctcactctgtcgcccaggctggaggagtgcagtggcacgatcaggctcactgtaagctccgcctcctgggttcacgccattctcccgcctcagcttcccgagtagctgggactacaggcgcccgccaccatgcccggctaattttgcttttgtatttttagtagagacggggtttcactgtgttagccaagatggtctcgatctcctgaccttgtgatccaccgaggccatgcctcggcctcccaaagtgctgggattacaggcgtgagccaccgtgcccggcccagagagtccttttatcctgttgtaagagcactggctgcttttgctgctggatctcctctctaccaaggcagtccctgtttgccctccaggctacaagacagggatctggggatacagtctcacagcacgcacccaccaccaccactttcaccgtcattattattgctttctctcatttaatacttaaaacaagcctagagaatagtgattattagctctatgtaatgttttagaccatgaaagagaagtttagtaactagtaacttgcccaaggtcacccaggtgggattctggtctaggcctacccgacttcttcactagcccacattgccttccagcagggtcctcctctcctgggctgtctgccagcgcccatctacaggatctaaaccccccatgcctgcctgagctggagtgggctggagctggggctgggggtgttccttacagtttcctagcctgggcctagccatgtgactctggggaaaggaagctaatattcccatctatgacactggcctatatttatccctgtgcccaggcggttaggaaaactattgtgcattcctgagaatctatgagtgaaataaacatttaaatgtttctataagatttatttaaggagaacaaaatgtggcctgctggcttattagagggtgagcttgctgggagatgacccagccctcagtgcttggctgattccagggaagggaaatggacccccagggaggctgggcccatggaggagtgagaagggcagtgagccaagggcatcctctgcccatgctgtccttttctccagctgtgtgttcagccttgtgctggtttgagggcttcctggaggaagaggtaccttctgtgaaggagagtgcagcttggaagaataagagtgtcagaggccagcagggcaccaggaaccaggggaggtgagaccaaaaactggggatgcagctttaagagtagcgtggtgtcgtgggaaggacacagcctgtgttcagtcacttcccctatttacaagcggcacagccctggacaagtcagtttttgcattgataaagtggagatcaaaatagaaaagcagaagagaaaaaagaaagatatcaatcttctaccccatgctcatggccttcactttcatcttctcgtttcctcttcacaattctatgagtttgggaggcattatcacccccaatttgtaggtggtgtcctcaggtttacccactgagtttctgggaggattcggtgagaaaacacgaggggggtctgggacagggcccaccacacagtgggcctgagtaactgccaattccctctagccatgtttgtttctgtgcttccatgtctgtaacccacaaagggcattgattggtttgagaagcagagggtgagagggagtggagccgggtgaaggtggccttggtggtgggtccttgatcacttgggcttatgtggtcagatgccccaggagagatgctccattgcgccgtgaccacagtggctgggctctcccaatttaactccagatggttgaggagacccagaactaagagcaaccatcttttcaaaaccaaatgccaaagtcattaattcaatcccgaagggaataataagggaacataacatctaatgcttagtgagcatttgctcagtgctaggtgcacttccacaggcttgccatctagggctgccagatttggaaaatgaaaatatgattatatgctgtacatggtggctcacacctgcagtcccagctactcaggtgagaggatcacctgagcccagaaatttgagaccagcctgggcacatagcaagattcagtcgagagagagagagagaatacagttatgtccatggaatatttgagacacacatactaaaaattatctgttgtacatttgaaattcaaatataactggggcatcctgtgctttatccagaaatcctatttctatatcaacttgtttaattcttataactaccctgtgagatagttccattatagattaggtaactgaggcacagagaggcaaggtaacttgcccaaggttatccagctaaaaagtataccataaggtagtgtggcttctgagcctgaggccctgaagcccctaagccagtaagttgtctggccaacgctatttggtcttactgctctcccaagctttcttgaaggcctgccttgtgtttgacagctcagaatgggagcagggatgcgtgtgtgcactgcatgaaaatctggcagaattcaccccagagggcccctagaatcttcccacacactctctcctggattactgtctccccagtccctgatagagtgaaaaacagcccccacaagacctgaatgttcccaccaaaacagttttgcagaaaaggagaagttgcccagagcttgctcaacgattctgtcagctgatgagggaaagaacactatgattttatgagttgtgtattttgcacacattagaaggcaagtgtgaagaaccttccaggatgttccatcaagggattagaggatttcctcctaatcgctttatgcttcctgctttgtaagccacttggaattgtgagtgtctgcggttacctgcttggcacttgccacccatggcttgtttctgcctttttgtatgggcacctctgccatggtcctcctccccagtgagatgcctacagtcaggagagctttgcttcaggtaaccattagccagcaagcagagaaagctcctatcagaaggcagctcactcccgtgccttgtacccatttacctggtaggtatcaacaccgagggcactattagtaatagcagtggaggttacttccccttctctccccattccttcatgctaatgaatgggaagcattgcagaggcccgctcagttcacctttgtcttcccagaccttagcatagaccctggccacaataggcattcaataaatgtttgccggatgattggacagaataaggtccaataatgtgggagtgttcacagaccacatccctttcttggacgccaaacagaatctgatcattgccagcccagtgcccctctcttctccaagaaggtctttgctctgtaagactcttcagtaaatgtttgtgagtcaatcatacaaacaaatgaagacaatctgcacaaaaaataactggatggagctgggggagtaaaggctggagcaggagaaaaagagaaagaaggtagacagaggatctgggcagggaggcaagcaggggaagagtcatcagagagggggcgtgagaatcgttaaggaaagagaaaagggcagaggagaggtcaggatgggagtgaagatttgttcccctttcatgttctttgagaggtgagagtaaagaatgaagttccttctatgctggttttctttctgttgaacagttccgtaaggcgagccttctcagagtctgcgccacgtggatcacggcttcattaggtttcagggcaaatagtttaaccacaactcccaaccatagactgttaggagcatgaggttctccttgtctgctagggatatttatgtttgtcaaatcatccatcattcccccatttatatagtctcatgtttttatatcttatattttattgttggttacttcaagttgctttgagaagtagatagtgtcaataagattaaaaataaacaaaggccaggcatggtggctcacgcctgtaatcccagcactttgggaggccaaggcaggcagattactttaggccaggagttggagaccagcctgaccaatgtggtgaaaccccatctctactaaaaatacaaaaattagctgggcatggtggtgcatgcctgtagtcccagctactcgggaggctgaggcatgagaattgcttgaccgggaggcggaggttgcagtgagccaagatcatatcactgcactccagcctgggagacagagtgagcctccatctcaaaacaatacataaaaataaaataaaatatgtattttacttatttagcagcctgaatatatgaaactgttagaaatggatatatgctataactctcctaataccaccacaattattttttcagaatacaacatggaattagctcatgtttggcccatcctgcccctttaaatagacacagcttatcctcatcaatgcatgccaggaatttgtaaagccccaccacaaggggtggtggaaaccatatgatagaatgcatgtaaaaaatgatattttagacaaaatgcatttcttcttgttcatcagaggactcatacaagaaagaaattctctaaatatgacagacatgaaaaaggcaactttcagagctcaaattttcacagtcagaataaaatccagggaaagaagcccgcgcatgctataagcacagtcagagtttccattggcgttcccatggtgataggcatgaggctgcccagatgatgtgggtgggagagattttaagcacaaacctcctgtgctctggaaaaccaggccaggatgaaaactacatgacacagggcagtaactcagatgcatttggggccagggagcacaaatcactgaagaaagccaatttaggatagctcaaacctggttactctgcagaaatatgggcctaagattgtttgatctttcagtttaaggaaaagcaggctatccagacctttatgtgaattcttacaattatggaatgttgataactaatttaaaaacttgtaaacactactagcaaacaggcacatgggtctctaatttgcacctctgagctcagaatatgcatcagaggatgctgattgcttaattgacatccaagagatcacacctgccagaaacactgacaaatccctgattcccagtaatgccttttgctaatgctactcctttttaatgatgtgaagagattcctctggaaagacttcagctcttcctactcaccagaaaacccacacagtagaaaactccctattccttcttcttccctggctctcccatttagcttggcacctgcccctggccctgcctgctgccccctctatctggctacctgccatttgacacactgcttccccttcttaacctccccagcccttgtgaatactgttccactgcatgtcctcggggccccagatcattgttccacttctcttctggtcccctggaaaccccagcctctgctgcttgctggcctcccaccaggggagcccactgaacaaaagatgggaaaaactggctcaccttgaatagagccatcattcattttaataataatcatgactcaagggtacttgtagaccatatgacacttatcaaagtgcatacacattcgtcatttctttttacttgcataatcttcctgtgagagagagcaggcctttggccattgtgccattataggaacggagggataaagccacaggaggacaagcttatcaccagcccatcaaggcatactatccagagaatgagttgttgcttttcagaaaactccctgggtgtctcttctagggggagtccttgacagaaggatgggtatctgtgtcctcagagggactggagctctgggatcatgaggacaggtcagccagtcttggtttcagccacaagcacgtgctgacttcttgtcactccctcttggccaactctaggtttccaaatggagacacagctcctatttaccagggagctcctcagaattcctataggggatgatagatgttctaataactgggcctcttctgtcatctcaaccagtgtgaatagagggatgcatggatgatctgctgtcaacatttctgtatttccctttgggtagttaagttattctcaagcctaaccttcagggcttcccatctccaaaaccataaagaccaaactcattagagtagcttcgaggtccttcagaagctggctcaatctcttattgtactttcacaattcccccagccctgacctctcctatctcacatgtcatagtccatgcacctgcaccagctacactgacaaatccctgattcccagtaatgccttttgctaatgcgattccctttggccaaatcctgtcctctaacatctttgtcgtgcaagctcctattcatccttcaagacctagctcaaatgtccactcctctatagagtcttctttaactcccctcactaaagagttttcttttccttcctctgagctttcacagaatgtggtccatcccttgtttccttatatttattatgagttacttccctgtatcccttgcttgactgcgagccctttagggtcttctcttcatatctcaagttgcttttggcacatggtggataaccataaagtgtttgttgaaagagaaagaaatctaaagtaatgtacacatttatttaaaacattaatcatatgctagatgcttagcacatttagaatatcaatcatggcctggcatcgtggctcacacctttaatcccagcaccttcagaggcagacgtgggaagatcgcttgattctggaagttcaagaccagcctggccaacatagtaagaccctgtctctaaaaaaaaaatttttaagtcagccaggcgtggtggtgcacacctgtagtcccaactactcaggaggctgaaccagggcaatcacttgagcccaggaggcagaggctacaacgagctatgattgtgccactgcactgaagaaactaaataaattaaataaataaaaatgtcaatcatgcataggtaccttatcaatgttatttttaatcttcacactaaccttgtgagttagactttataatcatggatcatagagaggttaaataacttgtccacgacacatagctagtagttgaaatttgagcccaggtttgtctgacccttccaataggcaatgctgcttccttctgcttctacacagcccacgtccctgcccaagcttcccttccatgtcccgggagattctgagtgcctcctcttccttcagccactgtagctttctgcactgaatcgctcccggataagaacacagagcccaatgaacatctcctcaaggatctggctctgggtttccacataaaagcatcctttccacaagagaagcagcatggtgctccccagctggactctcacccagagacttctccagctcatgtggccttatgcttggggccaaagaagggaagagatgaaaatgaaaatgggaaaagctgggttcactaaaaattgtgggacgtaagaagtccagatagcactgtatgagacccatttcacaacaaggcataatgtcaaaaggagagcaggcctcctccctaccttgcagggaaccaacacctgcacactgaaggctcaagaacacagcctggctctgccagaggctccagcccattggcagctcccaccgccagtggggctagtggaggtgaaaacatttcatatgcaggggctctagaaggatttggcccaccagggaaagtggcaatagagacagtgggcacccactgctttgaagctgcgggaggcagcaccaatagtggaggtggcagcaacatgctctgggacgctaggaggcaggcctttggcaaaggcagtcaggtgctcacagagggagcagtggcagcacatgccagtcaagggggtgggaaggaggagaaggaaaatgacaggcaccctcttaagttgatggaaggacctaagagaaaaccccaggagagtcttctaacaaattacgatcactgaaatgtcaaagttacccaaaggtaggactgtcgtggaacctcaggggtgtgtgggtgccactaccttttccccaggccatcattcttccccagccaggctggcctcaatctgaggactctgtaccattcttttcctgcattgctagtgagaactaaccagggatagcttgtagtgtccctaatcttagtgcatgaatagtggaccgtgttaagctcaggtgagggcctgctggggaataaaggagaaactgccttttttgttttctgagtaatccaaataacctatatgtgtgcactattcacaatagacaaggtatggaaacaatctaaatgtctgtcaatggatgaattaaaaaatgtgaaaaatatatacacaataaaatattgtgtctgtatacacacacacacacacacacacacacacacacaagaatattattcatccttaaaaaaagaaggaaatctcaccttttgcaacaatgtgggtgagcctgcaggacactatgctaagtgaaataagccaggcacagaaagacaatactgcatgatctcacttatatgtagaatcttaaaaggtcaaacttgcagaaacagagagtagaatggtggttgccagtgactgggggtgggagaaatggggagatgttggtcaaagaattcaacttactattttggttatgaggtgaatacgttctggggatctaacgtacagcacggtgactgtagttaataatgtattgtatacttggaatttgctaagtattgtccaccacacaaaaaggtaactatgtgagttggtggatatattagttagcctgactgtggtaatcatttcacatcaaaacatcacactgtatgccgtgaatatgtcacattgtatcaaaacattgtatcaaggtaatgaaaacatcgcattgtgtgccttgaatatatacaatgtttatttgtcaactatacctcaataaagctgggggaataaagagtaaactgcatttgtccccttatcaagatggctctgagcatcatgatgtgagaataaatgctctggctcctgtccctggaagtcccaccagcccaagcctaactctgtgtttttgttctaaaccggcagggtcctcctaccgcaggagtatcttgcagtccaactcccacgattgtcctgactggggatgccacttcaccagaaggagaaaccgacaaaaacctggccaacaggtacaggtgcctgatccttgcattgtgacaaacaatatttcctagaacatgaggatcagacagctatatttttaaataaatcttttcttttttcttgtatcattttattgactaaactataatcaagcagtttttcaaaatacaagatagaaataggaatttttccattatcttcctcctaaaatgatttttcctctcctggatgtggtccttttggctctgcgacggctccagcccatttgcagcctcctcccccagcagggctagtggaggttaaaacatttaatgcccaggggccccagaaggacttgttcccccatggaaagggctagcctttaagaaaagcataaatcaccgcaggagagtttcccataataactgtccagctatttgcagccaaacatgaaaggtgcaggtgtttgaatgtagaatcctgcccctggccaaaacgtgtgaaatatgatctcttggcagggacatgggctcacaggtagaggaatgtctccgccttggtttcacagagcactagcccacgaactgggctcgctgaaatgagactgtctaattttcaaaaagttaaaaagataattctcggccgggcgcagtggctcatgcctgtaatcctagcactttgggaggccaaggcgggtgaatcatgaggtcaggagatcgagaccatcctggctaacacagtgaaaccacgtctctactacaaatacagaaaaattagccgggtgtggtggcgggcgcctgtagtcccagctactcgggaggctgaggcaggagaatggcgtgaacccgggaggcggagcttgcagtgagcccagatcgcgccactgcactccagcctgggcaacagtgcgagactccgtctcaaaaaaaaaaaaaaaaagaaagaaagaaaaagaaaaggaaaaagataattctcatataaatatactgagcatatgtcaaagatttacttacctcattaatacaagaagcatctggataacaaagccggttcaaaggaggatacaagcaatggatatacatatatcatcagtggggaggaaagtgctggaataaaactgctaagttagatataaaataggtgaatgttctacagggcaatgaaaccatatttttgtcttttttcccaaacagaaatcatctgcgtctttgtcagacaacaatgatttacattttatgaggcttctacaagttagatgttagctcagagtctgggacctaatgagtaggaaatagtaagtcaaagtcacatcctcttagggcagtggttggaaaactttagcacgcgtcagaatcacctggagagctgtaaaatcatagctggctgggcccacctccagaatttctgatctgagttggggcctgagaatttgcatttctaagacgttcccaagttgagagtcagagaaaccctcgagaagcttgtaagatgatgttctaggatgactttgaaagaatatacaggcatctggctgggcacagtggctcatacctgtaatcccagcactttgggaggccaaggcgggcagatcacctgaggtcaggagttcaagaccagcctggctgacatggtgaaaccccatctccactaaaaatacaaaaattagctgggtgtggtggcacatgcctgtagtctcagatacttgggaggctgaggcaggagaattgcttgaacctgggaggcagaggctgcagtgagctgagattgcgccactgcactccagcctgggtgacagagtaaaactgagtcaaaaaaaaaaaaaaagaaagaaagaaggaaagaaggaaacaaagaaagaaagaaagaaaaagaaaaagaatatacaggcatcttttcacctattttcaagttgtggattgattttctgaacaagatgactgttctgtctttcagagttcacagtccccacaagaggctttctcaccgacacttgaaggtgtccactgcctccctgacatctgtgggtaaggaccagggcaatctaaggcatgttgagtagaaagacaggtctggcagcgtggctgggcttgactccttcctctctcctgctctttaaggcgctccctcccgataagtccaacaggacagggtagatcagcccctccgtgtctgggtctaggagaagcatatttaattcagttttcattgctcaaaagacaagaccagggcatgaagaggaagatgcagaagtcaaagaaagaaagaacagctgagtgaaactcatttctggggtttagggggcagagtcctccagcctctgctaaagaggcccacatccaggttggagtaggtgcctgagtgtaaggccggctgccctggtcatctgctcatccccagatggtggctcacgatctgccctgggctgttggaacatagatctcatatagagttggtccctgccttcatgctgctcatagactatgaagagactgagaaatgaacagataattgggacactgtatgataagagactgcacagaagagctaggccagccaaggcaagaaggggaccgagtctctctgaggagaggaagttttaggaaggtattccagaggaggtggcatttgagttgtgccttagagagctggacagataggcgagggaggaaaggcattccagggggaataggaaacacactgaaagagcaggaacctccctggagcatgttgctggcaactgaaactctgccatgtgtaccaattgggactttttcaaatgatagaaacccaactcaaactacctcacaccaaaaaaaaatttacaaaagccagggcttgtgatttcaggtagtgctggatccaggtgctcaaagtgggttattagcaattgtcccattccatctcttgaaccttttttcttgtgtgttagctttcttcttggcagactcttcaacacatggtagccaatagctaccagcaactccaagcttacgccccatcagtggagagttcttcttccccatatactccacaccaggattgcccctcaatggcttcacatggccatccccgagccaatccctgtggccaaggggattctgttcattgattggccaagactagtccacattcccactcttggcacaggggaggggggttagctaatggggaatcagagaggtttttaccaagtgaaaaccaaggatctgctgcccaaagacgaatggaacccgatggaggtgaaatgggagctgttcactgcagacacagctgaagtggagggacttgggaggagtatgtgggggccagcaagactggctgagcccagtttagggtttggataccacactgaggagcatgagaaatccccatgagatgaggtggagaatggcatggccagatgtggctctgatagccactctgataggcagtgggggatgggatggaggagctcgcctgagggcagggacctcttaggtagaagacataattgtccaggaaagagctaacaagtacgagcgaggctgaggcaggagaatcacttgaacccaggaggcagaggttgcagtgagccgagattgtgccactgcactccagcctgggccacagagtgagactctgtctcaaaaaaagaaaaaaaaaaaaaagagctaatgagcaagaatggagatgaggaacaggctccagagatgtttataggtaaatgcagggaggacttgatcaactgattggatgttgggggagggaggaagagggagaagtggggagtgactcctgtgatcctgagcagccaggtgagaggtggtgccgttcacccacctcatccagaggggcagttttggagaaaaatggggtgaacaatgtgactggagggaaggtggccacggggttgtggccgtggccaatgatctttggtctccttcttttattcacaaaccttaagcgcattagcttgtgaaagaaacaggccagaagcaagaatgcactgggggcgcagatggtgccggaggtaaggctcctgggtggccttcccttcctgacagagtttaggaaaattctgggaacctgagatggctccaggaccatttgtgacggaggaccacaggccataagccataggggccaggcctgcagaggaagccactgtctgtccccatgcaaccctcttgatggcactgggctgaggtttggctggctgggtcagctgtgggcagagtccctgggatgaggcatggtatggcatgacctcagcctggggccacggatgcagtggctctcaccccagctcatcctccttctgcagaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcaggtagggtggcaggatgtacaggtggctgccctgagcccctctagggtcgggagggaagggcctggcaccagctgcagtgggcgcctcacctccgaggaggtcgccttggactcacctgctctcctcagcagaggtcaggattctgtcctgggctcccttcccttgatctctgtgggtgctgggaaggatcctaggccctctggggaagaggagatggtctttggggaatttctgggttagagggaaggttttcctgggcccagaaatcctcctgcttcctctatgctagagtcacttttcttcctgagcaaaaagttgggcaagtgtgtaagtgtacttaggaggacaaggggagcttttgaagtcagggcccaccctgggaagtcgagaaggagcagcctctggagctgtacctgccaaccaacgccaggcctcagtttctggacagtgccttgaggtcaggccaggcaggctgagaagtgtgactctatcctcgaacccccaaatggcctgagggcacccatctcttgagcagcagcagggaggggttgggctgtaacaggagcatcatattgcagtccagcatcagcccctgagcccagcaaggcagacccagttcccagggcctgggaatacctaaaaggatgcctttgccaggttgaagtcctaaaccttcatgaatgccagccaatttgtgtctgtcttcacagctgtttccccgaacctcagccccagcgcttctcctacatcctctcgaagcaactcacttacagtccccaccccgccaggtgaggcccagctgcccggggacttcctgccctgcctctcgctctgggtggcagctcagcctggacagatcagcatgcctcccagcctgcaggcttccccttcaagaactctgatggccccttcacacccagagcaagacccctctccagggggggcatttgccgggccacccagaggaggcagatagactttctgttagcatcttgggcttgtgtcgggaggcaggtgtaccccagggtcaggaaggctgggtgggaaaggggactaggacagcctctctggctcagggaggctcagagaagccctcaagagcttatacagaaaggcctctttggggtctgacttcttccctttcattaggctgtacccagagtcacaccctccagccaacaaggaaagggggagggtgccaggaagggcaaccggccctcatcagtgcggcagggcacgctcaggtcggggccaggcagcctgggcccaaatctcagtgctgacatttcctggccatgagactttgatttccctgtgcctcagtttcctcctgtggtctctgtgaacattctgtgagggcccacctgagaacctggcacacgggaggtagtcagcaaatcttccaggcctgagattgcaaagggaggatagcccggggagggagatgtggctgaaagcacagctgagggcctgggctgctgggcctcactcactagtgtctggacccttccaggtttggatgtgtgcagtggcccgccatcccctctgcctggagcaccaccacaggtgacaggaccccccacctgctgtgctgtttctatgccaatgggtctctccccttaccccgaacaccaggaggcccttcgtgacccactggagatgagggtgctgggtggagggcatgaacaccactgctagggggcctccttggggatatttcaagaggaaacacggtctcttcccattgctgactgactcctgttcaccttctccagcagaagggggatgaggccgacgtctcttcacctcaccctggcgagcctgtgagtttgagctttgctccctttggatgatttgagtgtggggggcacagtctcctagaagcctaggctggctcctgggcagccttcaagtgtgtgtgcatgcacacgtatgagtggagggtcagggctggggaaacagcagattcccctgccttatagtgactagaagtctaaggtggaggggtggggaggcaggattcaggggggtgaactccgtggaggcaatactcacagcgctgacccccagtcaggctgctggttggagacaagggggacctccaggccaggtgagactgtggctcctgtcagctccagtgaaaagggcaggaaagcgccagcccctgcctgggattctgtctggggaagccgggaaaacctcatctttgttgatgagcaacagaagcgccccaccctgctcacatcgaggggcccacgtgctcagtgtttcaagggcagcagtagaatttagtgtcacctggaactgggtctgggatacagtcctctggaagagtctcagcacacacgaggcagccacacagacccccagacccacgtgctgctcacggcccaggtttcccttggggaatgaacaaagtaaactaacactgcagaatcttagagcttctgagcaggaagacatcacctttgcaagaatcaccccatccaatgatccctaacctctttggatcatggaactctgagaaattgttgaaagctgtggatgtttttcctagaaaaacacccctccacacacagacatacacatacataatttcagagggttcacaaacctgggtccctaagagttaagggccttgctaagcagcaccaaggctagatctggggcaactgagttagggccaaagctgccttctattcagttttcctcagctcctatcccttgggaaattcttggctggttttggattgcaggttccattttcctgtctgtttgacaaacctcgggcagaagccctctccttccacatcgtccactcataccccatacacacttatacaaatgggccccttggcaaggtgtgtgggggcagagactccacagcagaagtggcctcacctgtttcccctcaacctgcccccgagggttccagctctaccttgtctttttcagaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggtgggttcctgggggccagttgggcagagtgtgtactccaggtactccctgggctgaagacctcagggctgagtctgggcccctggccagggcagctctggcctggacttgggccttgtgagggcgtaaattttcccactctgagaagtcaggcctatttatgtggcatctctttcctaaataccagttttaggtgcttttttatgccagttaccaggcagagctcagtctaaaatctagttgccacacaaagccacatctcaggggaaggcagacgtgtggagggacatgtgggcccctcagtcctgggctgctttcctcctccaaccggagtcagtggctcataaacaggaatcccttgatggagtgcccagtcatgcctaggattagctagcaagggtgaaatagtgatttcctttgtgatgcccccaagccttccttcctgatgcctgttaacaaaagctttaagtccatctgcaagtgtgaaggctgctccgcccatggtgagtttcttccagtgcccatggtgtcccctcagcttctgttggccatcaaaccaggcacagcggtctcctgtggggttgccaccctatgcagggtatgattgggggcatccagagatagagaccagataacaggacaaagcaattctgaccagtcctgtctcctccagaaggcccacttggaatataaaccaaggcacctggattccacagagtgaggcccagcaccctcagagcaggaggcttctcctggctcctctacagagggaaatgtggggcagggaagaaaagaaggtgcccgatagcactcaagcacaattgaggggatttgtgtgctggcagggacacattccaatgctggccactatcctattcagataccttcatgatgctctgaactggaggcacaggggagctggggcgtggctgctgatgttaacattttacacacaaaactcctcctagtcagaaagacccaactaactagcggatcaaacagcacagggcccagaggagttgccacagtcccggatctctagcggaagttggagccaaggggccgatagccagggatttgccttcatgggcctctggttatcagagcctcctcactccctacactcctgcagatttcgcccacccagagaagttacagggaacctggaggccccatgtcactaaccactaccctggcacctgagtgcccagcccctacccgactccagtgtgctgaagctgatgggctgtgggcctctggcttgctaaccaaatgggtaaagggtccttgaccatgacttccacttggatcatgagcaccctctgctggccccttcctttcctcccttctcgggggacaaaccattcccaagtgccctctgccacacagcagactgaagatccataagtcacaggggcaaggagctctgccaggtgcctccactcaggtccttggtctggtgctaattggcttagagcaggtgtgagcccacttgggccacatcccatctctccccgggctctgccagctgaggccctaagccagcaattctcaggcctcacttttctggagagtttaaaaactcaagaggtgccataaaaggccattgatgacctgagtgtgtggggcaatcgcagctcctggaagtgagcagtcactgcccggaatgacagggcaggaagatccagccagccatgagatcgccaaagctgtttccaggagcagcgccatacacacccaggggaccctcctgtcccagagcccttagttctgcccctgtgtgtcctttgcaaacctcagccacagtgaggccaagcagttcatttaccctgaagcccacagacttgtttaaaaagaccatgccaagggtagtccctgacccatggaaagtggtgctgacagtggcgtttcaggcaccttcacggactgggagaggaactatttcctggtgcttctcaggcctcaccatgccatgcctgcccacccacctctcaggctgccccgctttcccacctaagatagtggtcgcagaaccatagacagagccaagagaacagcccagcccagtgtcatcatctgaaattgttatctctttcttttaccacaaaggagcacatcctgatgagaaatcagaacttagtggggctcaagcttccagaccttagtgaagcagctgagcaggaaaaaggtaggtggggttggggcagatgctgtctcagcgagtgctgatttgtctgtgccagatcaaggaaggtgaatgtgtaaacacaagacttcctgtgtcttcctcaggaaacatttgctggtgaatgaatgaatccgattgtgtcttctgcccgctcagcacctccaaacctgcctccttccaaccagcccccaggcctcgctgtcagccctccctaagccatgctggcatctagtgggcctggaagggtgcctcaggcctgaacttttgacacttccttttcctcgtacacccaggaagctgcccaaactgaagagttcctcttttcaaggcatcacggccatctcttgcttactaatctgctgtcaccacaaagtccataccccagccctgccctgctgggtagctgcaggccccttcctccaagcctctggttccctgtccaccttctgccagaaccatggcggggaaaatggttctgaaaatgaggcttcagcccccgcactgcctccctctctgcactcacctctgccgatgttctcagtagggttctgacccctctagatctagctgggcaagtccagccctgctcccagtgcccccaacacccttcctcggccccattctcctgcatgagtatgtcgagccccaccacgagttggaactgtaagccctgctaccactcaggtgacctgggcaagctattcaacctccctgggcatgtaaaaccaggctaagaacagtacctgccttcttaggtgattatggagattaaagcagctaatatctataaagtacctaaaacaatacctggtacatgacaggtgttatctaggtgtcagctattatccctagagaagaagcccccaagggcaggagtgtgtgtgtgtgtgtgtgtgtgtgtccactgcttacaacaatgcctggcactactagggcctgcataggtatttgttgaatgaacgaatgaaattgtatgagatgtggcagggggctaggtgaacctgtaatcccagcactttgggagggaggtggcttgcttgagctgaggactttgagaccagtctgggcagcatgacgaagccccatctctacaaaaaatacaaaaattacctgggcatggtgacacacacctgtagtcccagctacccgggaggctgaggtgggaggatcgcttgagcctgggaggtcaaggctgcagtgaactgtgatcgtgccactgtactctagggtctcgctctggggtacagagtgagatcctgtctcaaaagaaacatttttaaaaagatgtggcaggagcattgagataggtacatgaaaataatttgtaactgtaaccatagtgccatgaggtgggcaaagaggcatgggtgagtggagagagatgagtgtttccaacaggccaggctcctggctcttccctcttcccagagcctcttctctgtggccactcaccctctagcctctgtgcctctgtccccgcggcatctccctcctgctgggctatctccctcctctctgagtcatatggtacctgttccttaaagcagtgggttagtcccaccagctctgcaatcttctactttcttgactttcttttgtattttactctatatagtactccctttttcagagggggtgggggactattttttattgtaaatatatataacattcaacttgccattttagccatttttaagtatacagttcagtggcagtaagtacattcatattatgaagccatcaccactatccatttctagaacgttttcatcattgcaaactgaaatgccatactcattaaaacaataactctttattccctccctccccagcccctggtgatcaccttctactttctgtctctatgtatttgactcttctagatccctcctagaaatggaatcatacagtatctgtccttttgtgtcgagctcatttcaattagtaaaacatcttcaaggttcatccgtgtcacctagtccttttaattcaatcttaattaataaacttcccatagcattttccacagtataaaccattttgttacctctgattttatgtaatcttcccagtcagctaagaggggcagggattcttactcttatagttgaggaaactgaggcccaaggatctcctgactccaaatctcatggtttggccatctcatgaacagttttaaaactttttttaagctgcacaacatttcagacaagctgatctgtaggaggccagcgtgttggggagatgcaaatggggctgctctggttgaaggggatagaagggcttggatccttcatcttctgagactgtgggcccaaggtacctccagggacccaggcttcacagagcaccatttgaaaatccttgccccgcttcaagctgctgggggccagtctcagcataagagccctatggattcttgggtgaatgtgtccaggatgtcactaacaatggtggaagcccctggtctgaactgtagtaacttacacctacctatttattcagcattaataagaaggttcccagaagtaaaatttcaaacagtgttttttcccaagggcaaaatattttaaataaccatctttaaagagatcttttgaaaatgcagcatatacttctctaattataattttaaatttactaaagcatatttaaaacactggaaaaaacactttaaaatttcacccacaaccccatcaattctgaaaaactaacaatttttcttctttgcaatatttgcccatatttataatgttttcagttgatttgatgaatagatacagcttcttttttttacttgttattttatactcagcaatttctcctcagttatgatttaatgggtgcatagttcctcttgtattgacctatctattgttctttgaactaggattaacaatgctagtataaacaattatggaccgttagttgttcttttttcttcctttaaatcattcccttgagataagtgttcagacttgagaatcacaaggttaaagagtagaaacatttgcatttcccaaattacttacaatgaataacgctactgacaaagactgaatggacatctttctcttacgcattacccgtgctggtgtttgcttctgctccttattattcagaatatagtaagaataatcaataattgtcattgttttaagtttattattattagtgtgaaatttcattattatttcaattaatttgctaggaagctcaaacttaaaatgttaaaatagtcactttgttttcttactgggtgacttaacttcttacatctttgcccgtgtacccatttaggtctggggtttttcgttgatttgtttggtttttgttggtaatatatgtaaacttgatacattatagatattagcccttaattggctttctttcttttgggggggctgtattttaatatattttcattcaatcttttttttgctttttaatacgttttgtgttattttagaggaattgtaaagattttacataatcatgtttgcctatctttccctttgagaagtcttctattatttcaatcattataaaaatactacttctccccagttgtaataatatttccactttttttctctattaaaaacactgttataatgaatactatcttacatagatctttatagaaatctgttttttccatgggctactattctagacttgcaattgattggttaaaagtatttacttttaaatgtatatgtgcacactgccagattagcttacaaaattataccaatttagacatccactacctacagcaaaactttattatccaatattaatagggcataagatggatcttagaagtaaaattatcaggcaaatgaatgtgactcctataagcaccaaattttaaaaataaaattaaccatggtcagtgtccaacaatatacactccctctcattttctctcagttctagggtctggatgcttaagagctcagacttcatcacttaccagctgcatagccttggtcaaggttctaattctctccacgcttcagtttgttcatcttttaaaggaggttaataacagtacctacttcactaagctgctgtaatgtttgcatgtgatactggtctttattccagcaggaacctggcatacattttcatttctgtcatttaggttgtagaactctatcttgccaaccaaatgggatattcttgtacactgtgctccacagtgctagagatgtggtgggcaaccctccgtgtttaatgaatacttgcagacttgtgactttcttttcttatattctgaaagccccatcaaagagccccgtcccctcccatacccaggataaaaggctttgggagcattttatgagagctggctcagattgtatttataggcactaaatacagccctgcatatgaactcatggggaaaaatccagtctcttatgatggttgttggctgttcctttgagaaatgggaaaagatacttatcagaacattctggagtctgaagaattttggctctccttcagtttgtgaggactgggaggctcatttctgtgctgcatctagtctttccaacaacccaatcagttcccttctcaggaactatattgtatgctgttttgatctttgatcagttgcaggttatttcaagccaaatatgtgagactgactgtgggccagttcttaggctgtgtgctggggatgcattaagtgaaaagggttcaggccccaccatcagggagaaggccttgtcccagctaccattatcagtccccttggctaactcaacagcctgcaacctggtcccctctccctgcactcccaacccccaacccagctcacaccatggccaacacagcagccgcagggatctctagaaggcaaatctgtttcagcatcttcagaggcttcattctgctcttaggaagagcacttgaatcctcagtagaacctacaaggccctgaatagttaaccccacccacttccccagcatattctagggccacactcactctcactcacaatattttggcctgccttcggcagctcattctttcctcttcttacgcatggcacattctgtcttctgcatggaatgttcttcctctctccctctttgcctaatgaactcccaactcaatctttagatatctgctcatgtcacttttcttgggaagggtttgctggtaccttcggatcccttctcctttgtaaaatctctcagtgtgaaattgtttggatgtttctctgattaatctctgttcccctgaataatgagctccagaggatgtggcatgtcagttttgcttagcattgtatccttagctcccagctcattgccagggacatagtaaacactcaataaacattaaacaaatgtatgaacgaataagctcactgtctaggagaggaaacataagaatagacaaagtcactacgataaattgtgataaaactttaacaggccataaagtacctgggaacaaagaggaagaagcagctagctcagtggggttgagtcagggaaggttttcaggaggagccaccttgagctggggaagagaaagtcatcccaagcagggggacagcagaagcaaaagcatgtaggcatcttctagtgcttggcatacttcaggaacagaaggaatgtcatgtgaactaagtgtgagctacacgtcccagagagatgggcaacaaggtgggaacagtgggctgagaccaaggaaattgaaggctttgaaggccaattaatgagtttgaatttcatttaggacactttggaaagagaagcctgcaggtaaggaagcatcaggatcaaatctatattttagaataattcttctggacagattgtgagagctggcctgaaacagcagaggctagagacagggagacaccaggtaaaaggatagggaaatagcctggtgagaggtaatgaggtggtagtaaatgtggacaggatagtttgacagctattggagatcagcttgtcaggacttgatgaggagatggagttgagaggcagaccaggaataccaccaggcacctgtctgcatggttgtgagggtgatgaattgtgagacaggaggaggagtttgcttgagaaggaagacagtgaatttgagtttggacatgtcaaatgcccacggaaagcagcttgaatgcaacagacaaacctggttttgcattctggctgtactgctgataagctggaccctagtaaatcactttaactcagctgagcttcagtttctccagaaaatgcatttcataatacattctttgtactttcagaaaccaatttctcttctttggaggaagcaattaccaaaattcagcaggtcctacagtttcacttcacttcaagttcaattaaactctaatacttttaatttcaaaaaagtatatctagtataatctccctctttttcccttgctccttctgtatttgtggggaaggaggtgtttaagctattttttatttgcagtactattgtaagaaatgacaaagtgtatctactgcatagttgatgttcagtaaatggtggctcttgaaatgatttttattctccttaaccaggtggcaacgtctagaaggtagttggctatctggacctggattttgagggacacgtaggctgaggcagagaagtacatcgaatggacagtccttccaaaacccccagtctagactcagagcctcaggtcttgggcaggaaagaggcctccctgagaagaaagaggtaaaaaaaagtttatccccaactagcagctttgacttttaggaaccatcctgggactcagagcatctttcagagctccaaaagtaatttttccaagtccctgacatggtcagaaacaaatattttcattggaatgagctagtcctgggagatatatttgaaaataaatttattactttttgttgaaagtggcttatgttcatatctaaaaattcaaccaatagtgaaaaatacaaggaagaaagtaaaaatagcttacactaaacacctccttccccactaatacagaaggaggaagggaaaaagagggagattatactagatatacttgtttgaaattaaaactattagaatttaattgaacttgaagtgaaactataagacttgctgaattttggtaactgcttcctccaaagaagagaaattggtttctaaaagtataaaaaatgtattatgaaatgcataaagggtttggagttactgaggtagttttttgttttttgttttttgttttttgtttttgctttggtatgagttttaattcaatttttataaataatcatgtccatagtacaaaattcaaaaagtacaaaatgagacataggaaaaagtaagtctcattacatctctgtcccccagtagcagaggcaaccactgtcactatgttttagtgtaacttctagatatattccaagcatttctaaatatagacatatatgtaaaagtggatttttctttttttttttttttgagatggagtctcactgtcacccaggctggagtgcagtggtgccatctcagctcactgcaagctccacctcccggattcacgccgctctccttcctcggccgggactacaggcgctcgccaccacgccgggctaattttttgtatttttagtagagctagggtttcaccacgttagccaggatggtctcgatgtcctgacctcgtgatccgcccgcctcggcctcccaaagggctgagattacaggcgagagccaccgcgcccagccaaaagtggattttttaaacataaatcgtagtatattatacaaggggttccaaaccttgcttttttcacttagtaatatacttttttttattattatactttaagttctaaggtacatgtgcacaacgtgcaagtttgttacatatgtatacatgtgccatgttggtgtgctgcacccattaactcgtcatttacattagggatatctactaatgctatccctcccccatcccccggaccccaccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttgttgccattgcttttggtgttttacacatgaagtccttgcccatgcctatgtcctgaatggtattgcctaggttttcttctagggtttttaggttttaggtctaacactgaagtccttaattgatcttgaattaatttttgtataaggtgtaaggaaggaatccagtttcagctttctacatatggctagccagttttcccagcaccatttattaaataggactcctttccccatttcttgtttttgtcaggtttgtcaaagatcagatggttgtagatgtgtggtattatttctgagggctttgttctgttccattggtctatatctctgttttggtaccagtaccatgctgttttggttactgtagccttgtagtatagtttgaagtcagacagcatgatgcctccagctttgttcttttggcttaggattgtcttggcaatgcaggctctttttcggttccacatgaactttaaagtattttttccaattctgtgaagaaagtcattggtagcttgatggggatggcatgaaatctataaattatgaggtagtttttttgcattataggttttaaatttaatctaaactttggacctggcatttgttttaatcaggtatggtatgacacagagacccacaaatgattctcatgaaggaataggtttatactcacagatccctaatagcaggatgtgtggcacatcatacagagccccttggggaagggctagggtgggtcagaaggcagaagtggtgaggggagagatggccccaagcctttactggggttttcttggaaaggaaaggtagaggcagggtaggtatcctcagtatgtttagggttggctagtttgaataattttggcaggacctaggctatagggtggcccgtagttgtcaggtactggccctggggtgatttagggggagtattggcttggtgcgtgagaatttgataaaggtgatgtttacaggtgtgggttctggattggctggtttgtatttcaaagacacacttgaaggagagttgtttctaggaattagctagccttgagaggggctgtcactccaggattaaggcaccaagtgacagaacatcaagaatacggaagataagaacatgtagtcactacaatggtacctactgacttcctgcaggaaaagatgagaatggccgaatatcttcccaccttcacatttcttcctacatttccatttctacctctacacatcttgaattcttctttgtacatcattaaggttataacatttacattccatattctgtaaccatggtttccacagttatttagccttagacttaaatgtaaaaagatttcatgttcaccactggtccctttcccaaatttattcgatttatgtcttgtttagctggattttgttttccaacaattttcctgaaagagttcagaggtgctgtgttccctgagttctatcacatttgaaaattttgtcttttcttgaaggacagcttgtgtggttacaaaattcttggttgactgttttccttggaactgcgtagatgttgctcccctgtatttaaagttatggagaaagctgggaccagctgatttccagcacctcttaatcttcactttcccatgtagatgtctgggtttttttttttttttttgtatgaagcatttaaatatattttttaacatgatgcggtctgtcaacctgaagggttcaactttcccctcaagtgaggaacatttttcttctgttatatctttgaatatgtcctttgttccatttgttttgttcactgcttcggagacaacataatgcatagatgggtcatcagagtctcaactccaggtccattattttatctccatatacttcaatctttctttccttctttgcattcgttatgattactcaatctctaccaccctcctctaattcagcttgaagctatatctgctttattccttcatttttccaataaattggttggttgtatatttcccaatttcttgattagtccttttattttggtctttaatttgtttccttaaatagcaatcatcttccatctttgcatgatcttctcatcccaactctaatttcttaattttttttcaggttattttttctagagtcaaagtatttatggtatatattttgcacagaagcatacttttgcattttttgatgtgtttcttgcaactatgtttccatcctgacatctgtctcttgcacatttcccttttccttcctttctaccttccttcctcttttgtctatagtatttttgtatagttgccatgccatctgttttccttttatttttttctgatttgtatatttctaccttgattccctttccctagatatattgtattgtaggttagtttttgttgactccttcctaccttagctgggatctcttagccttccctttagtgctttagttgaggattgtatattttgtgtttgttttgttactgcttaggtggtggggaaaaggggaagttaagatagagctgtttgtagaattggtttcttctctttttccgtaactctgttcatagtccaaaacgtgagtttgttataccaaatcgggggcatatcttattcctttggaggtggttagtagtgggtttcagattgtttcaccaatttaggttggaattgtagagacaagctgtccgtaggtttattttccagacttgacccaatgcttcccaacggctactcctctgctaagaaaggaaggaaaaaacggcaaatccaaggagtttagccactgtttttcaggagtcgggggagaacatggtggttggggctttccatgtgtctcctgccattcactccttcagagggacgtgttttatttactttaccgttagtcttccttccttgtaaatcccttcatatcattcaagaaaatccactctgtgttctgtgcgatcattctgcctttcctctcttcttctcatcagtaagaaaagcaaaatggcaggcagcccaggcagttttttctctcttcgaaatgctggtaagatggaatggagaaccttctattctagggaaactttctgaatctcctctgacaactgcctacttgccccctccatccctttccctctctattctgtggtattgaactctttgtaagaattttttctctcccatcttcctttcagtactgattctttggagaagaagaaagggttatcatgggtggaagctctacatttattcctagtaatttttattctttctctagtcactatttttaaagactattgccttttcttgtatcttagagtttcttgtgtattttttatttgttctgaaattttttgttgttaatttggttgaattcaggaggaaggtggttggttcctagaatccaccaattctggcattactcttcaagcaccattttgggaaacttttctaggcaaaaaccctgatatgcatttcacttgattattagacctcatatgtttcgatcatcctatagatatctcaggagcttgctactcagttgactctctgttgagtgtggtagggatacatacataaaggtagaatgatgccaggggtgacacaaggtttaccacagaaaccttgtcagagagctataaataccaggacagaaccagagaggtaacaggtagctaagagaacttctagttgaatctcatatccaaagaagaattgctgactgacccatctctgacagatgatcctccagcttacttggctaccttgagtaccaaggaatccatgcctaccattctcttactggcaagctcaaagtatttaaacatattttaccttgagccaaactagatagcctcttgtctcttcatggtctcctttggtgagacttctttctattcacatgattcccagtcttaactcttcaggtggctacaactatgcctatagtcctggtctctagcctagcctaggatcctggaaaatgattgagcagattggaaagctaccaggttaaaatccaggagaaagagtaaaacatggataaatatgaagttctacatgcaaatggaaagtaaccattatacaggatgaggataactgatttgggtcaactaaagaggttgagagttttgcttaatgctaagtgtactgtaagcccgtagtcaggcacacaaaatctatgctgcatgaataacaaacatcaatgccagggacatttaccaaagtcttcctgtgctaagatcttgttagagaacatctgggcctctgtaacagcaacaaaccagaatgtgtgcaggaatgggatggtatctagagaccatgggccacagtggagcacagtgagcttgttggaaaaatggagctagagtctggagaagagaagctttagagaggcacaggagctgttttcaaacaggagaaagatttatggaaaagagaatacttggtttgttcattctgtcttcaaagcacagacccaagatagttttagaagtttaaaaaacaaaaagctgttcattgtctctgttgactaggaggcatttatgtttctgagatctgtaaaagatctagcaaccttaggtttactctggaaaatctcttatctatggggtatggaatcagatgttaatttctaagtaggatacataatatagaacattttaatttatccgaggaggaataattgaacaacaggtctcctgagaagcctgccaaggagcaggtttttttcccaaacattatagccaaagagccaaccagcttccaattgccagcttaatactgtgggaagcaaagggaagaacataacatttgaagcaggtagaccttgaggtctggccatgtcatttgctagttctgtaatcttgagcaagtgacttaaccttgctgagccttggcttatctacatgtgaaatgggatgactaagttctagctcattgtgagaataatgtaagataacaattaaaaagcccttaacatagaactagatacttataaatgtcaaagctcctgaagctagctgccaacagtactactgtgatttcaaagagacattttataagtaagcacttttttttcagggcttccttctgaactctccccagctattgaggaagaagagtcaaagagtggcttagatgtcatgcctaatatttctgatgtgctgctgcgcaaactgcgggtccacaggagtctccctggaaggtaaaatcaggatgtgggttacagaaggccctgtaccgagtggcccctgtgttggattctaggtgggacacagaggaacaccagtcttaattcttgaacccagaagggccaaagtccaattgtctagatagggataatgcattcgaaacaaaaagaataatgaaaggccaggctgggtgttttcaactcaaaggccaggtggggttcttaggtgagcacagttcatgaaggcataagggtcaccagaagctcatggcagcagagaatgggctttgagccaggagacatgggtttcaatcccagatacaccatttacccatgactagttaagttttcaaatatttttttgtagagatagggtcttgctatgttgcccaagataatcttgaactcctggcctcaagtgatccttctacctcggcctcccaaagcacaaataacatttaagtaaccaaatgaatgatttgaaagagtaaagttggtagaaagaccataaaatagggcacatctagagaatgacatgagagtggggcattgggtaggaggtcaaggaaaggcctctgtgataaagtaataatttgagatgtgcaaataacaaatgacaaaaagccactcatgcaagggttttggtaagatttacagaggaaaaaaattgtaattttaacaaacggtgctgggacaactggatagccacatacaaaagagtgaagttggacccctacctcacacaaaacacacaaattaactcataatggatcatagacctaaatgtcagagagaacactataagactcttcaaagaaaaaatataagtaaatcttcatgtctttgggttttttagatatggcaccaaaaacacaagagacaagattttaaaaataaatagtacttcctcaaaataaaaacttctgtgctgcaaacagtgtcaagaaagtgaaaggcaacccacagaatgaaatatttgcaaatcacttatctgaaaaggaacttgtttctagagcatataaagaaggcttacactcaataaaaagataaataaccaatttttcaaaatggggaaaggatttaaatagacatttcttcagagaagatatacaaatagtcacttaaaaaagatgctgtgtccttttagaggctcacagctctgcccccgggtacctatgcccatttgtaaggcacagttatctgcatcagacaccagacataccatgtggcttctctgcctaaatcatacttctctgagtcctcagagtttccccccagacccccactttttttttaaggtgggtatgttctaactgggtgtggtggctcatacacctgtaatcctagcactttgtaggctcaaggcaagaggatcacttgaggccaagagtttaagaccagcctggacaacagagtgaaactctgtttctacaaaaaataaaaataaaaaattagccaggtatagtggcatgcacccatagtcccagctactctggtggctgaggcaggaggattgcttgaacccaggagttcaaggctgtagtaagccacctctgcagtgatcctgccactgcactccagcctgggcagcagagcgagaccctgtccccaaaaataaataaataaaataaaaataaggtgggtgtgttctacagcaaaaaagcagaatgtgagtcattgaaatagaaaaatgtttggtttataatttatgaaaatatgtgcatttcacataatatcccaacaaacccaggagtcagaaacaaacttggcaagttttgccaaatcatttaaatcatatgtgtatgctgtagatgacagttaaggcaagggcctgatgggtggggttgtgacaaggactgtaagtgtcaaacatccctgcagctgtttgtcccgtgttctggactccgctgacttcatggccatggggtcttctcatcctgacaggaaggcactcatatcattccctaggggtgagaaccagccccctgcagagacggctgacccctacctttgctcttggggtcccttcacacccgttcaagagaggaagctgtgtttcctgagaagcttattgatggcatgctctgttgccaagttctgtgacgctggtaggacccctcccaggcctccccgccccagcacaggaaagggcctgtgcattatttacattgtgtggacttcagatggggccagctttagttaccagcaagagcagcagccacagcagcatcgagtggacatgcagatgcagggactgcctatagctggagagccctggctgtgggaacgccacagacgaggagctgctcaaaaggatgcctctgtgtcggctggggctttcttgccactctgtgattctagccatcagaagttcttgctgtggagaagaaccctggtcactctctcctaccatttattctctggcccgcatgcacctttgtcacagccctcagagacagaggagggtgaggctttgcagacctgggtggatatccccagaacaattataatggcaacttagatgtgtatgagttataaagtccttatcacatgcattttcttatttctcacagcaaggctatgagttcaaggtcacatttcccgagagcccactgagtgtggatgccatatatttatgcatacaaacacatacacatacatacatgagtacatatagtgcttataatacctctgcaaggtaggtgatatgattcccattttgcagatgagcacgctggggcttagagagattaaataacttgtccaaagtcacagagatagtcatggtgccgtaagagtcagtatctcacaggtgacagagcacaggcaaggggacattgcatcttttccttctcaccaacacagcttactccacccctggaaacacatggtctgctggtcattcagagtcacctttgggtctattgactaggttgcacacagttcaattgtgtgttttctttttcacagtgcccctccactcactgaaaaggaagttgaggtaagtgactcaagtgtgttatgaaatttagtgcccgtgcttgactgggcttattcaaaacatttcttcctccagactctagctctgacatttttagacaaaaatgagaaagagtgactgtggggtaatgtgaacattcatgaccagccctcttgaaccatgagatccccattcccacgtccgttcatggaagattttgacaaatttgggcaaaagggagaaggtagttggaaattttacattcctgtaaggattgtttatattctttaaatgtacgacttagatacacaaaaccagctgggaggctgcagaattgaatcaaatttatttcaaaattactgaaaaatggtcagatttcaagttctaagctttagtttagtgggaaagggggctggcctcctcagggtttcagctacaagaatgccagctcagcggagccgggaagctgtgctgtcagcaatccagccttccggtttcctcactggggcctccttgtcccagcggggttgtgagtgagctgaggggaatctgcatttcattctgtagcggacaaagagaacttatcagaggtgagacagtgagaactgctgatgtggaccagataagcagaggaagacagacagtatgaagtatctaccacaggtagtatctataacttgcacacaggcattgcacttgcagtctataacacacgcatagccatcctttcagctgatcctaaccagcagctctgaaaagcaggtggagcaggaatcagcacaaaggagaaaactgagtgagtaaataaccacaccaagtttctagatactgtagttggcaaaaccaagacctagatccaagtgttctcactgaattcagaactcattgtgtcacactgctgttaaggggataatcaaggtatagaaaattaagcattgagcattattcatagacttgaccaaggccgggtaaggcagaaaatttctatcactgggctatgagctctaagcctacccactgacatttgtgaagatgggccatgggcggtttgtttaatgtccaaatgctgaccgcagatgtatatggacacagctctcggcatggtggaaataaaacaggctttcaaatcagacagtctgaggttaaatcctggctccgttactccgtgtcaccttgaacaagttaatgaccgttctggtcttggcctctttacccataaacaggtataacagttcccaccccagagggttattgtgagattacatgaatttgtagaatgaaaagcagtgctggcatatagtagatgctcaataaggagtagttttcaatattgccttcatcatcatcattgggtcaattctgtaccttcaattcttctggagatgactgccttccatgggccatgttacatgaacttcagaagcccctgtggttactaaccctgcagggtataaatctgctaccactcagggcagatgatggctgtaaaattgaagaccattgcttccttcctgagtgaggtccatctgtctatttcttctccctagtagtttcctactgttctgggaattccatgtatgaccaatattatcttttcaaagtctgttcatgcaggctgcaattttagcatgaaacatttatttattccagaaagcttaaccgaacagaatcatacctggccttatttaatctcctggcagctacttaaagcttctatcaatacaggatttggaatactcgggctagatgctgattgaagtttgctttacgtcaacaatgcttaaatctcacatggagtttctttcaatacagtattttcctgcaaaatctccaaaacccctcatgcaataaatcccagcataaatccagatgcttacacaattagctgtactggcctgagtttatctaaacccagatacaggatgttattttcttaaaattcaggaaaaagcaaagtgttattctcttcttattttttggtagaatacatttggacctccggttctgggaagggcctagcgtggaccttggtccctgctttaccatcttttttgtggtttcctgtgaagtgagcgtttcccttgcacatggctgctttggtgctttggcggctgttccaggggccgttgcaaaacgctcgtgcaaggagcacagctgcagccttgtcctctgcagtaactcctcccagcacctctctcacacccttgttcccaacagaacgtgtttgtgcaactgtccttggcctttagaaatgacagctacactctggaatctagaattaaccaggctgaaagggaacgcaacctgacagaggagaacactgagaaagaactggaaaacttcaaagcttccattacggtaattgtggagcctgatgtgaggaatccctggagcagagactgtccccaagggccatacagggtgtcatgcttctctcaggtaccaagtatagtctcctgaagtgaaaaattgagccaagactctgacagtgttcctcagagagttggggggaactgaggcagagatcccaaaggcctggttccctcagggctgtggacaggtcctccaaagccttgggagcttctcagaagggggcagggtggcctgggtgtgactcctactttcaggcgccagggatagcgtgttcacattgggcttctccaagcaccagaagaaactgtggcccaggccctgcagaggccacttctctcagcctggatggggcccagagctgctttcatgagagctgagtctaggcttggtgtgtgtcttagtcagtttgaattgctgtaacaaagggccttagactgggtggcttaaatggcaaacatttatttctcatagttctggaggctggaaggccaagatcagggcaccagcatggtcgggttctggtgagggccatctctggcttgcagactaccacctttccattatatcttacatggtggaaagagaacagaactctctggggtcccttttataagagcactaattccattcgtggggctccactctcctcacctaatcacctcgcccaggccccacttcactatcacattgaggagttaggatatgtccccccaaaagtcagcagatgactttgtggggggcacagacatttagcccagtggtccgcatcccctgggccaggccgcaaaccggtaccaaaccatggcctgttaggaaccaggctgcacagtaggaggtgagctgcctgagagcatgacctcctgagctccgccgcctgtcagatcagcagcagcattcgattcccatagggtcacgaaccctattgtaaactgtgcatgcgaaggatctaggttgtaccctccttataagaatctaatgatcagaggtggaagagtttcatccccaaaccatcgcccccaccaggtttgtggaaaaattgtcttccaaaccagtccctgaggccgaaaaggttggggactgctgatttagtccataacattatttgaggaccccaggtgatgctcctactcctgttcagtcctcagcttcactctggcaccactgtgagcaccgggaaacctaccagaagttgctggaggacatcgctgtcctgcaccgcctggctgcccgcctctccagccgagctgaggtggtaggcgccgtccgccaggtgagtctctccagcccccggtcttgccaactctgttccacctacgtaaagtagagcaatcacccaagcagcggcaactacagataccacttagaggtggcttcctctgggccaggcatcctatgcacatcattgcagtattattcagagtatttttggcagatcactgaaccctcaaggtgctttgtggaaaaaggtttctgtggacgcacaagtttggggactactgcatactatctttctttcttggaaatttctaacacattggcctaatcaaggctttggtaactcctgtggtggagaaggctggttcactttacctacatagttcccaaacgtatttaactgaagaattccccccacagctctccattttatttttctcaaaaaatacctgttcaactcccatggagctagtatttgacaaaacatactttaggaaaacctgctttgtctcattaaatccacccagcaaccctataaatatcctgtctcccagatgaagatgcagagtctcagaaagtaaaagcgttagtggcggagcggggcacaggcccaggtctggctctctcttggccactttgaagtcctgaagcatacagagccccgccccggccccccatgttgtagcaggagcacattgcccgagttctaatcctggctccaaccttcattcgctgtgtgaccttgggccccttactgaggtttctctgcttcagtcttttcaagtataaaatgaggatggtcacagtatctgccatagagggttgctgccgtacttgtaaagcatttggatgttgttattatgttgctatgacatgaatctatgtcctgctgctctggttacatgagaggaggttcctggggtggtgcagccctgagcagttcctattaaataaaagaaagacctgtcgctgggccatcccaccctgtgtccttcaggacaaggacatctgactcagcagtggtgcccaggaagtcactccagctgggagcagcaacacgggaggactctagggaagtagctggtctcagccacgcatgactgtgggacctgttcctgcgaagccactgggtgtgtccctctgtggccaggcagggcctgagctagatcctctgagggatctaactggggtatgagcagagagaaattgttctcattgtgtgcaggcttcccaaacttgtgcctcagcccacctgtcactcacgccatctgctcccttctccaaatggctccctcgtcttggctgctatgtctcagtctttgccttcctctctggctccactgggccaggtcaggcttcatcctgtttttacctgctgccctcactgccaccagtctcactcccttgagtcccatctctacctatgacctgattatattactctcttactttaagggagatattcaatggcttcccttttccttcagaataagttcaaattcctttgtctagcattcgaggtccttcacaacccagacttacaaatagacccaactgcttgctgatccctacataggtaggaggacctgcagtgtctgggctttctggacagccctggtttattatgtcgattgtcccagcataatttgtcgtcgtgcctttcttcactctccagaggactcttattcagaggataaaacctcatctacatataagccctgtgcttccctgcctctagactcctcttggagttccctggcctgaacgctgtgtccctcctgcccttgtctatgggcccagatgctgctcacatcctacatccactgcattccctctccatgaagcctcccctgacccgttctctgcaagcagaaacaactctcctctgcctgtcatctcctgcagtgtggtggctgtgcttttctcattctccctaagcgcaggtgctgagtccacctctcagctcacatggcagacagcaaactcttcagagggcagagtcttgtccctgtatccttttgattctcctagcccagaccctaggtcagagcaaataagtgccaacggagcctttcctccaatggcctcatgcactcatgcgctccttccccgcaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctggtaaggacctaggctcctgccccatcttggccctacaaggtggacttccaagagctcttggctaggattagagctgtcagaacagccccaggacttatttccagttgagcagcactcctgtctagtgctgcccacaggggcctcccagcagctgcttcagtgggcctggcagggcagtctggaaccaggaaacatgagcctttccaaagtgacttcctaactcccaaagcaataaatcacagtggctgaccatggatacaaagcccatgggctacaagagctcttggacttacagggtctgagagtgaccctagaccctgtcagtccgtgtgctttgggatccccttttaggcagcacatgctaaggaatttgggctttattctggaaagcattagggatccagccaatgattttaatcaagaaaatgacttgatcatatatgtagtttaagaagattccctttaactgtggtgtggcagttacattactgggacaaagcagggatagaaaaccccatgaagatgttcttgcaacagtccaggtgaggggtgaaacctgggcagttagggtggagtgagagtctggctgaaggagatgttacggagaaaaacagcagactcatgggtaagacagaagtttcaaagaaatactcttgtttagaagttctatacgaattgctataggagcacgggggagggcccacctgattctgcttgaagggagacaaagaagccttcaaagagggatggtatcttgttggtgttttaaagtaaaaataggagttctccagtcaatagaggaagacacatcccaagtggagaaaccagcatggacaaaggtgtggaggttgggggtgaaaacaagatgaaacaaacagtttgtcatagtggcagtgtcagggtgtggaagtgagacttggttgaccagggccacacgccaggccatgctagcaatttgagcctctaggcaacggggagtcattggtaagtttataccacatgaggtaatcagcctttatttttagattattctgacttcagtggacaatatattggaggtgtgcaaaagctgaggtaaagagagacacagtaggaggctctttctcagtccagcaggaagaggttggtgccttggaccagatctctccatgggcactgtcagggtttgaactctggctgatgagggtggctagcaggagaaaacagaccttttagcaacaggaatccctgtggaatgcaaacatccgtgttaccaagagctgcagaagggaaagtacagaaagtataacagatggagaaacctttataaacaggaggtttcacaagtttcctggagaatatcagtgacatgtcccagagtccaaaggcagcatgcacacatgctccagactgtcagctttggatctgtcagcaaggctcctgacccacatgcacctaggcctctaaccattttccgtcagtgttggaagctgaggaagttgccgccaaaggaatcctaatgcgtggactcctgcatttattgctgcacaaggcctcctgcaaaccaccttacctaagatttataggatgagcagttacccatgagtctcattcgttcattctacagacatttattgagtacctttggtttgccctatataatactggaatatagaggtaaagggcacacagtcacagacccaaaggagctcccaacctttgggaagtcaaggcagtgtagccagtgctatgacagaagaaagcagacttccgaggagaatacaccacagagtcccacattcactctaggaggatgagaaaacgcttaccgtaggaaaggtcaacgatagctgtacgtgtttttctgatatttgtttccactccagttgttcttccaagctatacctcagcttgggctaggcagagtggccgtaaccactcagcaggtgtttccataagatactctatgactgttccctaatagtgtttgtgtcttaagcctttatacaacctctgcaatctttgtctatgcctggggttttgaagactgcagtaaataaaatatccctgatttcaaggaaggtgatatacattttttaaaaataacatgtttctttctgaatatgaaatttaccaattatctgcattttagattatttccttagtgtagatttctagaagtatgaatactagctcaggggaaataaattttttaaggctcttaaagcaaattattttcaaataacccatttatgttttcactgaatgggttacaatactcaattcaccgtgccattgacacaattcttgttctttctttttgtaaatatccatgactttgataggccacaattgtgtcttgtcttattgttttaattgtatttcttggcctttccaaatgtttatggaacatttgtatttctgcttttaaaaattctgtatttatgacctttgccacttgtaagcttggtagtttactaatttatatgaactcttcacatgtaaagaatattttctggttctgctattttggctgactggaaaacttgaaaatcttttgaccacaagcacttagaaattgctgctggacaaaataaagcaaacctttgtctaaatagctgaatccacaagaaaataaattgaaatacccagatacaagaaaagaaaagagaactgaaaccaagctgaccctgcagcttccttagggacaagtgtcagccttggttatctgggagctgagcttttgcacttgcctgtggtctgagacaaggcctggaacacctatggtagagagttgacacagattcccacagaaagttaagggcgtccaaggactatatcctcagatggaatttggataaggaaaaataataatcaccaaccagcagagaaacaaggaaatttgtttcaccctggactgtagtaggaaaaaacactttctccttcctcatagggaaagtacgtgctcacaaagtgacagcagtgatgatgcaatatgcagaggatttgaaaagaacagcaagatggtgcttctaagatatgttagaaataagcagaaaagtactctggagagacagaccctgcatctggacacacaggattcctctaataaagcctcactgaagatgacttcacaacttaaaattataaaatacacaagaaaacaattcatcatgaacaaaagtcatcagttacacaaaacaataggattatatcctaagaacctcggaaaataaaatgatctgacaatttttttaagataagcttaaaattgttacaggtagctgggtacagtggctcacgtctgtaatcctaacactttgggaggccaaggtgaaaggatcgcttgaggccaggaggttgagaccagcctgggcaacaaagtgagaccagcctgggcaacaaagtgagaccctatctccacaaaaaataaaaataaaaagcaattagtcagatgtggtggtgggcacctgtagttctagcttatcaggaggctaaggtgggaggatcgcttgagcccaggaagtcaaggcttcagtgagctgtgatcatgccactgcacttcattctggatgacagagtgagaccgtctctaacttaaacaaaaattattggagacataaaataatggatcaaaaacagagtaaaagaatacagttatcaaagaagaataaaatagaactcctcaaaatgaggaataaagtcacagaaatcaaaaactcaagagtttagatgtggtagttactatatttgaggctattcttcattattccagatctccttcttctgggcacatttacccatccccttgaagtcacaaggcaaggccatgggatttgctttggtgaatgaaatatgagtagaaggacatgtcacatctgaacctaggcctctaagaactagaatgcagtttgccctgtttcttcctcctaacatgataaccatcattgctccagaatagtagaaggccagtattaggctgagtccagagtgaggaaacagagaaccaagcttgctgcagacttggaagtaaatgagcatgtagcataagcaaatcacatcttccttgttatcagccactaatactttggagttgcttattattactatgctattaaactagtataacctagcttatcctgattgattataacatttaaatcaaattgggcacagttgaagaaaaattagttaacttgaagataggtttgaggaagttacccaatgtatagttcagagaaataaattgattaaaattatgaaagaagcattgagatatgggatatagaatgcagaatgagaaagtcccaaatacatttattaggccatccttaaggggaaaaccaaggagagaaaatatgccaagaaagaatggctaaggattttctagaactaaggaaagtcatcaatcattggattcagaaaatacgtgaattccaagcaggaaaaataaaaacacaccaaagagaaactgcagaacagtaaagacaaagggaagatcttaaaagtcatcaaagagaagattacttacaaaggaatgacaattctcaatggcaataatagaagaagccaatggaataatttcttaaaagaactaagagaaaataactgtcaatctagagataacacagatggctaagataccatgcaagattgagggcttggtaaagactatttggagacaattgagaaagtttacctctcatagaccctcgctgaaagaacaactagaggatgtacctaaggaagattgaaattgaactcaaacacatgctcacaaatgttcattgcagcacttttcacaatagcaaagacatggaatcaacctaaatgctcatcaatgacatattggataaagaaaaatgtggtacatatacaccatggaatactatgcagccataaaaaagaatgagatcacctcttttgcaggaacatgcgtggggctggaggtccttatccttagcaaactaacacaggaagagaaaaccaaatactgcatgttctcactaagaagtgggagctagacattgagtacatatggccataaacaagggaacaacaggtaccaaggcctacttgagggtggaaagtaggaggagggagaggagcagaaaaaatcaatgctgtctactaggcttaatacctgggtgacgaaataatctgtacaacaaatcttcatgacaagtttatgtaatgcacctgcacatgtaccctgaacctaaaataaaagttaaaaaaaattgagctcaaaagaaacaagtaggatacaagaaagaatagtcaacaaagacatttgtaaacgtgggtaaatctaaataagcactctctgtagaaatcaacaaacataatgaataatttaagaatacaaacacaaggtgaaataaaaatcctggaaagcaatataattaagagggagggttattattttaagatttattcaagaaaagaatagagagcttgtttaattttaaatttaaagtcagtatgttcaaaagttaagaggacatgctaaaggttaaaaatagaatgtataatttccaaacaaaagtgtcaggtgggaggaggggtagaaaaagtcaatgaataaaacaaaataaatagaaaatataaaattacatggtagaaataaatacaaatatattaatcacaagaactataactagtataaatctattggttaatagagaatctcagattagattatgaaaaaaacaggccaggtgtggtggttcatgcctgtaattctagcaccttgggcggccgaggcgggtagatactttaagctcaggagttggagaccagcctggccaacatggcgaaaccctgtttctactaaaaataaaaaaattaaccaggtgtggtggcacacatctgtaatcccagctacttgggaggctgaggcacgagaatcacatgaacccaggagccggaggttgcagtgaaccaagatcgtgccactgcactccagcctacgtgacagagtgagactgtctcaaaagaaaaaaaaatttttttttgaaaaaacacatacggctatgtgcttttcaagagactcaccaaaaatatatggatatgaaagagagagatatgcaggctaaatgatattggttaaactgaatcaaattgaattgaactagcaaatacctttctctgcacatactcaggtgtttcctggtggtaggattatccaggtatgaagctaaacatattacgtgagttatatcacttaatgtatgtagtaaggagaagaaaatcctggggtggtagcttcctttgctctgagtcatttggtaggtaacatattgaaactacttctgttagcaagttttcattatttactggcaccacaccttccttgctcatagtttctctgactgtacatccttgaacgagcatgaaataacccaataagtcttcgtgttgctgagtagttttcatacactatctagggtgttatgcagagcgtgtttagtggggtcagataaagatcagaggtccaagactggggcttcctatagtgagaaggggagttaggataaaggttttgtccaaaaaaagcccccactctgcagccccatctcaaaggatgaagtgccaaactcagtgtccccaacacccagacccttgggctatcccttgagggccagttctggcccatggatacgatagcctagtttctgtttcctgctggtgcctagcctgaaacttacctgtgttctcttctctgctccctcctgctgcagaagatggggtccctcgcacggcacggtccatgtccctcacgctgggaaaggtatgcatgttcaaggaataccagggctcctggaaggagtatgacagaagtttccatggtcacccaaacaatcattcattctgggatccatggatgccagagaatctctgaacagagtttctattcggctttccacactctcaagtttagcctctgacatcttacctttcttgctcatggtttccttaactatgtatacatcccttaaatgaacatgaagtgatcataagccttcatattgctacaggcagcttgaatacagtctccagggtgttacccagagactgtggggtcatttccattctgtatctccaagatctcataagctaaaatagaacagattgagcgttcactcaccaacaacagaaaatttgggtcaactttggccactctctccacaccaattctatcattgctactgcaaaaccaaaatatccagtgaatgccattacagcattagaaatgaggaggctttttcccagcccttctgaactatggctattgctacctccaagacagtgagcctggtcacttctcttcctgcagaatatgcctcgccggagggtcagcgttgctgtggttcctaagtttaatgccctgaatctgcctggccaaactcccagctcatcatccattccctccttaccagccttggtaagtatgacgatgtctgcctcccagcacagaatagtagaataacctttccttcgtactcagtcctagggcagggagggtgaccaaatgggggcagggtcaacaaggagaggaaatttccagaatagaatctgagtgataggctcaaaaactcaatatacaccaggctgcatgtattctactactctgggaagtcccactgccctcagcatggtgttggcagctcagcgttctttgcaaatgataactctttttgtgcttacaccacaatctgccaaggtggttacaatttttttctactctgcagtgggcttaagtagctgaagtttgtaatgtgtgataggtggtagaacagctttgaaccctaggttctctgattccacagcctgagttcttcaacccattgttctcctgcctcagttcattgtagcattgttcataataatgaaaagtgggaaacaactccatgttcactaataagagattggttaagcaaatggatattcctataaggggtttctgtagaattatccataatttattatgaatcaaaagcaagtaaaatagaatatacaaaacctagtgtataaacagtataattctgttttgtactttttaaaagagtgtgtttctgtgtgtagacatagaaatttctggtagaagatatgtgaaacagctaataatggttatctctaggcaatggtaaaatagttcatttttattttcttcctgatgcctttttatatttctataataagaatgtattggtaataatcaggaaaaatacatttccatttcttttagacaaagacgtttggatataacaaaatattttctgtatcccaggcctttgtgcatctggctaattctctctaattctttcttcagtggtttctctatcccctgcctatgactagcactaccctataaggaaacaatctgattgtgtaagcaactggaaattcaagctctatgtaataccaatgagtggtattcactgcttcctgcctcaagcatttcagtcgtctatgaaatcaacctaaattcccaaattacccactaaaataaaacaacctgaaaaaaatgtttaagaatgttggagaggactggttagtgtattttaacagatctatttcccatactttgcctaaaagcataaatttattttccaaatatatattcctttagactaggggttggcaatcagggccatagattaaaaaccacacagggtacttttaaaccattattcccccaggccccacaccaagattctggagtggatcgatacttttttaaaacctcccccaggtgattctaatgtgcagccaacattgagaaccattacttaaaccaaatccattgcaacaacacaacctggaaatcctggggaacgtattgtaaagaaatttctgatggtttgagctttcagtagtgatttgcatctcctgagaattgtacctggagctatgtctctagggacagtgatgggcttgtgtgaatctattgtaaggagcctgagacctgcatttgtaggaggcccactggtgttcagtcacagttgctaaacgggacagagaaaaactgatggctcctctccagaatggagcctcaagatgtaaactttcctcttcacttaaggaaacttagcagaggtgaaggaaaaggaggaagctgcatgtgccctagaggaaaggaggacagggaaggcctgagggaaagggccaagtcctgggctcagatgaagattggaaagtgggggcatggaggaaagaggagaagcagcagccccgctcccagcatcatcagaaatccagcagctctggcttcttccttccatagcgcatcctcaattctctgtcttctgtttttcactcagtcggaatcacccaatgggaaaggcagcctacctgtcacttcagcactgcctgcacttttggaaaagtaagtttgtcgattttcctcttggcttcagggatctctcaggaaattttccccattttactttccttcctcccatttttatccccaaaatgcagtggaaagcaaattaagttttaagggaaatgaatgggagtctgaaacccacaaagatttcagaacctgtttgcaaaattcttgaaccaggaagatgccctgagtgaggccaagtgtacccaatcttagagagcccagagaaggctggagccttctctgccaattgggattccttgggctacagacaaaataaagccccaactcaatgggacttaattaagtccagaggtagagctgctcctggtatggcacagcagggctctagctcagcgagtctacaacttccttgcctctggccacattgtatgttaacttcatcatcaggattgtggcaaatggctggtagttcctgggatcccctccagacaggacaatacctagaggaagaaagggactgtttcttgccatgttcctttcttaggaataaacccagaagcctttcaccagtcttctctattatctcattgacaaatctggaaggaagtccctttctaaaagaatcactttgggaaagggattgtcattatgggattaaactattccctggggttggtgagagggtcagcttcccataaagcaaaatgactccatgaagaagagtaaattcctgaacagaatcatgttgctgttaggaagtaggaaggaaaatgcatattggattagcagccagcagtttctgtgattttctaggcatctatgcaatttgcagatcttttcatcctcagccagagtaaggcaggctgtttctatgcactcagaggattttatagcttacttttcaaattctttcatttgcttgctgaaaaacatctggatcacacctgctgcctctcagaattttccccttgtgtcttttctcacttggtaaaacatataccttattcttccttcttccttgcctcaagacagctttagtcctttgtttttctttgctgttagaaaagttttgctatctggcagggaacctgtatgttgggacccttttcagtacagacaagctcccatctccagactcagcctgcctcctacatctgtcattctgtatagccaccagcttatcacccagtgatttgttagtcttgaagtttgcccagcatttcgtctctttgccacctcacccccataagctcacaggtccttcgtgttatagagggtctcttggggtctctctctctgtcttttcttgatcactacagggaaattgtcaagaggcaacacaaccaccaccacatggaagtaaccgagtttacagaaacttaccaagtccctagagtcatagtacctcatccagggtctctgaatctctccagaaatggtcacctcatgctctgactgagaaacccactaaaattctccctgccaaccttccctttgggtgcacagatccctacttcagagaaccctcaactctagcccctttcccaactctaggcctgcagagccactcaaggcagaagatctcttcaacagactcttaatcatgacagagagggcctgaactctgtagaacttatgccaggccagttgagcacttctgtccaaggcagtggggatcatgaaaacatgaattatccttggtaagggaaactgaggtacaaaattgaagacaataagcagcagccccaaattaggagtgtcaatgggtgacgatcaatagtggcatcacctttccagtgctttatagaacctggagagatatggacagagtggggattaaggcaagtcaagcacactggggctgactcgccagttgggaatatacccatgtaagaatggttgcaaagaggtgagggcatctttagaggaagaggggttcaggatgaacaacagcttccccttctggatttctcaaagatgttaagtgatttccatttaaaactggaaacatggccaggcacggtggctcacacctgtgatcccagcagtttgggaggctgaggcgggtggttcatgaggtcaggagttcaagaccgcctggccaagatggtgaaaccctgtctctactaaaaatacaaataaataaataaataaatataaagtggaaaatttacttgattcccaacagactaacaatgagacaatatatgagtaaaagtgaattcgtatcttctgtcctatacacaaatacagtcaattctaactgccctatccatatcgtgaaagagaaataatgtgttatagtttaatatacattgctttggagactgttgtattcagctttgtgttaaaatgatttcacctttcctaagcatacagtgacaaagcaggaagggcactggctaagcaaaggataagatcaaataccctgtggctagttcacaggaagatacttgagagctggttacactgcttcatgagatttcagagaatgctgagccttgttcttggaggtcatttcgtaatgaactgctcttcactcaccaagggcctagaaacctgtagacttaaacatatgggtggagagtgatatttaaagttagtcctgaagatgaagagaaaacaaagctcaagagcagttccacaagtagaaatggctatgtaattgtagtcttttgttctttcattccttcagcaattaatcaccaagggccaggcacatagaatgtactcaaggagcttgcagtctagcgggaaagacagatgggaagcagcctattataatacaacatgatgggtgggatcgtaaggaagtgtaggttgctaagggaatgatgcacagaaaatgagcacctaacctgattttggtgtaaggttgggggaactggggaagtggggggaagagagagcttagaaaatgattccccttggctgggcagtggctcacgcctgtaaccccagcactttgggaggccaaggcaagtggatgacttgagctcaagagttgaagaccagcctgggcaatataacgaaagccccatctctacaaaaaatataaaaattagccaggcgtggtggcgtccacctgtagtcccagctactcaggaggctgaggtgggaggatggcttgaccccagccgggagaagtttcagtgagctgagattgcaccactgcactgcagcctggagcctgagcgacagaaccagaccctgtctcaaaaaacaaaaaaaaaaaagtttccctctaggaacttacttttaaagtaaaaatctaaagggtacataatcaactaggtgaacaggaggttaacaacattccaggctttgtccatgtgacaaagtatggagtattcaaggaatgatgataatgataacgatgacaatggtaattactgttgactatttacagcactgatgacaatggtaattactgttaactatttactgcactgatgacaatggtaattactgttaactactgcactgatgacaatggtaattactgttaactatttgctgcacctcgctgtatgccaagtgctttgctaattgctttgtattaataatctcagttaatcctcacagtaattccatgaggtaggtgtactattaatatctctgttttatagatgaggaaactgaagctcagagaaatcgtcacttgcctgaggttacacagctggtagatagcagagcacatgcccttacccttttaatagaccgcccaactggaagaacaaaacgaagttcagtgtgaccatagagaagaggatgaatttaagagctatttttgaaagagcatggtgaccggttgggcatggagtggagaacagagtcggggtgagagacagggtgtgtgtggaaccgttcacagagcgatcagcaaaaccaggatgtagatgatgcacagggttagtgtcaaaaaggggttattatgttaatgtatcacagagcaattttaactctgaatctctaaaaataaccatgtttctatactcttgaagcacccagggtaaattccttaaagatttcacaggacactaaatttgtacagtaagcaactcccctttgctgatggtatcttggagtgaattcctccctcccgccacccaccccaataaacttgtggcggaccccaggtatctagaactgagtaacacggagtaaggaagcttgggttccctgggctgggcttgtcagagggaaccatggcagtgggggtgacttggaaatattgctgagcccaagaagatatgccgatcacaaaggatagtagccactttcaaatattgtttaccatgtgggaaaagttgaatctaatatacctgcctgtccaaaaatatattttgactaaatagttcttcacattactgagagctgagcacaatgacaaacatttttgacctggtgcacgtgtgagaataatgagcctcattttcatgaatcatcccagaaagaaagcacataggatttcaggcaggggacagatgccaagatccatgagccttcgggccagaaatccctagggtgggcacaggctgtgctcagctccagtttatagccatgattacagattcgtttagtccaacccaaacactgggttctcaggaaataaccatttacagagaggacttgtgccttttacaacattcctagtagggactggataagtcatagtgaaaccgatgcaacttgacaggcacttaaaggcacctactgtatgccaggcactattctgacccaaacacagtccttcttcctgtgatgacagtcatatgcaggtatctaaaacatacatcaatgcctccctgtgagtcatgctgtcacagaggtgcggtggcagcataaagggagagagagggccaggtgcggtggctcatgcctgtaaccccagcactttgggaggccgaggcaggtggatcacttgaggccaggagttcgagaccagcctggccaacatggtgaaaccccatttctactaaaaatgcaaatattagccaggcgtgatggtgcacgcctgtaatctcagctacttgggaggctgaggcaggagaatcgcttgaacctgggaggtggaggttgcagtgtgcccagatcatgccactgcactccagcctgagtgacagagcgggaccctgtctcaaggaaaaaaaaaaaaaaaggagagatcaactttaaccagagggtgtgggggaggggagaacaccagcaaaggtttcacagaggagaaggcatttgagcttagtcttaaagatgcttagagagaaacttccagatagttagagaagatatttaggaaactacaagctcagtttagaggtcaggagagaacagcaaacattttacatgttgtgtttcccccacttgccaccctacccacaacccctccactcccccctacccaccctccacacacacacacagtaaacaaaggccctcccagccacttacactgtagacaagcagccttgaaaagaggggcagcatggaagccatggtccagcctgagggcaggaagggcttcactcagcagagtgaaaggaagagacttctgttgaaagaaaggcagggggattcatggagggcttctattgaaagaaaggtgggggttcatggagggcttctattgaaagaaaggtgggggttcatggaaggcttctattgaaagaaaagcgggggttcatggagggctggaaagtccatcttgacacacaggtagaagaccaaggtgagagtcccagcaccaataacgtgaatttaggcaagtcacttaatcaacctgagcttgggtttcttatctgtgaaatgggataataccccacctaggtggcagatagtgcagtcagaagaatgggcacatatcagactgcacagggtaaaatttgagctctaccacacactggttgtatgatcttgggctggtcccgagatcatacacattctctcacttgatctttccaatgataagaagagctaaaagttaacttacttatcaggctctgttctaacatctcatttaaggctcacaaatgacccaagaaggtattactgttctctgtttgacagatatgaaatcacttgaaatgcgattctcatgcctcagcctactttttgagccttggnnnnnnnnnnnnnnnnnnnncatctgtcaaacagagaacactaataccttcttgggtcatttgtgagccttaaatgagatgttagaccacagcctgatacatataagttaatgtttagctcttcttatcattggaaagatcaagtgagagaatgtatatgagagccctataggggagctgaaatgaacagaagatctgcatgtaaaagagtcgatgaaatgggcttcctggccctgctagggaaaagttttcctctctagagatcagtgacccaaggacaatgagagctttgtttacagtcacttatctgcaaaattctaaggtgcataatgtgtgatgacacacaatagacatgcacctgagaaagttcctaaagccattttatgaaaatgtaatgttaatttaccataccttaaattagttcacatttagggttcctctgactctgaagtgtctcagtaatatataacaagctctcccttgatgatataaataattgcctggattttttatgagtcatatttggaggtagctcagattgctcccaaaatgtaccaatacatttactatataacaataataatagcagatataatttgttgagtgccatattccagaaagtttattgacatttcttcattaattcttacacctccaccatcaggtatgtattactatccccattgtacagttgaggaatctgaagttcaggaagattaaataatttgcatgttttggagctggtatttgaatccaagtttgcctcaggcgagttcttttcctttatactacactgtcctccttcacgcatgcttaacattaaggaacctctaaggctgacagttgtatataaatcaaaagtctgataccaatatctcatttcatatatatatatatatatatatatatatatatatatatttcatgaaagaattactttccctgcccttggctgtagctatgtttttctcctcttgctccagtcgtttggataaataggaaactgcacattaggccaaggtcacatggaagggagtggataatgtaatttgcaaaaggagaaatgttatgaacagctggtatttttagagcgttatctttcttgttcacaatgggttgtggtttccagcctgactaaatgtaaattttaaaaggtctgaggaaaactaagagatgggaaactgatgccaagaatgaggagaagatacaaggctcactcataaaccctgtctgagagttcagggagggtggcagctgtgatctttcagagtcctggctggaaagctctgctcacagtgttgccttgttggaggactcctccatgacgacattgctcccattgggaatcaggacatgaaggtgggctgcaggatttctagggaaagcatagccatctggatacttcctttaaacttgtgatcccatacctgcaatgatctcccagcacctcccagccatcttaccaagatgttctagtatgtctgttttccttctttctcatataactcttttacacccctcctctctccacagaccttcctagacccctctacctctcactctcagcagatgaccttgccttccactttatagagaatacctaagctacattcccataggagccctctcactttccttcaccagatctccagcccaacaacttcatcatcatcttacctttgttacaaacaaggagagattctctagttttccaaggtctgtccctatttccttttgcaaagactgagttccttcgggcatccctttctctcatcctctactggatcatttctacctacattcaaatgtgcatcctcccttgacctacttcagctgcacactccctccaacacacccctctactctccttcctactcgaattgctgtgtctgtggcttcccctttccaacctccccttctttactttaaacctgtgcttggctcccaacattacacagaggctcctgttgacctctgtattatcaaatctaatagtcaccttgtctgcacgcttcaaactcagaagtgtgtggcactgtttactcttccgccttgatgagctcttgtctcctggctcccaagactccacctgctcctaggtttcctcttacctctctggctgctacttctcagccttctctgaagatgccttcttttccacctgagacaagtgtggagttcctcatgacttggtcctgggtcctcctcttgtctttcttcatattatctccctaagcaatcttgtctatccccgtggctttaaataacatttatgttctgatgacaccaaatgaatatctccagctaaaacttccctgactcactttggtgaattcaactgtctacttgacatctccctttggatacctcacaggcattgcaaatgtctcttgtccaaaagttaactcctgccacactgcctctttttaagttctcaaacaactcagcaccttttgtgtctcagagtctttacataacccgcattctcttcctggaatgatctctcctctgcttttttactgagttttgctttgtcatccaggctggagtgcagtggtgcgatctcagctcactgcaacctctgcctccaggctcaagcgattctcttgcctcagcctcctgagtacctgggattacaggtgtgtgccaccacacctggctaatttttgtatttttagtagagatggggtttcaccatgttggccaggctggtctcgaactcctgatctcaggtgatccgcccgccttggcctcccaaagtgctgggattacaagcatgagccaccacacccaaccctctcctctgctattaatacatctgacttctcatccttcaggcctgtgcttcaacttcagcacctcagagaggccttttctaactattcactctaaacacattctctccttgttattttctgtcactgtacagaatttctttcataaaagttattatttgtaattaatcacatattttttctttccttttttggggcttttccttctgctaagttccatgttggtaaaaaccatttctttattttctaatgtgcccccagcacattacaatgtgcctgtggcttagtcatgctgagtggatatttgaaaagatgagtgggggtcttcaggtgaaagatagacaacaggaatggaatgaccttaaacgtgctggtctgcccccattttcctcatctcagcgctgtagatcacccattacagcatctcctggaataagaataaacgccagtttgggagcatgaggagaaggggagctggtgaggtatttaatgggctggggaaaattcatggactaggacctttataaaatcttgtctcagggtagaaggattgggaaaaaatctgaaagttactgaaaaagcctgagtttcctcactcctaatcaggaatcgggccaaaaacatggttttgtttttaggcctccacctttttctgaaatgatgccctgtacttccctcttctcactagtggaaagacaaatggggacccagattgtgaagcctctgctcctgcgctgaccctgagctgcctggaggagcttagtcaggagaccaaggccaggatggaggaagaagcctacagcaaggggtgagtcagacctcagccaccccaagggcacctggcagttctcagaagatgccttcccatgggtctttcttgtttcttagaggctttagggaagtaaccagtggccgcaggacctccttgccacaggaaggaactacataggaaagagcaagactgttccacaggaaggacaggaggaagcagggtcagagggtgtggttagacaataacaagactgccctctttttaggcagagagccaccagaatgccaccgctcagaatagtctggaaatcaggggtcctggatgggttcctcttggtggtgcctgaggcttcctgacacgtgctcaaagcagtcatgttgctgccagcagtgcccaggagcagctgcagctctgctccctagaactgctttggtcactccttcctcctataaatggagtctcttcaacttcgaactgcctcctcctccatttgagcttcaatagcacccatggccagttgtcagcactggagagaccaagtcctgagcaggtaccaagcctcaaggtagagaatcacctccaaccatgtatggtgccctatgcgtctcctgtctccatagctcatgaggaagacatagcttcccactggcacagaacccatgggcttcagtggtgggtttgcccagccaaactgctagtgttagacactcagcataggacaagtgaacagagtatgtttggggtaatattgaccctgggggagaaaaaccacaagggtttctctttgaaagcgtgcctttctcacccaccactgtgctctatccttggaatttatgggcatgaactccttcattggtttcgtaaacatttactgagtacctctctagatcaagccatgtgcctggcacttgcaaaaatcattccaacgccctgtgaaatgagtgtcaccctctctcttttacagatgagaggctgaagctccacggtcacatggagaacaaatacaatcttagccctacggaatgttttgtgggttaagaacccagtcaggagaccctgcaccacattttttccctgtcagttttgtcacactttcacataaacaggaaggatgactgaggagtgaggggaaatggtactggcgtgagctgccttaggattcagtggagcttcccagctttttcctgttttgtggaaccataggaagcacataattattggaggtgctgctcaagtcccctcccctaggaactcaggaaaggatgcactgcatctgccctttccagactcaactgttcctttttgccccccagattccaagaaggtctaaagaagaccaaagaacttcaagacctgaaggaggaggaggaagaacagaagagtgagagtcctgaggaacctgaagaggtagaagaaactgaggaagaggaaaagggcccaagaagcaggtgggaagcctgtgtttggagtccttgccgttgctgaaatgggggttacaattcatctaatttaaatgcacaaaatccctggaaatgccagtccagggcagcagtgaatctggggccccagtgagtagcccaagaaaccaagagggcacacatgttgggaaggaggtagaggaaatcccaaagagccaagatagctagcaatgagaagtttgcaagagcttgagaggtcaggggcagtcatgggaagggaggatggcaatcaagagctccaggagctaaggaagggcgaagggccctgaatggagtccctcccagcccagccatggttagctcatttcccagatgaaattatgggtagccatccccatgaagaggcccaagacaaagagagttgactcgaagccctggagtgagtttcttacaagaacagggacagggaggacacacggaatagagggcaaactcagctcagtggcaaaggtgagtctccagcaggtgcctaccatgctgaccaatcaagcttggtcttcactttaggttggaaatacttggggttttcttttaaaatacttcctatttcaaaggtactttcccctaagttggggaaggagaatataacatgtagataaagagaatatagacctgtatcttgtcccacttgtggttcctgcctggcctttaggatgcagaatcgtagaaatgacctaatttagttccagggcactccatgcaatgaagtattataggaatgaggtctcagccccacctggcctgaattatcccctagaagttcacgcttagggataggataaactagcacccatagatgaggtgtactctaccccacagatataataaccatgccaacattctggattttcaggacagcccaatttcatatattcagctatgttgtctctattagtatagttaaaccacaagtcttgaattttgattttttaaaatgtagtaatagccaccttggaaaaccttcaccaaaatctatttttagacccctgggatatcttggggtccagggcagctccagacaaaatatctaatcagctgctgaaatattatctaatctgggtatgtatctgtgcctcattgctggaaaactctggaaaccacatgcatgcaacaaataggtaatgaagtgaagattagaagcaaaatggataggcacacaggagctatcaatagagcccagttggtggagaattcaactaaagtcagaggtctcagcccatgctggtcgaccccattgttcaggggaagagccgttaggagaactggagaaatgcttctccactgaaaacaaatcacacactgtctccccagtgaaagaacctccaagtttaacaattaaagtgcaatccctactccaagcaaccagatcctgttctccttaggcctcatctccctcctgagggttctctgctgatatttctcagtccaccacattgccttcctcccctttaatgcagtcaagcaaagccctagacaaaaagcctttcctctggcacccgtgaatacagcagagacagactggaacttctaacacttccaaacactgagaaagaacaaaagagaaataaacagagagagagtacatggaatataaacagtctggtttgcaaagcaaggggctcaatgtcttatctagctaattcaatctcaggcaattgtcagctccctcccatttcatgaaaccccaggggaagtaaggcttagcttggttcctttctgtccagctcctggtcatcagtgagtggcaatggtgcctgtaacatttatcatgcacctgctctcaaacatgatttcttccctgaaatgttggtgcctcactaacaagcaaggtttgaggttattaagagttccatgtcctacttattgcatttttaaaacactgggttcagcccagctgctgatcgcttaagagattcaacatcacacattaaagtatttttgtctgagtcacgtatctgttatatataacaattatgttacaaatattgctctcttgaggatcagtttaaataaactttgggtaaaccccaatattttaaccatattaaaacagaaagcacagtcttctgacattgaacaagtgagactcataagggacaagataaaacttttgtcttttctcctaacggctgttcaaaccagttctatggggttaagaggacatttaggttcctttacttttccaataactctcaggaaacagaagtttacttattataaccaaaaattgacttctaaagaaattctatttctaatctatttctaaactcttttataggccaggcatgggtgaccagctaaggtcacacagacagatcttggtctcttcctccagagccacacttaagagtggggttagagtagggagaagccactctggcaccttgttttggaggatggaaatacagccccaaaggctccattttagcatccaactctgtctaaatagaatctagagaatctacaaagggctgagagaaaataaccttctacttctaaaccctgccttcccaacagttgtgaaaatagtcaatgattttcaaatcagcgaatgtgttcactttcgtgctttccttaattgtgactgaaatgatctgatggggttcccgcatggaacggaaacctgtcaatgttctctgtggccctagcatccaaggcaggcattctgagcatctggtccctttctaaggagggcatttattgagtctgtcaatcctttgttagtcatgcattttctgctacctcaaaatttgagctctccgcttctcagccaatggcttggtcattgctgtgtgtgtatgagcctcaggatcttcagaaagcacttctatcactttccccacctccttggttcaggaatcctcagtattctcatttttcatattattttttaaattgggttagaggttaaaaacatcaggaaatcctggcttaatgaaggggctcagggcttcttcagagagctctagaatgaacttgtcaaagcaggccatctgcccggtgtctttttaccacaccacagagagagagagaggacaaaatgaaagacagttgggaaggaatcaagagggaaaaggggcaaaaatggagaggaagagagagatgaaagggatagagaaagaagtgtggagagagtgaaggaagaagaggaggaagagggagaaattagagaataaatattaatgaggttgagataacatcatgaacaaaccacccagacattgctagaggcttctaatcttctgcctgctcttggatggtttgaagtgaactcttgaggttgatctagtcccttgtcatttatcactggatatcaagctgcttagagtttagcacagtccttctactctggacacagttagatgtggaactgagaacaatgaattacgcatctgaggcaaggcacaggttagagcttggaactgatcattaatgcagctaggtgctaaaaagatgcatggccaaccaatcctgtacccccgggcttgggagagtgcagatatcagtaatcaccccgtgaatagatgagggcatgtatggatggatgatcaaacaattaagtagaatgatctagataagtagctctcaacttcaaggctgtggactggtggaatcaaaatcacctgggaaaatttagccaatgattcctggaccataactttggatattctcatttagtatgcttggggtattttgaacaattgctgccaacccaatctaggcacagctaagtttgagaactattgctcaagacagcatggaagctatccgcagagagaactgtgggtctgtgtatcatatgtgtgcccagtatactaaagcctctgcatattttttttcattgacagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacat

SEQ ID NO: 13638 - DNA, 15950 bp, Human
atttaagtgagagaaaggtaattgaaagattgttttatcaatatttttactttttctaccttaggttattcccttccaggtcaatttctcacataaactcatatctgcaaagcccataccaaaagggttcccaattagcaaagattaaataaaatattaagtaaaaccttttttaaatttttaattactgaattttaagtgtcttaattataagaacatccgacttttacggctaggtgaatattctctttgaagtctagacaatagtttttgaatactactcttcttagtaaactaatgtattcgttcattatcagataaatggaatgtaaaccagttatgtaaaaatatcacatatactaatgcatttttccaaaccttaaagccctacagaaattataaagaaacattattctcgtgttatcatgaagctagaagggtccaaagaaatacaaagtgaaacctcttgtatttaaaacaaaacttgcaccaccaccaccaccccaaaatagttttttttttttttttagaatatctcttccaagttttaaagttcaagtaaaattgatgtaatagcaataagtgtagtaacagtaaagtagggaatggtgactattctatagcaaagatctacagatgttggaattgtgttagaaaccttcagagccacaccacagccttctattacatttaaatgtcgtacgaaaaactgcaattttccggaaaattgtattaaggaccaggtgctctaataccaagagctgttttgacacatcaaaggttaagtttgggtctttgaaaatcctgcctcttactgaacactttaaaagtcattcatgttaaaacacacacattcttgcctttgactatacactgtaaaagtactacatgttaaaatggagatggggacatttttgttgtttaagtttatggaagtatgactccattttagtatagctacaatgtcgcaaacgatggaataaggtactcatcaatacattacctggtaagtataaatagttcaacttgccggctttgaaaagcttaatcctatttcttatggtgaaccttaaataaaatgaaaatacacaactgacaatgtttaacgtgcacttaaacaaacaaaaaacaaaaaaaaacaggagctagcaattcgaaatcctccaaacacccgcggaagtctgacacacagggtgttttcctcggtgaccgccagccggacattcctatgggaaaagcagcttcttctgtgcggttcgaagaaaatcaaccccttcctttcatcactttctcattcactctgcagggggtgggccaataaggagctgaatgaagctcccctttggcatccgggcgcacgtctcgcctcctccccactactttctgggttccctaaggctgccgaagccgaggacctggagccgggtagtgtcccggcgctgcgcccgggggctccaggcctcaacccgaagggcccagccccgggagaggccaggcacgcgagggcagccacagctccaaggggcgccaagaaaagcaatgctcactcgccacgcacagggttcgggggaggtaagggtgcgttttcttcccatattcccggtgagaaaacgaggtcgagggaaaaggggatgatacaactggagcatggcatatggactcagtgaacaaagggactggagcaagaagcagcagccacgccaacgcagactcaaaagggctctccggctttacgcacgcaaccctcatctcgacagcgctcggcgccccttacgccactggctcagcctcagagacttcgcgaatatggctttgcgcactgcggcggggctgcgccgcaaccgagctcagccctgtggctcctcctcgctgccctgcgcggattggtggcagacggcaaccgggccgctgattgggcggcgaaggagccattcggggagactctggtgggttcggctgccccaagagtgataagttcggcttcagacacgccttagcgccagcagtgagtcggagctctatggaggtggcagcgggtaccgagtggcggctgcagcagcgactcctctgagctgagtttgaggccgtccccgactccttcctcccccttccctcccccttttttttgttttccgttcccctttcccctcccttccctatccccgacgaccggatcctgaggaggcagctgcggtggcagctgctgagttctcggtgaaggtgagttgagccgctgccgccgccgagtggagcgctctaaaatggccgccgtccctggtcgcttcttctcgagtggtacaaaatggcggccgcaggcggagccgggtggggcgacccttttttagcatttcctctgcgcttcagatacctggaaagtcttggcttttgttctctcttcctgttgctgacggagtagaaggaaaacgtcagtgttggccaggccgccgtgcggtcatggccggatggccgacgcctgcagggacgaggccgtggcggaccgaggcacggctgtgctcggacggcgagggagcgtggctcggaccgctagcgccgtggcgggaggcacgcgggccggcagggaaggccaggccgttggcgcgggaccagggaaccgcaggcgtcccggagcctggcctcccggcggggaggtgtgtaggacctggagtcggcaggggctgcccttcgtcggggaggaaagagagagtgatgatttctgccccttttgtcagcagaggaggccgtggcgaggcggttgtcagtcccggggggatttatggtgcaggagggggcccgcttggaggcggcgggtgggcaggaggccgccttcctgcttggagaacaaagagctgggcgccgggctggcgggggtggcctcagctgctcctccccgtcgagcgacccgggcctcgcggggaggttgtcggaagcacttccctaacttgcgcctgggtgggaggaatgctccgctcttttgttcccaggaagggaaaaacggggcggaggttcctgctgccatgttgtggccctggtcttccgcctgcaagtgctagtcctgtacacccggccccctctcgcgcgtctttccacgagctctccacggggaggaggcgaaagggtggacaggggaaaactgctgaagagctttcggagagacctcatctagtcgctggcctcgtcaaggcagtaaaaattcctagggcagacattttccacgtgatgttgctcgtgtctgtagttagacttttctattgatctcagtgctcagttttaaagatagtagaatgtggctttttcaaaagattcgttctgagccgtttaaaatgctcttgtgttctacgaagtctctttgcatccttgaacaccggggaatttccaggtggctaaacaaaatgtaattgtcagtgttttgagtacattttaggttagtcttacagatctgcaatgcagtgacagtgccaggatctgaaatacgttgtaattgaatgaaggcttatagatctgtatgttagcagtgtctaattttggtgctctttctcgttccaggtatttcatttctcctgtcccctcccctccccaccccatctattaatattattcttttgaagattcttcgttgtcaagccgccaaagtggagagtgcgattgcagaagggggtgcttctcgtttcaggtacttgtagatttattttggggaatccttttgaaaaggccagtctcaaaaagtagttaacacagcaaataagtccgacttaatgggctgcaattttcatttgaaaagttcttaagttttcattgacagccttctaagaactgccatctgaagaataaataaaatcaattatttgcctttcctttgggtccgagttcagtcttcatttgtagcataatatacaagcactaaaatacaggcctggctccagtctgggcaaaatagcgagacccccatctctacaagcaaagcaaaacacaaaatagatgctttattctttttgagtgagacatagttgggatacagtaaacaatttttttcttttaaatagtgcttcttcgggcggaggaggaagtaggggtgcacctcagcactatcccaagactgctggcaacaggtgtgttaaacatgtaaaaaaacagtgagctttatttaacagattaaaagtctttcccatgtgacggtataattaaggcaatagccatcaagactcctaatcttaaggggcgtggtttctgttgggtatcctaaatacagaatatcagttcctgattattccttagccaaattttctaagtgagttgagactctcaagctgttatttttttccttattctttgggttatttttactaatgtgtttttctgaaatcagtagctattattcctactgattgttattagtaaagtagtacgcactcaacatggtcaataaaacattagaaagtgtttattggcagccggtacagtggctcacacctgtaatcccaacaacaactttgggaggcaaaggtgggagggtcgcttgaacccaggagtttgagatcagcctgggcaagacagcaagaccccatctcttaaaaaaaatgttaattttcaaaatgtggttccacagcgttgatactgggaatatttactagacatgcaaattcttaggccccaccccaaaccagtgaaagcagaaactgggtgggcccagcaatctgtattaacaagcccttcaggtgattctgatgcacactactgttccagaagcactaatttccagagttggctttcttggaggggaagtcgagaaagcctaaattacttttttctatgtaagagaatttatgatgtttaacatttggtgtgtgacaataagtgtttttgctgatttttattaatcagcgagttcctggggaaaaccccagggcaaaacgctcagaaatggattcctgcacgaagcactagacgagatgacaactccgcagcaaacaactccgcaaacgaaaaagaacgacatgatgcaatcttcaggaaagtaagagggtaagtttcaaggtctgttttactaaaagatgggaggtgtggattagctgtgtttggtgtgtgtgctgtattactaagaaggcaaggttcatgcccagagtatgtatgttttaatgaatcctcatggtagcaatttttaaaaatatcttgaactggccaggcactgtggctcacgcctgtaatcccagcactttgggaggccgaggtgggcagatcacttgaggtcaggagtttgagaccagcctggccaacatgttgaaaccccatctctactaaaaatacaaaaattagccggacgtagtggcaggcacctgtagtcccagctactagagaggctgaggcaggagaatcacttgaataccccacaggtggaggttgcagtgagccgagatcacgccactgcactccagcctgggtgcagagcaagactgtgtctcaaaaaaaaaaaaatgtatcttgaactgaagaacagcacgtcatattttggggcttcccgttgctttcagccattggattgcaatccataatcctgtcgtgctagcatttcccttgactaagggaagtgctatgttatttaagccagtgaggcagggaatataatggtcttagttcatggtctagccttgataatgagatctttgcgctctaaccttgagaaagtgagaaaggattcttgtcaaacagctggggaccccccagtccaattcaaatcattgtaattaaaataacaggtttatttcagcatccctttggttttagatgagtaagaaaacatgtcttgattttttaaagggagcaagttagaagaaaaatcagtataatttaaaagcagtttttcaattcaaattctgtgtattagctaacacttaaaatgtaattcctttttctccagcatactaaataagcttactcctgaaaagtttgacaagctatgccttgagctcctcaatgtgggtgtagagtctaaactcatccttaaaggggtcatactgctggtaagttttaaatattggcttaactcaaaagggagagggaactgtttaacaaactcaagttgtgtttttttacacttggattactacttaaaacccttaggtgtgagttagataggtacgtatttttgaatactgatggtgattaaaaagaaccactgactttagtagcattagattgaagaggtaaatgttaagttcatggtatggttgaagaggtaaatgggagtgcttagcaagctgttctttttcttttgtggaaaacaccgtatttaggtcttggaaatgcattgtatgacagtttatgtagacttgaaagttttgatatccatggcattttctgactcccaggagatggatgtgactagatgaaatctgtataactggacatttttggtagactgtaatagctaacatttaggtggttgtatttttcctaaaggaagggttcttggagaagttttcatatttagtttaagcaatgacattttctgtagattgtggacaaagccctagaagagccaaagtatagctcactgtatgctcagctatgtctgcgattggcagaagatgcaccaaactttgatggcccagcagcagagggtcaaccaggacagaagcaaagcaccgtaagtggtagtttttgtttgcttgttttaaagttgacttgaaaaatttccttaataaagcatgacaatgtcttcttttccagacattcagacgcctcctaatttccaaattacaagatgaatttgaaaaccgaactagaaatgttgatggtaagacttatagctgataataagtactactgtatattttcagcttaattctgaatgttggcttacttcattggtatctttttcagtctatgataagcgtgaaaatcccctcctccccgaggaggaggaacagagagccattgctaagatcaagatgttgggaaacatcaaattcattggagagcttggcaagcttgatcttattcacgaatctatccttcataagtgcatcaaaacagtaagtgtgacagggaagttaggcgaatgtagtcagtcgtttggaggaaatgagtcaattattcatctaagagggaggttgactagttaaatacagatgtgcaacaaaatttactaaacagaataatttgaaatacgtggtgtgtttgacaaagtagagttagaactgatcaaccagactggtagaaagccctatactagattctgtaggaactgtgaatgagtcagtgcaaacataaagggaaagaaagtactacgcctaaaccagagtaactaaaactttgtcaccatggccttttattcttgtagcttttggaaaagaagaagagagtccaactcaaagatatgggagaggatttggagtgcctctgtcagataatgaggacagtgggacctagattagaccatgaacgagccaaggtacgtgtgtagctgatgaaagtagtacaagtagtttgtctttaaatcaagctattgatttttgtgacatcataagggattgccatatttagccattaactgggttataattttagaagtcttaaagctgtaaattgaacacatttgctttagctcttccaatgaatgtattcttctcttatcagtccttaatggatcagtactttgcccgaatgtgctccttgatgttaagtaaggaattgccagcaaggattcgtttcctgctgcaggtaatactggtttctttaaatttgttggtaagctgagtttttggtttaggaatattaaaataaaattatttttcaattaaaggataccgtagagttgcgagaacaccattgggttcctcgcaaggcttttcttgacaatggaccaaagacgatcaatcaaattcgtcaagatgcagtaaaagtaagattgggttttgttttgtttgtcacatagactttgtgtgtgtagaatagaatgggtttcctcctcacccaccccaaacgcttgaggggtctgtctcatcttagtggtggagcttaatgtttttagtgtctcgtcttccacttttatttttttattttttgagacggagtttcgcactgtcacccaggctggagtgcagtggcgcattctcgattcactgcagcctctgcctcccaggttcaagtgattctcctgcttcagcctccccagtagctgggactataggcgtgcgccaccacaccccgctaattttttgtatttttagtagagacagggttccaccatgttggccaggcttgtcttgaactcctgacctcatgcaaaccaaggcttgggcctcccaaagtcgggggattacagatgtgagccatcatgcccagccttgtctgccatttttggaagaagttatttacagaaataacataaattatggtttaatattctaggtttccccccctagttgcaagaattttagttttaagtgaaatagtgtccagagacaaaaagtgcatattcacttcatttctaaaggatctaggggtgtttattcctgctcctatggctcaagggatgagaagtgacttctttctggagggaccgttcatgccacccaggatgaaaatggatagggacccacttggaggacttgctgatatgtttggacaaatgccaggtaattttgaaaaaacaatggttgcattaagctgaaaaatcagttaactttagttttgagagttgtccgtatatgtattttaaggtagcggaattggtactggtccaggagttatccaggatagattttcacccaccatgggacgtcatcgttcaaatcaactcttcaatggccatgggggacacatcatgcctcccacacaatcgcagtttggagagatgggaggcaagtttatgaaaagccaggtaagtaatatttgagtgtttaggcaacaaatgttaaattatgcaatatatgtgatttcatttgctattaaaacatgaaactattttaggagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgaggtacatttgcctatgttacttatataccatagtttgtccattcagaaatttattgcccgatgattataaaaagacgcgttattaagaggactttatgctggagttcttgacgtttttctctcttttctatacttctttttctttctttgaatgtccagcgtcctgtgagcgaagattatgagatatgagggcaagtctcctaaagtctgttagagcaagaaaactggttgtcaaaatattgtggtttctttctttgtaagggtgatttaactaaggataaaacagggcattttctaaactgtagttaaatttgcagttttttatttgaatattttagtcatgctaattctaagagaatgtaagatttataatagtatcttactactgtatgcatcagatctttaaattttttgccaaaaattaaacctgttaatgtggagtaccttctttagtttttcaaaaagcttaatgtttccctagattctgtcactgtataggattttagaatgttgtatttaatatgttcgccaactgcatgttgttaatttagatatattttgttttcaattccagattagcctgaggcctgctcagtcgttcctaatgaataaaaatcaagtgccaaagcttcagccccagataactatgattcctcctagtgcacaaccaccacgcactcaaacaccacctctgggacaggtacagaccatagtaggacagcattttctaaagatatctgaagacttttttctaaatttagtgtgttcttccccctaatttcatagtcctctttttaaaaaaagtctgtcattgcttgttttttagacacctcagcttggtctcaaaactaatccaccacttatccaggaaaagcctgccaagaccagcaaaaagccaccaccgtcaaaggaagaactccttaaactaactgtaagtttcaaatatcccattttagtgtaattagcctgtatttgagatagagaatacattaaagatacttgtgttcttcacaggaaactgttgtgactgaatatctaaatagtggaaatgcaaatgaggctgtcaatggtgtaagagaaatgagggctcctaaacactttcttcctgagatgttaagcaaagtaatcatcctgtcactagatagaagcgatgaagataaagaaaaagcaagttctttgatcagtttactcaaacaggaagggatagccacaagtgacaacttcatgcaggtaggacactttactgattgtgtggtaagaactcttaccactcaaattcgaaaactgataaactgttgtatatttctttcaaggctttcctgaatgtattggaccagtgtcccaaactggaggttgacatccctttggtgaaatcctatttagcacagtttgcagctcgtgccatcatttcagagctggtgagcatttcagaactagctcaaccactagaaagtggcacccattttcctctcttcctactttgtcttcagcagttagctaaattacaagatcgagaatggttaacagaactttttcaacaaagcaaggtcaatatgcagaaaatgctcccaggtaagagaatgctgacttgtttgttttgtttttttaatattatatctagagatttcaggtaccttgagtggatttatgtaggtcagacagtctgattgtcctgctcagataatgataaacattaccacagatctcacctataaagagagatttataatttaactactttcatttgatccgtatgttgagtttttttcatttgctgggttggttctctattctgctacatggatcttacatacttggggacatcatttgtgaagctctgctctctggacaggacaacttggtaaaatgaactattagatgatgcaggtggctttgtctcttcagaaattgatcagaataaggaccgcatgttggagattttggaaggaaagggactgagtttcttattcccactcctcaaattggagaaggaactgttgaagcaaataaagttggatccatcccctcaaaccatatataaatggattaaagataacatctctcccaaacttcatgtagataaaggatttgtgaacatcttaatgactaggtaagacgaatggttttctgcatatggtaatgtttcatgtactagaaaagaagcgtaggagactaagagttgtctcttgagcaagaaaactcactgttgggttctaacaagacctctttctgtccagcttcttacagtacatttctagtgaagtaaacccccccagcgatgaaacagattcatcctctgctccttccaaagaacagttagagcaggaaaaacaactactactatctttcaagccagtaatgcagaaatttcttcatgatcacgttgatctacaagtcagtgccctgtatgctctccaggtgcactgctataacagcaacttcccaaaaggtgagaggacttgtatcagaagaacggcgtgaggaagttcttaaacagaacactaaataatgggcttattacttttttcttttttttttttttttttaaggcatgttacttcgcttttttgtgcacttctatgacatggaaattattgaagaagaagctttcttggcttggaaagaagatataacccaagagtttccgggaaaaggcaaggctttgttccaggtaagtcttttgttaaaaatttggtctgcttacttcagtttgcttggtattaacttcaagttaagagcctttttcaactgaaatacaggcaaggtagtcctagttagtagtttgtcttcacctgtacatttcattctgcactatttgaagctatgattaagtaaagctacacaatgaatcaattctagtggtgtataagatgttagaggtagctaacttttcaaggagtatagctacttatatacatgggagtgactgtacaagtttcgatttaagcttttttaaaaacatcagtaaagaggaaattgtagctgggcacgtggctcatgcctgtaatcctagcactttaagaggctgaggtgggaggatcacttgagctcaggagttcaagaccagcctgggcagcatagtgaaaccctgtctctaaaaaatacaaaaaattagccagacgtggtgacatgttctgtggtcctggtcccagctactcgggaggatgtcttgagcccaggaggcagaggttgcagtgagctgagatcacaccactgcactctagtctgggcaacagagtgagactgtgtctcaaaaaaagaaaaaaagtttaaatactatatatttttctaaaaagaggagatgtttctgatttctcacaatttgattttttcttattgaatgaacttgtagccctaggggaagaacatcagggcattctctcaaatcacctgaagagcagtttaaaaagcaggttccaggcctattcctagagattctggtttagtaggtctgtggtacaaaatccaggtgattctttctcatgctactagttttccagggggcccaggcttgagaaacattggtcctgcagcatcttcctacctttttattgctgatgataaacaagattcacgaggatcatccttgcaggattaaatctttagctctgtgttgtcccaaatctggataatataccactgttcgttaacttaatatacaaattgttggtagggatatccttgtttcatattctaaaactgtgtagtaccacctaaaactttttggatggatttctgtttatatcatgaactattttaatttacaaatcttaatttataggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtgatgtgtggctgtaaatggcatccatagtctgggagaattgtcagctttgtttttgaggtataggagacccaccttagtttgacttaaggacttcccaatttttgtttttctgctgtacaagcctgggttccagaaggaatttttactcttcaagatgagacacaagatttaaggtgtttatttcctttgagttactgaaactaaccaatataaacgatttttatgatcaaagatcacaagtcttatgaatttggaggaacatagctacacatagcaactaaaatttggtgacaatttatcttttgtcagactgaaatacatggtgatctctggataagcttagctgtcctgcaagcatcattcccagtagctgccccaaatgtccaggaagatccctgcttcctctggaaaaattccagtgtcccagtaaaattgacttcattcaactaaacctctgcatgttttccaaaaacacacacgaaggatttgtctccagccctggaacattctgacaatcctaggattacttctaacattggcatggatggggactcttgaagtgtgctactggagtcctggttgatgtcaacacctaagaacctgttcttggtgattggggagaccctcaaggcagactatcatactgccgaacccattagaaccttgaagtcagaagaggctgcctgcacatgctccagtgggtgggaggcagaaccaatcaatgtttttgtgtctgtcttatttgggccagggaagctaaatcttgcattatggcactcatcttcccctgaagttttaacaagtcataagcttttgggtactttgagtacagcaaaatttaaagctaaacagatttgtatgaacctacctaaattttaaaggggctgtaaattgtttctctgcccaaccctccccacgaaggggaggaaactaatttttaacctagcaaaaggagcaactggttaggtggatcagctagtcaattcttattgccagaatttgcctaattcagccagggtatcaggctaaaggaagttttagaactaaacctgggcctgggtgcagtggctcacgcctgtaatcccagcactttgggaggcctaaggcgggcggatcacctgaggtcggagttcaagaccaggctgaccaacatggagaaaccctattttcttctagaaaaatacaaagctgagtgtggtggtgcatgtctacaatcccagtgactcgggaggctgaggcaggagaatggcttgaacctgggaggcggaggttgcagtgagccgagatggcaccattgcactccagcctaggcaacaagagcgaaactccgtctcaataaaaaatgaactaaacccggtacgcagtggtttgtcattgcttacagaatcatgctttaatcttcccaccccaaacatgtcaagagctactcaaaatattcaacccatagagaatgtataatactgctgctaccttgttctaaagacacctaacagtgtactttataatctaccatactgtggaatggcagtatctgggtataactgggatgtaccttgcatgattgccaatttctttagtatcagcatgtagtgactaatcttcattcacttcatggtgacttcaaaataagattgcatgtctttactgcccccaatttttttttcctttactgcaaaattgaaagagttgtctaattttccccattctcaagcctcagtagggcttcactcccctggttccccacaccaaaactttcttagggtcaccagtaactccaatgctatatccagtaggttttgatcctcctgtaggcagcatttgacaagttactcattccttgaaagtgttaacttgttcccaggacatctttttcttctcagtttccaatgggagatgcctgatctcaacactttttcagttgttgtcatactctgcatccattctagcatcaaatcatgttgattgcattccaaacattttagaaattgaagaa

SEQ ID NO: 13639 - DNA, 253364 bp, Human
attgatagccctgaattgcaaaggttgagggatatgtgaatccattgtttgcctttgcaaataataggcagagtttcttaatgtggactagagttgctaatcttagattatccatttgagtcatgatttcctactatacaaagcaggagttgttatggggtagaagaatttttatcccaggaatgacaaagataagttgaagcactacagtaaaaaattagagttagacatggacacgtagaagggaacaacagactctacagactctaggacctacttgaggctgaagggtgggaggaggtggaagattgaaaaactacctatcaggtactgtgcttattacctggatgatgacataatctgtacatctaacccccatgacacacaatttacctatataacaaacctccaaatgtacccctgaacctaaaataaaagtttagaaaaaatgagaattagttcttggattcacaagatataaagagaagccagccattgaataccttgtttgaaagtaggttgacttcatgttttgtagcaggtctgaataatccatttgtctaattcactgtgctctataatacctattttcaaagatagtttcccaagttctgagaagtccttacatattagctgactttatactaaaatttgggtttaaaaaaatttttttttagagacgtggtctcactctgtcatacaggttaaagtgcagtggtggtgtgataatagtttactgcagcctcgaaatcctgggctcaacaaccctcccacctcagcatcctaagtagctgggactacgagtgtgtgccaccatgcctggcttaaatttttttatttttatttttatttttatttttttttggagacgtgggatttcactatgttgcacagcatggtcttgaactcctggcttcaagcaatcctcccaccttggcctcccaaatccctaggaggcacaagcatgagccattgtgctctgccctaaaatttgttttaaattaaagtttttctggtaagaatgtaatagcgtattttgacaaagggtgagaaaggcttcttctggaagcaactaatgctaattgataaaattgatatataaatgggttgtggtttccagctctcttctgggagagaaataaaagggaatctaataaagaacaatgttggtttttctctggctgctttactaacaagaaacaccatgaaacatttctctcatttctaaacatttctataaaaaagataacttatagagaacaaaatcacaatcgaccagttatttcccaaacaaattttccatttttacaatacaaagggaaagctacaagtattagctgatttagaatatttctcatctaggatgagatgtcccagatggcagagtagagagagttttggatataattgaaactctatagaattggtggcaaatgtgcacatatacacacacacacacgttcctatccaattaagcagccaaaaagtcagcaatcccattgcttctttagtttaattaaagtcactgattttccaaacccaacatttagagatcacatcagatgctactcataatgtaaggaagcatgtattatggagaggttatcctgggtgaaaggtacagcaacaactgaatagtcaaccgaaacttctatcaatgggccaagctttgggagcatcaatatataaaagtttagaattccattttgtatcctcttctcccccaaaaagaaagagcactggaaattattccttgtgtggtgtttaatagtggtagatcattttgattaaggaattaaatggattgaggtgcatgagagcaagaaagaggaggggcaagaggggggattataggataaggtgtactgctactttaaaattatgtatgcatgatcccatccaggtccctcccactgcttgaggtaccagcggaaagcttgggcagctcagttccaagagggccaccaagcagaccacgctctgagcttcaggtaaccaagtgtttgctctgcagaatactttacctgggcacccaagtcttccttccagcattcctgctgctacagcctatttgctgagtaaccaggggttacagcagcgttgccaggcaacgagggacagcggtcctgttgaagagccatttgtcacactgaggggactggttgaaatgcaataaagaaatggtaactcagcttatttatcaatacaattacttgcacagtattagggatccatgtgtaacctacaaattcatagtcatatgaggaaacacagaaacattttgctaaatattaaagcataggacagacagatggtgttgggtttctaatcagctttactctgagcttaaagttgctgcacatgctgggataaggggaaaggcccaaagtcctttgccagctttattttgggcatctgtaagttagctctgggttacaatgtacagtgcatgtgtaaagaaaatctacaagattcttttccctgttaagtagagctggtaatgccattgctaattccctggggtgaagtaacaacacaaaattattgtatgtgtaatatattattaataattatatatatataaaacacacacatatattatataaatatttatgtataactggttataaatattactggttgtcctgtggacttataaagtgcttgatttgcccaatgcaatcaagagatttaccaaaaggatgagtattttactctgagcactgtgcttcaaaatgttttttgagaagttcagtagtgttgcttctaggagctcaaagtcctcaggcctgggatgagcttcagttttaaaggtgcagcagctttcccttgacgccctacgtttttgattcccagataccagcagctactcatgtcttcgccattgctaagaacgtcgttggtattaccttactctgagaacgtgtctgcagtttccagaaaatggagtatcgcaacatcacttaaagtaccctgcttcaaagtattgctggcaagtggcgtgggcctgattatttatttagaaatgctttatcaggaggagaatgcttttttgtaaacatgaattgcccagttctttcattgggctctggcttcttgtttcaggtcattgaaatgttgatctttgcctattttgcttcaatatccttgactgagtcacgaggtcttttcccaaggctggagaacgtgggagctttcaagaaagtttccatcgtgccaacccaagcagtatgtggactcccagaccgaagcactttttgtcacagctctgctgctgctgaaagtattcagttctgtacccagcggttttgtattcaggattgcccatacagatcttcacaccctacctacactgcccttttctcagcaggcctcagtagctgcatcacaccagacaagaatgatctgcatcctaacgcccatagcaattctacaagttttatttttggaaatcacaagagctgcttttcttctcctccttctccaaagctgatggcatcatttaccttagctgtatggctgaaacctgagcaacaaggtgtaatgtaagtagtagtgtaggtataagctttcataggtccccaaaaccagtagtagtgaagatcatttcagcctgaattccaaaccggaagtgaaggctatatagaattcatggtattgaagactaactcttccagttgtttccccaattaaaatttttttctcttctatggatgaaatggaccatgaaaaaaaatgtgaaaatagtttatcaaaggcaaatgtgtttatgcaggaatcatttattttctatagcttagcgcgacctttggtcttagccttcaaagcctaaagaagactcagagtgagttttaaggcatggaaacttgtaattaatacaaataattaatattttcaaaatcttgaactgggtttatataatcaacatttccttactagggtataacattttcattaggcagatagttctcccagtccttgggactgttttcttcatcctcgtttccccaagaagagctgtttgtttgactcatggaagatgttcagtaatataaattgaatatataaataaccctccatctctaaaaacatatagcttttagttctttatcttgtggtattttcattttccaattagttaggaaatatgtaggtaagtgtgagagattctcaaaagctttcatgctgttcatcccagagaaatgccttcaatgagtctgggtcttattactgccattttttgttatttaatcaccagtttttcattctgtaatcttttctcaagctgatatctaatgagtttcttctaaatatttattgccaacctggagattttaatatataggacagttttgaggaatttttgcttatcttttttcttcctagagggcttttggccctttctcttgtgacattttctgtgtgtgacagcgttggctggatatctaaaaacttgtgaaacaaaccagaaaaggattacaatctcataagcaaataggacttaaatgtttttggtgtttagtttcaatttgccaagtgaaagttggcatgtcttcattttgttttaaatttggattaatcacaaaattaatcacaaaccattcccatttctacatctctcctcaaagaaaaccttgttttcttactgtttgaaattctagtaaattcaagctactcagtttatataattaacatctgaagagtcttaaaacattgtcttttgacaaatagggctaagataaaatatccttctgagcttgtagggacatatctgtaccaaattcatcttctattgacatcattttgtataaataagacagagaagtatttacagggttggaagaacatggttaatggttttgagagttccttgtatcaaggtcgtttccattttcaaaattaaaatacctttgggaattgggggaatttcggggtgtttgcactagataagtaaaacaaacaaaacatggattatccaattattgtttattcaggagcagaataaatccagttcctaaatattttgctacctgccttcctctcacatttattatctaccaaagctagtatgtttacaagcaaacaaaatagcaaggaagataatcaataacatattaagaaatgcattttcagtaagcttgggaaaataagtctgcatttggtaaatacattcttgagtaatggtcgaattctcacttgtagatttaaacagaagaaaaatgaataggggcaaactcttttcaggttaagacctgatgggtagggataaaaacaaattcacttcagtaaattagaaatattcaactactgaagggttaaaaatataatttgcagtagaatttatataaaacttttatttctacttatataaaacctttatgtcatctaaatctatttgcctaaattaaaaatatacttgcactcataactttataccaaatatacatacaaaatatagtaaaattgtgacagtaaatgagggactattagtgttttacaatcttattcttacctcccaactcaggaaaaaaatagatgcaagtgatagatgcaagtgagaagaaattatgtgtgaaaaacatgccctttaaggaaagctttaaaccatctttagcagtaattcttgattggctcaattttatacatttgcctctctgatacttcctaccaaatttgatcacaaactcatcattttttgagagactactgtatcctaggtgtttgtgtgtgtatcctcagaatactcatgatctaaatgatctaatggagtgtacagatggatgagtgttattacctaggcagcacagtgtgttaagtgagcacaaagtgagacccctcaaccgaccctgagcaggaagaagggtgccaggaccaagcataatcattcagataccaaagctaagtaggaggtaaccaggtgaagaagagacctcaaggtctgaaaggtgtgtcactctaataagggtagagataacttaaaataatttgataactgccctgacacaagacctggaagttttctgaaaactcttctagtttttcaaaatcttatttcactgtgttctagaaggctgaaggacctttcacctcagatatttaacatgatctcagtacctcagttggactgtacggtcatggagaggtagccagtcatcttacagacactggctttggctttgtgccagttgatgatggggtgagtagagactatagctgtccattcttcatttcaccatgggaattaaatagagtgattctgacttcagggctaccaatttagagccttccatggacactaaatttgctttacattaaaaaaaaatttttgcactgatgacttaatactcaagcggcctgtagtgtgttgtaccacttcctctaaaagaaatagcaggagaactaatgagccaataacctaaatgttagttttgcagaatgattcaaccactttagtttccatcatgaatctctaatgaagggtgctgaggctctggggaatatattgtaaataagaattctattttttattgaaataaaggggcttcttcattggaataaagctttcattgaatataatgacattcaggcacttattcatagtacaccattttgagcaaagtttgaggtcattttaacaccactgtaactgcacaataccttagcatgtctttttggttggatgctgaccttttctctcttttccggttgcttcctaaggtgtgttatagaaaagacggtagatgggcagattgtgttcaaacttacaatatctgagaaagagaccatgttttattatcgcacagtaaatggtttgcaacctccaataaaagtaatgacactggggagaattcttgtgaagaaatggattcatcttagtgtgcaggtgagtaaaataaaaaatatttaacatttggttaaacacaaggatttgtcttcctttctctcttttaaatggcatctactcacaaaatctgcagcagtatcttttagatttcaggtgtgtataaatgacaactaaagaagaaaaatatttaaatgacctaatgatgtatctcttgatatactagcatttcctcccccaaaattgctgtaaaagctctcacagaaacttaaagacaatgctatctgtaattgtaatatcctcagaaaatttttgttttcttgggttcgtatattctattttgtttaaaaatgtgtaagggctcatttgatgtctggtactaattttactagtcatggatgtattaataccccagcttgatttttacatctgtctttctcagcagctgatgatgtgaataaaatttgtctgttgcattaaaatggtgaccttagaactaatgaactttacacttgaggcactcaaaaggtgttatattattattttagttgtcaaccacagtttgtatgagccttagaagctgctaaaggctgagagagctgtgacatgtctggtatttacagtctccagaagagaggcacagttcatccttttgttttttcagggcactggaatggcccaatacagttaaagccacacctgcctttcaaaccaggtgtattagtccattcttccactactataaaaaataccggagactgggtaatttattataaagaaaagaggttcaattggctcatggttctgtgggctatacaggaagcatgattctggcatctgctcagcttctggggagaccttagaaaacttacaatcacggcagcagacaaaggctgagcaagcacttcatgtggccagaatagggaggaaaagaaagaaagggaggtacttcacacttttaaaccaccagatctcatgagaattctatcaggagactagcactaggtggatggtgttaaagtactgatgagaaaacgtctacatgttccaataacctcccatcaggccccaccaccaaagctggggattacaattggacatgaggtttgggtggggacacagagccaaatcatgtaacttggggtgctgggtaccacagtttccagtatgagctctcatatgagcatccatccagtggctcatgtgaacctcatttgaactagaggacatttacatccttgttcattttataaaaattatctttgatttctcacttttttttttttttttaatcttgaagcagataatgagtgtgcgtcctcagagggtcttgataattgttcattgttttggctttcagatactaagatatgagtttagcaaatgtgattggcaggggtcagagttttcatacacaactagggttgaaatgatacacaaaggggacgtcatgtctgacgtcaagccttgtgcataggacatgatggtttctgattctcaatgcttattctccatgtgttcagtagttaacagataggagaccaatttgtcctagtcttgaagtttccattgtcttgaagtctccattctgcccactgaccagtcctacagaattgggttttaatattaaaaacgtagaaatagaaacttttaaagacagtgccatctttgcagaagatgccaaatagatatgtttgttgcatatttttgtatcaacaatgacaaaaaaaattatctttacttgcctttattttgtgttatctgtgaaactgtgccatgttttggcaggcagtagtacattaaaagcttcacaaagaaagtttaaaatctaaatgcagagcggtaaccatgactgaattactcccttggggataaaatgctcttagagtgcctactgaaatcagcattatcatttcaatacatgtcaaatatgagtcatttactagtttaggcaaaatttcttcatgaatctttaaatctttctcttctttcaagaaaaggttaaagtacttatgatttaatgagactgctttatttcataactgtttgactatcaagagaaaacttgtccttttcgatttgtacactcttttatttatttttttgcataagttttaaactattctgcattttatattaaaactacagaactaggcagtcacaaaatgttagaaaaccattcagatctgtcatttaatcatctagcacttattaaatatttgaggggtatgcagcattatgggaatctggatttattcaaatgaaaattaaagagcaattatttactctaaaatggagctctatataaggttcctttatattggacaacagtctgaatatgtttaaggtattatgaaatttataaaaatccatattatagatttttttttgagacagagtttctcccttgttgcccaggctggagtgcaatggcatgatcttggctcactgcaacctccgtctcctgagttcaagagattatcctgcctcagcctcccaagtagctgagattacaggtgcctacaaccacactggctaattttttgtatttttagtagagaaggagtttcaccattgttggccaggctggtctcgaattcctgacctcaggtgatccacctgccttggcctcccaaagtgatggtattacaggcatgagccagagtgcccagcctagattttgaaaaaggaatgtactgattactcaaaagttgttataagaaataatggaggccaggcgcagtggttcatgcctgtaatcccagcattttgggaggtagaagtgaacggatagctcgaaccaggagttcgaggccagcctgggcaacatggcaaaacctcatctctacgaaaaaacaccctaaaaaaattagccaggtgtgatggtgcgtgtctgtagacccagctactcaggaggttggggctaaagtgaaaagatcacctaagcctggaagtcaaggcttcagtgacccatgatcatgccactgcattccagcctgggtgaaagagcaagatcctgtctgaaaaaaaaaaaaaaaaaaaagtgacaggaaggacaggagattaggagttgggaaatctgatttaggttatgctactctgtagtcttaagaataaaatttataggaatccatatgatagttgtttaataaggaatgtactaattgcttaaacgttgttataagaagtaatggaagctgggcacagtggctcacacctataccctgcccgccttgacgtctcaaactgagtcatttgactcagttttcctatttacataagaagattgaactagatgaacaaaatgagggccttttgaattcttcataaacaagtaagtggagtgtggagtgtagcacaagtcattaaagtatggcaagctgttgagttgtgtagggttatttaggtagtaagtgacagagccagccccattaaccaatgatcagtcttgtgctttttttctcttctcccatgctgcttggcatttacataaaaacatttttttgctagattttctggacaaaatatagagaaatgtagattgttactattccattgtataactgcaagaacatttccagaaaaaatattttagtataaaatgtaacttactgttgcatgattatataatgcatctaaactccatttaatttggggattagggacttttatcatgctgggcataggacagaacaaatgattaataatcttgtttagtcaagtttcaaactacaaacctgcactttatgtatatgtggattttcacccatcttccaaatggccacaaattgatgaatttatatagtgtgtgtgtttctgtgcatgtgaaaaaataaaacatacaactctattcgtggaatggcccagaaaccagaattttagttcgttgcttatagtgattttttactggttagcttatacctggtggcataaaattaattagcagatctcaacttatgctttatctcagacagttcacttgtatcagctttccatcagtaaaatcagaattctaatttaccaaaatcagaaaaaaaattattttaaataattaaatatctgggggaaaagatgtcaggaaatccagacataccaaaattggaaatcgaatttcctaaacaaacaaatagacaatatgctcaatattgctatggtaatgaatctcacagcttttattccaaaactagcattttaaagtgtcaatctgttggaaaatgattagtgtttaaattaatattcatttatggacttgaatctgacaggattgccaattgaaattttactttggggtttaatatattggctatttcaaattatatcaagctaaaattcattgtgtcattttttatactaaaactagaaaaaatcaattcatagtttttattatcatatagggaacactgatcatattagcaaaatttttaaagcttagttttcatattaaatcagcacatgctgtagttataagatttcctttggttactcttataaaagttttgaaatatgtaaaaaaatttactttagcatttcgttatggattggtaggtaaaacaatatggaaataagtatatgtgtttagtggcatttcatttaaaagtaaaactttagggttttctttgacaatatattttgccttaagcagttccacacattttatagcccaaatagtgtcaaagaatcatcagtatagtcatccttctagtaattatgcagaattgcagtaaaacaattactacgatttgaagctgatgaaatactacagctgtggaaccaagaaatgatttagcattgggcttgttcacattttctatgctattttcagggctccttgatacattgacaattcaagagccatagatgactctagctacaatagtgtgaaaaagagcagttctaatatgatacaatgaagaaaaaaatgcatgggtaaataaagttttaggaatcaatatatgaaggataggagtttcataatcacagttcatgaagtatgctcttttgatttatgtattcaatctaagaaagaaaaactattgatagttctggaggaaaacaaaatgcaatttaaccaacatttgttagaatagataaaccaagtctctcaattaatctctgaactgtatgcccatgtgcacactttataaaggtgtttccatgttcctattgattgagggaacataaaacatccatgtcaccttatggaagcctcctcattcagttcagtaagctttatggcatagaattgtcataggaataccatcccagccccactcccattctaagagaatctcaacccatattatttctttaatatatcattgcatttagctctgactctgtgtgtgtgtgtatgtgtgtgtaagtatgcatgcatatgtgtgctaaatgtttctttgtgcaaagccttctctttatatctagccagctgggttaacagctcaagttagttgaatagttttgggttattcaaaataaattaagatcaatagaatataatgaagtttttcagaacaatcagttacaaattatcatagctgctattaatcattgatttatgtgcactatattaaacatgttacatatttgcagttatacaatgaaatagtgacatgcttgtaacatgtttaatatagtgttaataatagctctgtgccactgacttatattatctccatgacagagattttaaaaaattagccttaggaaatttaaactacctgcctacatttatagtctcaagtttctctgaccttaaactaaaagtaataacttgccatgaacatgggtcactgagcagatctaaataatagtttttaaaattctccaaaccaaaaaaaaaaggcacagaatcccaaaagaactgaaaacatatatttataatgtaaatataattttgtatatttatacatatttgtaatataaatattttcaatgcttcagatatttacatgatttatacaaataattaaagtcaatatattttttaactatacccctcattgatacaagcaatttaaatgtacaacagaatgtaattttgtataaagttctgcgcaatattttcatgttttatggcagttgcgatagactacaatggcttaaagaaagaatatttcccttaagccagcctgatcacctgacccatgccttatagaatcaacccttattacaataaaatacaaagaaggaagcacttcctactttattatggaagaggtaaaaccatccaagtaaaaaagtaattattctctgtacgttttttgcatgtgattttaaaatgcaatatttaagcagaaggcaaggctttaattcttgaccttttagtaaaaaattgtgcaaccctgggaaaactatgtaactcctcaaaatgttaggatacccattacaaattggaaacaaacaaacttggcctatttagcttacaccataaatttgaacatataaagaaaatattgtctactaaaacactttatagcctataacttcctgctatgaaggagcttacagtctcttcagaggataagcaatcaaataattacacaaataaaggcaaaattataattgtggtaagtgctacatgatcacatgaagaatgatttggtcaaaccactgaagtcaagaaaagcttccttgagtaaatgttattgaatatgtgtattagttttctaggcctgtactaaaaaattatcacaaactggtggcttaacacaacagttaattcattgttgaagagttctggaggctagaaagctgaaatcaagttgttagaagggccatgctctttctgaaacctctagaatccttccttgtctcttccagcatctggtgtttgcacagacaccagagtatgtgattgtgctacctcctggggtttgtctgcccacagcaaggccgggaacccagaaaagaaaagaggagtgcccagtgtagccaccacccactgcatgagaaacagagctggcagcaatccttgatgctccttagcttgtagctacatcactccagcctctgtctgcattatcatatggtcctctcctctgatcgtgtgtgtcttctcttcttataaggacatcagttgtactggattaggattcttcctaattcggtaggactcatcttaacaattacatccaaaaagacactacccaaataaggtcagagtcacaggcacatagggttagggcttcagtatgacttttgatgggacacagttcaactgatagtaagatttattcaaaagaatgcataggatccaactgggcaaagagaattgataagaacattccataaatgcatagcaaatagtgtaaatgcccttgtataaaaagaaatatgttacatagactaaaaaaccaaagtggttagagtgtcgctggcaaagtgggacatggtgtgaaatgaggacagaacagtaggaagaggctatgtgttaaagagaatcactggatatgttaagattttttttttaaatggaactctattgaactgttttatgtgaaggacaggagatgagggatgaggataaggaaggaaaacgtatgatatgcacagattattttttcctaaagatcactttggctgcagtgagggagaatggtttgcttgaagacaagtgtgaagggttgttatggtattttcatggaccaagtcagatgtaagtgttacttacttacagcatgaagacaatagtgaatatgcaaatgaatggtcagctttgagaggagtttaagaattaaattaaagggcttgttgatgaaggaatatgtaatatgagggaaagggagttgatgaatcccagctttctggcttatgtaattgcaggtacagtgatttctttttctcaaatagaaatactggaagagaatcagattttggatgtggagcacatatgaattagattccagtttagggtaataattctcaactatagaaattattagcattattgagaaactttaaaaaatattctgatgtccatatccctttatgtcttcattggtctaggtggggcgcaggcattatttctttctttcttccttccctgatggatttaaaaaggtgtaacaaaagaaaatatcagtctaccattgatgagcatttaggttggttccatatctttgctattgtgaacagtgctgcaacgaatatacatgtgcatgcgtctttatgatagaatgactcagattcctttgggtatatacgcaggaatggaattgctgggtataatggtagttctgttttttttggtctttgaggaattgtcacactgttttctgtaatggttgaagtaatttacactcccaacatcagcctattaagcattcctttttctctgcaacctcactagcactgttgtttcttgactttttaataacagacattctgactgatgtgagatggtatctttcattgtggttttgattgacattgctctgatgatcagcgatcatatgcttgttggccacatgtatgtcttcttttgaaaagggtctatttatgtcctttgcccactttttaatagggttgtttttttcttgtagatttgttgaagtttgttatagaggccagctatcagacctttgccagatgtatagtttgcaaaacttttctctcactctataggttatctgttcactctgttgatagttcgttttgctgtgcagaagctctttaatttaatttgatcccatttgtcattgcttttggcatctctgtcgtgaaatctttgcctgttcctatttcctatgtccagaatgctattgcctagattgtctttcaggcttttagttttgggttttacgtttaagtctttattccaacttgagttgatttttatatatggtataaggaaggggtccagtttcaatcttctgcatatggctagccagttatcccaacatttattgaatagggagtcctttccccattgcttgtttttgtcagctttctcaaagatcagatggtggtaggtgtgatggccttatttctgggctctctattctttttcttcggtctatgtgtctgtttttgtaccagattcatgctgttttgcttactgtagccctgtagtatagtttgcagtcaagtaatgcaatgcctccacctttgttatttttgtgtaggattctctgtctatttgggctcatttttggttttatatgaatttaaaaattttttttctagttattccaagaatgtcgttgtttgtttgatagaaatagcactgaatctgtaaattgctttgggcaatatggccattttaacgatattggtccttcctattcatgagcatggaatgtcacacaaaccaatgatatctgtttgtgtcatctctgatttatttgagcagtgctttgcagttctcattgtacagatctttcccctccctggttaactgtattcctggtattttattctttttgtggcgattgtttcacctgcttctaatcaaatctatttagtagctgttattaaactgtgtagccattagtatacagtagtactccattacccttggctttgctttctgttgtttgtcacccacagtcaaccacagtctgaaaatatcaaatggaaaatttcagaagtaaacaattcataagttttaaattgggtgctgttctgtgtagtgtgatgacatgtgaggtggtcaccatacctcctgcctgggaggtgaagcatccctttgtccagcagcttctccatattgtctatgctcctagcccttcagtcacatagtagctctcttagtaatcagatcagctgttgctgtatcacagttgtaacttgtgttcaaggaaactgtatttcacttcttaatggccccaaagtgcaataatagtaatgctggcaatttggctatgccaagaagccataaagtccctcttttaagtgaaaaggtaaacactctcaacttaacaaatgaaagagaaaagatcatatgctgaaattactaagaacttcagtgtaagaatgtatcttctgtccatgaaattctgaacaatgtattgttataattattctattttgatagttattgttaatctcttactgggcctaatttataaaaattaaactttatcttgggtatgtatgtataggaaaaaacatagcatatattgggttcagtaatatccacggtttcaggcattcactgggagtcttgcaacatatcctcaatggataaagggggactactgtatgcgcaatatatgtatacgcttaaaaagagttttgtttagctagtgtgtgtaagaagattatcacaagtcacactgtagtgtttgccttttgccagtctgaatgttatcatcagtctaatattttatagcaaagatttaagttcattgaaaacttccctatggaaacacttccaatcaagacctacagcaagccatgaataaattaacatttaaacatgaaaactgatatttgaagaagaattagcaattaataatttctgctagaaaatggtggtttctcagccaatagctataaattgtataatatatgtaaaaggaaatatatacaaatatcatatgggacatatatcacatatactactaaaattgaaaattgctataaatagaagactatgttccaatgtccactgatttttttttttttaacaatctctagtcttgaaaatgccactatggtaattctgtcaaatttgtaatggttgggatttgatggtagtgcttttgaaacctgtattatctaatggaattgtcatttatattatatcattttcacctaaaagccaaatacaataagacttaaattatttttgctttttttgtggatagtcatttttgtgcccaaagggctaactgatgccttcagttatacatgaacaattcgcactaacgtcaggaagaacagtgtgcatataacctagggcagaatttggtctatggaatgtatcactcagtagtggaatggagattatgactttatttaaacatggacttgagtagttttatttttccttactgtttcccttggcatttctttctctaaagtgcaacattcaaaagtattctatgcagctgtagtgtcctggatgcataataagggcatatgttcaaggcaagtttaaatatccacataagccaaagacagagtaattaacattaaaaaaattaagacaacttttccaagaatgaaaagctttaatagattagctaattttagaattatttaacaacaactgtgaaaaattattagtatttacaaatatgtatatataaatatatgtaatgtcttatgttagacagcaatttcattctgctctctaatgattacatgacatacttctgaaaaaagtcaaacagtgtgttctagaaggacaaagaaataattggttcagttttgcttatacttagtgttcaattgttatcaacctggggtgggaggaagggaaagaaagagggaaggacagaagagagcaagaaaagaaggaaggaggagaggaaggagagatggaagtcatgtgacatagctagggatttggggcaaaattcaagacccatgttttccttgatggaaagccaaggaacctgagaaggagagtcagcccatgccaatttcactgtggtagaggtgaccaagaaagtttacattatggatgtatagtaggtaattttaggttgtttttgtctgggatataaacccattgtgttattccagttatttggccaaaatgttccatgcaaccattttggagtgctagcactttagggaatttataaaaaggggtggtgttcagtgtctgggttgaatacaaggtaggtagaaaaggacaatcaaaggaattagctgcaaatgagatgaaatctatgggaacatatattgagaaaactagtgaccattataatttaatcctctgaaatacctgcaacaatctgagaacaaggtaggtggcaagatgcatttataaatattaaagaaacacaagaccccatacactttgaaaactggggagtaccgaacttggagaggtctagtataggtagtgcttgttggtttgcatatttttaaaaccactttattgaggtctgattgacatagaaaagtctgtccatgttgcatgtatgcaacttaatgagtctaaagataaatatatgcccatgaaagtatcaccataatctgtggcataaacatatccacctatttgtttatttttaattaaactttttcctgagataattgtaggttcacaggcacttgtgagaaataatacagaagtcccatgtaccctttactcatttgttctcatcagtaacatcttttataactatggtacaatattacgaccaggatatggacattaatataaccaatattattcacatttcccatttttcatatattcctatgtgtatatgtttagatccatatgattttattaaaattttatccaccacagccgagttgcagaaaagttccatccctacaaggacacctcaagctgcctttttataaccatgcccactgtctcccttcccctactgctgccacaggtgtccctaacttctggcaaccactcacttgtactctatttctaaaatttggtcttttcaaaatgttgtatacatgacatcacacaatatgtactcttttgggattgtttctttcttttttactcaacataattccgtggggattcattcaagttgttaagggcattgatagtccaccttattgcagcatagcattccacggtatgtgggtaccatggtttgtttaacccttcacccattgaaggacatctaggttaattctagttttgggttgtatcaaacacagttaaagcattcgtgtggatgtttttgttaacatacatattcgtttctctggaataaatgctcaagagtgcaatagcgtatggcagttgcatgtgtgtgttttaagaaactcatttccagagtggctgttccattttagaatcccaccagtgatgtatgagtgctccagattgtgcacatcctttgtagcatttaaaataaaggctacatttattttactatttaaaataacattttagccattctgatagataatatatcactgtggttttattttgcatttctttaatgactaatggtgttcagcatattttcatgtgcttatttaccattcatatgtccaattcggtgatgtctccccatgtcttctgcccattttctaatttgattgcttatttgtagcttgctgtttttattctttttacagggttttgctgagattgattaggtccaatttatcaatctttcctcttatgtattgtgttttccatgtcaagtctatgaagtcttgcctaaccctaaatcctgagtattttttctaaaagattttttttattttatattgttaaatttaagtatgtgtttcaggccaggcatggtggctcatgcctgtaatccccacacgtcaggatgctgaggtgggtgaattgcttgagcccaggacttcgagaccagcctgggcaccttgtctttacgaaaaattggctgggcatggtgctgtgtgtctgtagttccacctatgggggaggctgaggtgggagaatcagttgagctctggagtttgagaccagcctgggcaccttttctttacaaaacattggctgggcatggtgctgtgtgtctgtagttccacctatgggggaggctgaggtgggagaatcagttgagctctggagtttgagaccagcctgggcaacttggtgaaacctcgtctctactaaaaatacaaaaacaattagccaggcatagtggagtgcacctgtagtcccaactgctcaggagctgaggaaggaagatcacctgacctcaggaagttgaggctgctgtgagcagagatcatgccactgcactccagcctgggcaacagagtgagaccctgtcttaaaaaaaaaaaaaaaaaaaaagcctatgtttcactttgagttaatatttttttaaggtgtgagatttggttttgagcagtggatgtccaaatagcccttagttgaaaaggctatatccttccttcactgaattgctttggcacatttgtcaaaaattagtagaagatatttatgttgatttatttcagaattctatgtatatccttccaccaataccacatgttcttgagtactgtgagctataatatctagtagagcgactccttctactttatcctgctatttcaattacaaaaaataataaaccttttagggcctatgattttccatataaatttcacaataagcttgttgatgttttcaaaatatcttgtttagattttgataggaattgcattatatctatagatggatttggagtgatttgaaatcttttactatattgagtcctctaatatataaacatggtgtaagtatcaccatttaggtcctcttttattggcattttgtaatttttagcacatacattgtattagtctgttctcaccctgctataaagatactaccagagactgggtaatttataaagaaaagaggtttaattgactcggtttcacatggctggggaggcctcaggaaacttacaatcatggtggaaggtgaagggaaagcaaggaccttcctcacgtggcgtcaggagagagaagagtgaggtgtgaaggggaaagatccccttattaagccatcagatctcgtgagaactcactcactatcatgagaacagcatgtgggaaactgcccccatgatctaatcacctcccgccaggtgcctccctagacacgtggggattatggggattatacagttcaagatgatatttgggtggagacacagccaaactatatcatacatcctgcacctgttttgttgagcttacccataaagtgtttcattttctttttggtgattgtaattggttttgtgttttaaattttggcttctgcatgattattgttggtatatagcaatgttatgaattttctagggtgatcttgtatttcaaaactttgctgaactcacatttatagtagttctggaaattctttatttgttggaattttctacatagacaatcatgacatctgaatttggagcagtttttttaatctttccaatatgtagtttttatttctttttccttactgcagtgactagaatttttagtagtatgttgaataagaaaggtaagagcagagattcttgctcttcttgttcctaatctgaggaagaaaaagagttcaactttcaccattaagtatgatgttagctgtagattgtttgggtaagtgttctttatcaagttaatgaagttcctctctattcctaatttcttggagttttgagtattaaatattgtcacaaggcattttctgattcaattgatatgattatatgatttttcttctttagtctattaatgtggttgattacactgattgattttcaattgttgaaccaaccttacatacctgaaataaatcctacttggtcatagtatacaattatagtatatgtagtatacaattccttttatatagtgctgaattgatttgctcttctttctctagtttcttgaggtagaaacttaatgttttaagatccttcctcttttctcatataagtattagatttagcttagtgttgtaatttaatgtgtaatttaatttagtatttaatttagtttagtgcaataaatttccccttccacgctgctttagcagcatctgacatattttattatgttgtatgtttgactcttgaacaaaatgagggcttggggtattgactcccgatggagttaaaaatttgcatttaacttttgaccaccccaaaatgtaactactaatagcctactgttgaatggaagccttaccaataagataaatggtccattaacacatattttgcatgttatatgttttacgtgctgtattcttataattaaatagagaaagaaaacattgttaagataattataaggaagataaatatatatttactattcattaagtgggagtggatcattatataagtcttcatgctcattattttcacattgagtaggctgaggaggaggagaaagaagggttggccttgttgtctcaggtggcaaaggcagaagaaaatttgtatataagtgaatctgtgtagttcaaacctgtgttgttcaaaggtcagctatattttcatgtgcattcagttctatgtttttgaaatttcctttgaggttttcaaaattttcttttacaactttctttttgactcatgggttatatagagatgtattgtttagtttcaaataaattggagattttaaatattataattctgttattgatttcaaatttgaatcattttcaatcagagaacacattcagtgtgaattcagttctttaacatttgttcaggattttttaacaggccagaatgtagtctatcttggtgaaagtttcacaagtatttgaaattaatgtgtatagtttgttttgtgtttacacacgcacacaaacacagatgcatacacatataaatcttctgttatctttttatttctatttaaagaacttcttttagtcattatttaagagtaggtgtgaagaaaaccaattctcttataaatagaactaagtacatctactttgtatacttttcttgagtgattctatattgtaatgatgtcctttttactagttctatcaattgctgagagtttgctgttgacgtccctgatttaattgtgggcttatctatttctcctttcagctgtatcagtcttgcttcatgcatgttaaagttctgttgttaggtgcatacatgtttaggatcattaggtctttctagtggagatatcattttatcattatgtaatgtccctcttaacctctagatatttggtttgttctgaaatctatgctatttgatagttactagttattccttttttcttttgattaatgtttgcagatatatttttctgattactaatttcaactgacctgtgttgatgtccatgaagtgaatgttgtacagatagcatattttttggatacttttttaaaaattaagtttatattctaatacactctgctaatctctgtcatttatttgtatatttagaccatttacatctgagattcttactgatatgctagccttatgtgtgcaattttattttttctatttcttgtctgttgtgggtctctgcatttctcttttctgaccttgctgtaggttacgtgaacacattttaggattctatcttggtgttttaacagcattttgggtatatcttttttgtatagtgtttttagtggctctaggtattaaagtatatgtaagtcacttatctactgacatggacatattactacttccattaaagtgtacttttatttccacttaggtcctttactcattctaccttttcagtataattgtcttaagtgtttcccctacatacagtgagcatcacattacactgagttgtaatttttgcttcaaccgtgaaatattatctagcaaactaataagagggaaagtctaacttatttccccctaattttattcattctgatattcttattttctttataagttctgaagcttttattatcattttgtttctatttaaagaacttcctttagtcatcctttaagaatgggtttgatgaaaacaaatactcttatttttcactcatctgagagtgtcttgatttttccttcattccgaaaggatatttttgctggatataaaatttatgattgacagttaattgctttcattacttgataaatgttgtgccactccttctggcttctaatttttcagatgagaaatctgttgtcatttgaactggtatttacttataagttttacatcattcctctggctgctttcaaggttttctctttgcttgttttgtatttagcagtttaatagtgaaagccctagcatgagtttccttggttttatcctattgtatgagatttgctcagcttcttgcatgtgtttgttaatgtcttttgccatattttcagtattttcagacattctttcttgaatacattttcactgccattctctcctcttattctaggattccagttatacaaatgttaactcttttgtttttaactcactggttcttgaagctctcttcaagtttttttttttccttttaatctctcttttcttatttgttcaaattaggtaaattcttttgatttccttcaggttcaggaatcctgtcatcttcctgttacccttgaacccatatagcaagtttgagtttgtttcaatggttgtatgtttcagttatttagtttccgtttggatcttttatatatatatatatataacttctatttctatgctggggtttctctcattttttttcttgcttgaaagaattcacaattgcttgttgatgcatttttattgtatctggtttaaaatccttgcctgataattccaacatatgattcatatcactgatggcatctgttgatcttcttctttcattcaagttgttattttgatggttcttagtatgacaagtgatttttattatatcctggatgttttgggtatcgtagtatgagactctggatccaaattcatcttcttttttattcagaagctgtccttacattgaggtgtgcacagaggccaggtgggtgtgtatgttcattcatcaccccgttgtcactgccaacatcatccagcagaagtggagcactgactcacactgcagcagatgggtagggtgaaacttcagcttccctgttgaccccttcccagtgaaagcgggccgcctattgctgctgccttgttgcccctcatggtgacatattcctaactccccactgagccacggaagggaaaaattcattgcttgttcacactactttgttgctgcagggtaggggtggaagctgagcttcctgctggtctctgtgacaccaggggaggtggggaatggagtgtcaagtaaccctcctcctatcaccttattctgcctcattgatgccaggtgtgagagaaggttctgcttctctccagaactctcccagttcttgtgaactgggtccaattcacaagaaagggaaaaaggatgtagagtattgattggccctaacacctagcacacagtctcactaataccactgggagtaggggctcagctcccctctaggccctgctcacttagtgagggtggggtgggaacagaatggagactaaccctgacacacaccacctcatgtggtcttgtgctgtgaagagagtggagaggttcattccctccttggtcccactgacaccagaggttggagtaaagtaaagtgctgatgagccctgactctcgtgtccttgtttagtcttgttaatattgggtggatgttgagcttcagctcctgactggggccctgccagagccggggggaatgtaatgtgctgactagtcctgccttgcaccacttcactaagtcttgctgctaccaggtaggggtggtggagatggtttagctacttgctgggctgaggtgacactaacttagtaaagagttggagcatggctgactcctttcagacaggggatgaaagatcagccctctgctcactctgccaatactatttagaaaagagaatcagagtggcacaacttccactgagcagaggacagaaaataagctccttatttggtctcatcaaaaccacccctacctacagttagacagctgcctgtttcaacaagtggagaatggaagatcagctctctgtttggtttattggaaccaccaggcaaggggaattggaacactgactgcttctgccagtgggaatagaaggttagctgcctcttggccctgtcaacaccactgtgaaagggaatcaaaaactactgcttacttctgttgggtgagagggtggggtgaaagattagctccctgatgagctcggctgctggaactatgaatgtgtgtgagtgtgtgtggggagagagtgtgtgtgtgtttgtgtgtatgggtgtgcttgtgtgtgtgtgtttggtttttccattggagtttggctaaagtatgacaggtactttttgctaaaaaggttttctcttgtaggccaacattttcctgatcttctgtctaggaaaataagcctttccttggagcttattttgtctttgcctgttggtggttctacgttagatgtttctggatattaaaacaacaacgaaaactagggaatttgccatgttgttcctcaagtcctcagattcctaattttttttcttctacctacttcgcaaagtcatcttacacttatttgttttgttatgttcagggctttttaattatagaaagagaactgggaggaataaggctgctccatctctgtcaggatcagaagtcatgtagtgttataaaaaggactttgtctaccattttaaaatagctgttggctgtaagctccttattgtatttaaagtatattggctaaaattgtgggaggtaaggaaaactctttgtaaagtgaactgacatggtgaaaagagagagaagatatgcttgtcaaatattgcgaagtctattcagatcaagctagacatggtctgtattagtcagggttctccagaagaaaagaaccaataggaggtgcatgtctgtgtgtgtatgaaaaggaatgtattagggagaatttgctcacatcattataaaggcaatgtcccacgacaggctgtcagcaagctatagaatgatagaagccactagtatgtctcccaaggaaggtgatactatgtctcagtccaagtcccaaagcttcaaaaccagggaagctgacagtgcatcccatagtctaaggctgaaagcctgagaacccccagatcccccagagaccactgctgcaagtttcagggtccaaaggctaaagaacctagagtctgatgtctaaaggcaggaggaagaaagggcattctgcagtggaagagaaagagagaggcagctcacaaagcaagaaaagcctgcaagctgaatatcccccttcttctgtctgctttactgtagacacacctgcagctgattggatggtacccacctacattgagggtaggtctttctctcagtccactggcttatatgtcaatctcctctggaaacaccgcaatagatacatcaagaaacagtgctttaccagccgtctaggtatccctcaatccagtcaaattaatattaaccatcacatggcctattcacaatttaaaaatgtagcataaattgcagcagtggtcaagtgtattggcaagttgtaaagtgcctataagaaacctatacacgagcatttgcagattcccttaacacttttcagcaaatattttgttacaattgaaattaaaaggcagtttgaaattgttcctctactaaatatcacactggatatgaataaaataactagatagactaacaaggtacatactttattgcctgtgattattgcaactaccactcctggtggagagccattcttctcaggtgtgcaagtggaagattaattctcaatcaggaatatagatttgatacaaggaaagcatttcacttggcattagtgtgtcaacatttcagctaatttgcctaaccacaaatacttcagggggaagagaaattgctagtgctttatattaaacattggatggagctggcggagataatacaatttgtactttttttacatagtttcaacgaattttggcagatatgtctttttgaggcaactttagatgttgaaaagctgcttgtggatattcaagacttgtctttttttcatgttacaatgaccatcaccatagtttgtatctgattttttttgtgtgaattgaggaatgtggagtcataatgcaaaagtcattgccataattctttgcagatcttatgactggaaattcttgtgtatgtagtttgatattcatttgtaacacatgtaactggttcgtgtaatgattaaaataataagtaatgcttgatcatggttaaaataaataccaaggataaattcttctattaattagtgtaagcttatcctaattaacatctttaattatgggctgttgttaatttttgtcgcaacctattagatatactgtcctaaatcattaacactagtgtaactgagcataaactctaggtgactcacggctacagtggaagcgcccatggaaaatatatatttctaagtacacagtttagataatttcaagcagaatcagaaaattcttgatgaattctaaatttagtataaacagaaatgtattaggtttggttattgagccaagcttcaaacattgaatatcagaattgtgtccatttgcaatgagtaagcatttgattcaagatttttttttgtactcagactcatttttgtatatctttctgtttaagtcatattgtatttactgcgattacagattttttacatatttcttaaactggttctatgttatgccattatataacaggtgataaggaatgtactgtcactgccccttgacaatgaaaaggggacatctctactagtgtatgtgtatgtagctgtggaggagttgaaacagtgtaagtgaaatgcctagaaattgtcctgagttttgattttgtttgtgcttacatttttattagtatatgtactttcttgaatagataattgatttggggcaatatttctcaatcttggcactactgacattttggactggataattattggttgtgcctggctttcctgtgcattgtaggatgttcagaagaatctctggtctctacccactagatgccagtagcaaacctgccacctctctgcctacttccgtcctgtcttgcaatagtcaaaaatgtctgcagacattgccaagtgtcccctaaggggcatgagccttggtggagagaaacttctttacagtctcatccttggcgatgtcatttccttataatttgcgtagttaaacatttttgttttgaggagcataagttgtgataccatacctgtacagaagaggcttggatttaaggttaaccacatttaactgagagaattttatcaaagcatgaaataagaaaaataggggcaaaaaatgaaattctaaaatggcttatgcaatttctaagggtagctaataagaattctgaattggtgacattgtttttaaaaaaagtaaagcattaaaagaatttcaaagataaaatatattttttggagtgtgaacactgtaattaaggagacccaataatgttaagttacttaaaggatgtatttttacttaaagtaggatacaagttggagaaattaacattcggttgattgttaaatattttgattcaaagaaagaacatagaattgtcagcctcaaaaaatatgcttaagatagaaaaataattttggttgcatgaaaagaaaaagattttagtaaattgttgacttgaaaaggggaactatttgacagaagtctcaacagtgttttggagtggcatagtgattggggggtgacatcagatgattagagttaaaaacgactggaccggctgggcgcggtggctcacgcctgtaatcccagcactttgggaggccgaggcggctggatcacaaggtcaggagagcgagaccatcctggctaacacggtgaaaacccgtctctactaaaaatacaaaaaattagccgggcgtggtggcgggcgcctgtagtcccagctacttgggaggctgaggcaggagaatggcgtgaacccgggaggcggagcttgcagtgagcggagatcgcgccactgcactccagcctgggcgacagagcgagactctgtctcaaaaaaaaaaaaaaaagactggaccagttattaggccttaagttgatgtaaactatatgacaaattgacaatttagagacattgtggggacatttctatgaaacgtctgtttattattcattcctgtgatgattttgaaagggcaaataaaatcataatcacatattgtataatgctttttgtctttcaaatacatatacattaaaaatgacttatataaagcaaaatgtacctttttgtgcacaattctattggtttttgtggatgtatactgttgcataaccaccatccaaccaatacacagaagagttctataacttcagaatattcctttgtgctactcttttatagtcattcccatcttcccacccccaccctctattgacccgtaaactgttttctgaataaatatctgggaaaaggattgctgcgccacatggtaggtgtatgtttaaagtttctcagaagttgacagactttttccacggtggctgtaccattttgccttctcaccagcaaaatgtcagattacagttgttttgcatcctggccagcacttggtatggccacttcatttatttatttagctcttcttctgataggtgtttagtggtatctcattatggttttaatttacacttctctaatgattgatgattttccccggtgactgatgatgattgaggatcttttcaggtgcttatttgcctcccatgtgtgtatcctctttagtgaaatgtttgttcaaatcttcccatttcaaaaaatgttggcccttttcttattatgaaatttctatggctctttatgtcttgtgcatagaagtcctctgtcaaacagatgtctgttttgcaaatattttcctgatttgtagcttgtcttctcaatattttaacagtgtcatttatagatcagaagtttccaattcttcaggtctggctcccctccataatctgtttgctttgattcacttttcagcatcctcatgtagttgctttttgtgtttggtctgagattttacttgtgattggcagggagagataggctgaacgtgactgagtggagtatagcatgagaagacttgcataatattttttttaattttcagtgttttgcaaacattatttttgatccattaataatgttaatgattgccattttatatacgagaaaataaaaaaatcaagagtcataagagtttaagttcataaataataaaaagccacatggaaataaccagtgatctaaatcacctggaacaactaaaaccttaaggtattatatcctagtttgtgtgttctgaccacaagcccctagaatgcaaattacttatgtaccttatttaattatgtttgctttacgtaattttagtactttaggaacttccttgattaaatttcaattcatacatttgctgaaaaataactaattttaaaactaagtaaggttattaagtaacttttttccatctggaggagaattgtttttgttccagattctttactgacacaatagtagcacactcgaataagtgcatagtatgcttcatggaagatcatgtgtaaaagccaggcttagtcaatgtttcttctgataatacatgtgaaaagttgaaaagaacctttatggtcattttcctagtaagcaagtcaattccttttgcttaaagcattttaacttcattaacgtaaaagacaatagatatctactatgtatacaacactttttaagagatcttgaggttacagaagatagtaaagccatggtgtctatccttaagaagctatacataataagaaagaaagaaatctcactgtgatattgagtatacatttttggaaagtaatttttgaataaaatcagatgttttaaaaaatcgtaaaaggttttgaatcaacattttcaaatatttagaaaataaatgagaaaaaagacagacccaaccaattccttccagtaattttgctctgatattaatgtaattcccttcagcttttatgtgcatattatatatgttattaaccatagtacatctttaaaacatatataattttgtctgctcacttttttttaaaaaaacagcattgtatcacagtttattttcatgtaccttcatagttcaaggtacaagggaagtaacagagattccctgagagaagacaatggatgttcctaagaaagacctagtgtgagagttcagggaactgctacactttggattttttttttttttttttttttttttgagacggagtcttgctctgtcatccaggctggagtgcagtggcacgatctcagctcactgcaagctctgcctcttggggtcatgccattctcctgcctcagcctcccgggactacaggcgcctgccaccatgcccggctaatttgttttgtatttttagtagagacagggtttcaccgtgttagtcaggatggtcgggatttcctgaccttgtgatccgcctgcctcagcttcccaaagtgctgggattacaggtgtgagccaccacacctggccaggattggttttttaaaataatgtagaatgttttgtatttgtccttgcatcatgtaaagatttatccttaaaagtgcaatttgtctttggactataaactctgcgagggacaggacagtacttacatagcatgttaaaaattcaagtatcaatctacccatttaggtctattggctctttactgagtccagggttttatttacatgtatcactgaatgaatggccttaagaaggtacagatgagactactgaggcatagagagatttaacagaggcaagcagagcatcacaagcagtttggaactcaacacatgtttcttgtttgaaaatatgcacagacaaaagagggatggatagaaagttggttcaatataggattaagacctggaacaaaagcacatgggcaccagcagaatctacttgagaggtcacagcgcccaaggggaaacaaccctaggcaagtcacttaacctcactcaccttagttctcttgttggtaaaatgcagagtttatgcaaactcaatacatgtcaagaaatatctgcaaggcattgtttaaaattgaccctctggatttttttcatgcatgcctggttattatttattaagatgtactaggggcaagtctcaaatggaagaaaaaataaaaggcacatctgcaaagtgaagaagtggggttaagcgcaatgcaacagaaactcttatactaatccaggaggactttacctgtcaatcaaatctatattcattttttttaaagattaataatggtttgttaactgagtaagctggcagatggtaaagtaatgtgatgagatcttggggcatctatgaccagttgatgactgactgaccaatttcaaaagatgctatgaaggatcataaagtttagttccatgtggattttgatgatagttgcatctatatttaaagccttctgtcactggaagcactcttggtgttgtcagactgtctattggactggatgagctgcaacttctcgcaattgaatgtcaataagaccaaagcaattttggttgattcatagcaccagcttaagcatattcacttgcacagattacatttgacagatagttaccttcagctgaactctgtggttagaggcttgggcgtattcttgacagtgagcttagagttgatgtctaatgtttatttcatatcctgtttttaccttccctaatattgcatgtgtaaatctatatttaaatatattcacagctgatgttcttgtcggtccacttgttatctctggacagaatgctgtaatgattcaatttaattattttaataaaaataacttgcacccctccagttttaatttcaataaatctgacgagtaatgattaattttaaggagtcttattgatgagcaattgcaacactataatgcaggaaaatgcccaagtggtgggagcatgcttacatctatagtaaacttaaaaccttcaaaatttggtgtgtgattatgaacaccgaggaaatatatccacatttatttaccaaattattattcctgtatcttttttaagttatttaggtccatcagttatcttcaaagtttaggtttgaaactatccatttcaagaatattagccttttaagatgattataatttaaataacatattctaaaatgttttaattgaacagtagaatgcatgtaacccaaaacattataaaatttaaaaagtcacggccatttttgaatatttagattgggaaaacacttaagatgtggttttatgttcaagaagaggtgcaattatggtatggattcattcatcattatggtattgtattgtcaacttttcagttatgttcaatttttaagatgctgggtgggaaatttaagggacatatagatctaataatctgagcctaaatctcctgctctatacaaataactctgcaaagctttggaatccctttatttgactaggtgaatggcagttttgtttgcatcagcctaaacctagcttggaaatcatgattttaaagcaaacacgttttcctcacacatttccatatttcctagaatctatcgttttaagatatcaaacaattcaaattatgtagttatacatttcacacaggacaaaaactcatgctgaagtaggtaaaatatttttcaaaattattttctctacatttactggcatactttctctttcttactgtcttaaaactgacagtcagttttttttatttttctcttttactgacagctagtaaatgtactgacagttcagaagcaagatgtaaatgtaagtcactattattttgttcacctgatacctgagcattagtagaaatgcatggctatattttaaaataaaaactagattatttccaatggttctgaagggaagatgtatagaaaaactgtcctctgtaaataaaaatgtgtttgaggcaagattgcattacatttagaaatagcatactttcctcattaggatgtgattggtatttgtactgaagaaaatgggctaattatttaagtaagatgtatatttactttctgtttcattagctgtaaatctttatagcatataaatctcctttagaaattaatgggaagtatataagtgagggaaagaaagcaggttatgaagttaataaataccatgttaaaaattagtttctacttaaatataaagttcaagattaaaaattaaaaattgttttattttaattagaaaaatcttgcttagttaatttctctggaagaaatgctatataagcagttaaatgtggagaattatattctattgataaaagtatgttgggccagactgaaccaacaacatcatagaaggactgattccttacttcctttaaaaagtgatctgtcatttgtctacattataaataacagctgagttttaaaacacaaggagatttttaaaaagtggcagcatttatttatttactgcttagacagtattcacagtattttatttcatccttaagactctttttttgttttgctcccacattattgttacacatatgggaattggtaaagtgggaaaacttagcatttatagatttttatactgaagcatgcgatgataaagtagtcactttcatccaagaaccttttcctcttttcacttacactagctcttccagaaatggcccctttagtgcctttaatggttttattctccttctgtcactatttttaatattcttattcttatactgccatcatatataactttgtgaaaatttgtcatataaggttaaaattgatttgcctttaaatacagtagtttccattttctgttaactgtttgaagaacacctattgagaggcaaggaaagacctgcgggataagttacaaaaggcaagaattcctcacagaaaaagcagcaggagcttccttgtcaagagcttcagcaagtagtgtcagcagcttagaagttgctattggactgctgagtgttatgcagataaattgtggctctagcttgtcctccgatgtcattctttgatttttctctgttaacactgcatttgcatttgggtctcactgagaacaaggaccagtgcaaatgccttatggcatgtgtagaaagctgcttttatgttaaaagtgatatgttttcttgttcactgtgttcacaacaaaaattcatcttccgagtcttggaattcccttatgtatttgtaattttccttccaagtcataatattcatatacaaagagtggaaatttttctttaaaaaaacctaccaaacaacaaaaacagtaaagttagttggttactagcagcaacaactgaaaagcagcatcaccaaaacatatgtaattcatgggtttccagcaaaagaggaaatctggaaagagaagatccttaagtattgctttaaagtgagcactgaaggacagccgttaaaacaatcccaatttttagaaaaggtattattccctgacatttacttgttttattcccttctcaatctgaagacacattttggacagatgctcttgtcttacatgaacattcaattcatttgagaaaataatggttatacttaaactcgtgaagtgaaatgtatggaagtctgttgctttataactttaaatagccatgtaacttgttcatggcagaatatagtcaagtcctgggcaaggactttttttctcttctccaataatgctattcaaggggaagctagttattgtgtgacacatgcttgattctcaggaggtttggacaaaagagagggttagaaggtcaggagagcctgacgctattcaactagatatttgagtagaattcccacaccagaattttgcctcatacctaattcagacagtgtaataatgggggaagggcagagagagggagggcagatggaggtgtcctttcaggttaaatgttaaaataagggtcttcatttctgtctctggtggcacagagcattaaaaaccctgtgacacattttggaagtgttgctataaaatagattttaacgtttgaggatctataaagggtattattgagtacttaatagattctgtgtttgcctactgaaatcactacaccgccgatatatacctcattaatttgtaaagcagtttggcccaacttgagacaatgtactgtattaaagcaaagtctatatcccaaattttcatggccaataattacaaaacgttcagcatctgaagaaaattatctaaatgtgacaatattggtcttggatagtttaacttgcgtgaaatatttcacacagaaacatttgatctatattgaagagttgtttcttttttcatcagatcagctatatcacagtaaattgtggaaatagaaaatggaaactaaattgttgaaaatgcatctgatagtttgtttttattgccaaaatgtcattgtccttgaggtccatcactttgtagcttagtaaaaacagatttaggcattgcaagtgagaagtcattgactgttttccttgtaaccaatttatttatcaagttggtaagtttcagaagtatttccagtgttcagcctatttcttcacttttctattttccaaattatatcctattacttcaaagatgtataaagttcacacattctggattctttatctcttttattgttttctgcttcatacaaagtaattaaattatgttcttgaagtaattcctcctatcttacttaaaatcaccttcatgatctgtcaagagttttcaagttgttctgtgataaagttcttagagtttgagaagctaaatggtggagttggtgcttaagctcttcactgaaagctgcaagagtataaacgaagtcagaaattactattattattatttttttctcattgagacggagtctcactctgtcgcccaggctggattgcagtggcgtgatctcagctcacggcaagctccgcctcccgggttcgctccattatcctgcctcagcctcccgagtggctgggactacaggtgcccgtcaccacgccaggctaattttttgtatttttagtagagacggggtttcactgtgttagccaggatggtctcgatctcctgaccttgtgatctgcctacctcagcctcccaaagtcccaaagtgctgagattacaggcatgagacaccacacccagcatatatatatatatatatatatatagttttttggtttttgttttttgtttgtttgtttgtttgtttgtttgtttgtttttttgagacgagtctcgctctgtcgcccaggctggagtgcagtggcaggatctcggctcactgcaagctctgcctcccgggttcatgcctcagcctcccgagtagcttggactacaggcgcccgccaccacgaccagcaaattttttgtatttttagtagagatggggtttcaccgtgttagccaggatggtctcaatctcctgaccttgtgatccgcctgccttagcctcccaaagtgctgggattacaggcatgagccactgcacccggcctgaaatgactattctttttaataacttctatttattgttttgtgttattcataattgttgtgcaatttaatttatttcactagtagaacactatgtacaggactgtactgtgtggaggttttagaagtgacaaaaccagttaactaggctcttggtccaaaggaatttagtgaaagagataagacataaacactaatgactgtaacatttatggaataataaataggagctgctgaaaattgtgatttcttctcattatgatagtgcttcttggattataaaaaatttaacctagaacatgaggtttcaagaggcagagatggggagagaagaattccaggtttgggactaggatgtagaaaggcagaaaggtgaaaatattcttgtgatgatggcaaacagtgactggtcaagtttgccaagagtaggttttatgcaagagcgtagtaagatgaaaccctgaaggaattttactgtcagatgatagaaaccggaataaagctgaggatacagttcaataatcaaagggaaccaaatgaaagttttgagcaaagaagggatcttattaaaacagccttttattatttcttttaagctagaggtagcttggcattatctgtgccagctcagagtgaccttcaccccaaaattctagttggattatggagcagttaatcttacaggctctaataattctgtcaccctttgttgtcattctatatctgtgtcccttcagttatgtgtcttctcccatattctcataccattatttctctgtctttcatttctttactttcatcatccacatcaggacaatgtttttattctatagtagtttgtaaacatgtcacattctttagactttcaagctctttgtcaacagtttttcaaagtccttgccttacataaacactaattctttccctttagggacccctttcctggcccttccaagcaaagggtgctcattcatccactcctcatgcacctcattgctgggagcaagtagagatgtagggattgctttcttctttttcttttacctcatattggaaagagatgtttcctttaaagctcatgttaagttgttgtgtacctttcttcaatttttgcatcaatttttgcaaaccttgcatcaatttttgcagctgctgacaccttggataccccagccacctgcctgccagatacaatgaaaaatttcacctctgactcacagtgtttctctgcatcattatcagcttttggttaatgaccatgaagcttcactttttcacctcttgaaaacttttggctacagaatgaagttaagcgcctaggtgcttatattgtctttgagtctgttgggttccttctaggttcagtttcttcacttctagcctagcccacaaggaaaatatctttagtagtcttttaaccattttcttttatttcattttttttcattctgttgccaccagacacctattctcaaatcattcacctgactgccttcttaattcctgtgtatagattgcagaatattactgaaaaaaaacaggtgtgtggattgaggccactaaaaattaatgatttccaactagagatggacccttagtgcagccttagggtaaatttcagaggtgcagctgattcaaagggtgtgcacaatttcaggggtatattgacctactgtcttcagaaaatgtttgactagtgcagactcctaccgaaagagaatcagagtgcctattcctcaaattattgttaatataaggaattatcttttctcatttttttctaattttatgggcaaaatagtatgagtgtattcttatttcatttagcatttcttcccctacctcgtacttatcttaccttacataggcttattagccagccacatgtattttttgcttctgggtaatagctgtgtattgttctcttatttttttaaataaaggggtctgcatttttattaatgactaagaaatcttgatatatttagaaattatatgtaaaaataattttaaattttttttattctactttaagttctggggtacacatgcagaacttgcaggtttatgtcatagttataaaaaaagaaagaaagcataggcagagaaggaaaatcactctggacagaaaaaaataattggttaaaatattaaagaataaaatttgtaggtaaaaataataaattttaaaatgacagtttaaaaatttatatgtaggctgggtgtggtgccccatgccgatagtcccagcactttgggaggcctacgcaggaggatcacttgagtccaggatttcaaggccaggttgggcaacatagcaagacgtcatctctacaaaaaaaaaaaaaaagaaagaaagaaagaaagaaaaaaaattagccaggcatggtggtgcatgcctgtagtcccagctactcagaaggctaagatgggaagatcttctgagcctgggaggtcaaggctgtgagccatggtcgtgccactgcactccagcctaggcaacagagccagatcctcttgcaaaacaaacaaacaaacaaattacatgtgaaaagaattatacgtgaagataataatttcagacatacaatcctatgttaactcccatagaaaattaagggagttatcacacctttgcttttaacaattctttctcttcccacattccagttttgttgaaataagcagagcttcttatcccagcttattgtagcaaaatcattatagtaaaatgatatttttatttcaagcattacaatagcactttataacttatttaaaaatttatatgatgttaaaaggattcaatactcattgagtatcctttcataacatacatctctaatttcttaatttgaattgagctttctatttggtgagagtatttctattctgaaaaggaacatggccagtgatgtaccttctgaatctttgcgtagttgagcctgtctttctaatgcctgtacccatgaacaatgtctggatgatgatggatttttttttcttataccctttcgtttgtgagcttttaatacattgcatcgtgtttctgaagagaaatctgagacaagcttaaggattatttttcactgtgggtgacccgtttttgtgtgcctgagtgagattcttacaggtttctttctttatccttaaaatcccaggactaccagcctatagtttggtgttaattaatctttgttttcttgagaatatggtaagcttttcttagctgaatattcaggtcatatttttaatcccttaattttggtttctatcatgtctttgagtttatattttcattatttgttttcttcgggctttcatcctgtgaaatttagtgaccaatatagttttattccttttatgtccaagatacataagaagttgtatgtactctagtgtccattcgttcatcaacttattccaattaccccaaacccctatttccaagggcttttcttcttccgttcagactctttatttgggtcttttcgtggttccttgcttaacactatgcacttttcacggcacacactttccctgggaattcttactcacaaccatgactcctagtactattttcatatgcatagttataaaacctgtaatttctaaatttatattgccacagtgctatcagtgagctttcaaaattcaaattcaagtatgatttttcttagttttaagatttcttcagttggaatggagacccttaatgacttagctctgacaactgttcagcctcatgttctgtaaggtctcctctgggacctcacattctagtaacactgagctgtctagtctttaattgtatccatctttcttatgttgctacaactgcacatgttctttaccaagaatactctcccttactatttattccgcttaatcctactttttcctttcactcatttggcatcaacattttcaggaagccttttcttatctcaaaatctgagtagacatgcactcatcctttctatgaaattatcgcaatttactcaatgtgctttatttgtgtccatcactagactccagaacttttagatcaagaattttaccttatttagtgttgttcccttcagggctcggcatcatgtttgaatgtgatccattctcaataaacaaagtttgattgaatgagtgatggcatcatccagtattagaacaaagttgataggacagtttgtttagaagctcttgcaagaatacagttgacccatgaactacaaggaattgaattgcccaggtctgcttttatgtgaattttttcgagctaaacacagattgaaaatacagtacttgcaggatgtaaaatccgactatgcacagggccgactttttgtatccctgggctccgcaaggctaactgcgagacttgggtatgattagattttggttatttatgcctggatcctggaaccaatcccttgaagactgtacagatgagagatattagttgatcgaatatgtagcaggagaaaactgaaaaaggaaaagaaatttatgaagtaaattaatgagaccgctgcatttcattactactttggagattagaggaacaataaaggtgactttaaaattttgaaccaacttctttataacatggcttacaagtggtagctagaaagaggagggttggttacttttgctttgtatattgcaatacatttctgattgttccctttccacttttccccctagtattgttgattactttgtctttgtaaaaaacttcatcgtgaaaatttctttctaaaatgtaaatgtgattacctccttcctctccttaaataaacactatgctcacgattgctcacactccagagaatgaaatttccttcccttagcaacatgttcaagatccttcaaaatttgttagatggtgcctctatagcttcattgtccttctatgtactttgagttttaaccatgatatttttttgcctcccaaaatcatgtactttgtggttttcatgcaagctcttcctgtttgccttattcagttgcttctagcttgtacacttttccctctccctcttcaactccatttctttgtgtacgtatctcaatgaccaccacaaatacaacttcctctgtaaaacacactaatttcttctctccttttctcctctctgctcctatagcacttttttttcttattggctgtatgacatttattacataggcatattttattagatattaagtaggttttgcattaggtatatttttgaatgtactgaaaggcagatactttattcattcatatgtgctcagaagagcaaaatatctcttacataatgtatgtttaatataagtaaatatataaacaaatagaaatattgagtttggtaaaagatgatattgagaaaaagtgatatgtgatagaatgaaaagctacatatattttctaaatgatgggtggacatttacaactttgctaaattatatattaaatcatctctttatcctgaaaaaattatcttttccatgattagtaagtactttacagtctcttctaggttataaagctcagtactctaattagttttagaaaaactgtgactaaactagcagtactgttttttctcccatattttgtctcacactgaagtcagtgatatttttttctgttcacagatatattcactcttagccttccctgagctctattacagcctggaaaataactggaatttcctttaaaataatacacattttcttaacttatcatattaaatgaaaaacacacaaacactggcctcctttcacattccctagaactttttgttttttctgtatttggcatttctgatgtctttaattttttgtgattctggctctgtattctggtgcctggaacagtgttgcttccaaataaataggcagtagtgatagcaatactcataaatattttaagctatttggaaaaagatattttttagaagctgtgttttgaatgaccttcccatttaactacagtgaatttcattcttagttccttcccaatatctaccctcttgcatcttcttttatgttgtttctaacgtcttttgcggtacctatcaatttactgtcatctactgttttcattaagattgctacttgtagatcattaataaaaaggtgaaataaaactaaattccttatcaattctctccttaagtcaataagtatccagttttaaatgacagtgcttgaattcaagttcatattaaatgttacttcaaataagtttgggagtttacacatacatggctctttggttcaattacatttgtcttatttattttgttttctgttcccttgtagtattctttgataaacttgtcctttaaaatatatattccaactaaactctgcttagggcctaagtggtgtagccctctggggagggtcgcaaatgtaatttgtttgattggatactcaagcttttcaattgttttcttttccttagagaaatagaacctttctagctttcaggtcaattgatgtaatggttggattcagatggaatgacactttctccccgttgtaagtctctagttcctcagagaaatccttgggaaatctgttgacaacttgctgtcatccagctgttctgatggtataaatgacttagacactgattcctggtagtttaaaagtctaatggaacagtgaaattttgagatctcaagtgcatcatgaataaagcacttaagtagcacttgtatatacttcttacaatttgttaactggttttctgctttttttttttgctggagaaagagatttacagttttaatctgattagacattagcagctggttgaagatgctattactgtgaagtatggaaaagaacacaatcatgatgaaaactttttactcaaatccttagaagaagaaagcagatgaaattagattggcaaaggaaaccagcccaaattacacacaggagagaaatgtagcagaggagagtactgagttggtgctgcacgcatagagcttacagcctccatgggcaggggacatgtgggtgtgactgccagggacaggaattgcaaacagcatttggagtgacagtctgggtcagcttctcatgctctttcccatcaccaggcatcagcgagtggaaagatttgacctgattttggagcacagagtgtgggctctaaggccacaggaaggcaggtgaatgggactaggatgtagtggagtccccatggctaaaaaataagttgtattgcatacctgcctttgccccacaattatcaaatccaatctagggtgaatagaaacacatctgcagacagatccaatgtccacctacaaaaagtttcagaaaatgaaaacagatggagaaaaaaaattataaaaatataaagaattctggtaaagttgccaaaagaaatgagtcttctagtcaaatgggctttgttctattagtagatgttgagacgaatgcagtgaattgattagaactgatgttatttgtttgggtgcatacatgtgtgcctggtgaggggtgggtgagggaagaaaaaaaactcaaacaaataagaaacatattgagagaaaaataatacctagagaattaaaatagtacactataacaaagtttgtgagtgattattaaggcttgtgtgggtattcgggggctctctgaggtgtcaatatgtaaactgagatctgacagtaaagactcagctaccttatatctcttcatccctacatcttgttctaagaaaacatcagaagtcctgtgatctcagcataagttgaaaactcgtaagtagtcattcaaaggtggatttgtggagggtagaggtaaactaccttgattatatttacatagaatggaagtgatgctaatttagaaatgtccattgctgtaagtcttaggagatgtaaagtaccaatgaaagatcctgaacagtattatgtgacagaaaatgagtgttacacttttaaaaaaatattagatgttgtaactttagtcattctcacctttaccttttaagtatttcaccatttaatatcaaccttcattattgatttatttctaaagatatctggaaatagtttaggctcattaattttctttttaagagtcaaatcggcatgcaaatgtttctcccaccaagaaatttttttcctggacttcaccttctgaggcatgtccacctttgaggcaagctaagccaggctttgtgaaggcagaaccatccgaagcacacagccccaccaaatttctctccctccttccctccctcccctgttcctctctccttctctttcttttttctctttctttctctttctttctctttctttcttccttccttcctttctttctttccttctttctttctttctttctttctttctttctttctttctttctttttatttctttccttctctttctttctttcttttttttttctttctctttcttctctcttcccccctcccctgctctcccctgctctcccctccccttccctttctttcagctgctgcttacctggggtaacatggtttgggaagaaacatgtcagaattggagtgaataaatataaatgataaaaagacaaaatgaatattattttcaagagtaattaccagtatgaagttcttcagatgataacaaaaactattgacttattttgtctaaatcaatgccactatcttatctgtgtgattgtgaagggaggaaaggaaactgttcactgaatattctgcatttgacccgtaaatacctacttttgtattcagggatgatatattcttaccttaaattaatgactgttttctactgttcttttttggtgcaaacaaattaaatgtgtgcacttctccatgactgattgtgcaaaaactgcttagacaattactatctctctagcttttgatcagaaaggactaccttgaaacaatggccacaataatggtattattctcaattctagaatttatttaaacaaacaattcaaatcatatttcataatacagttctctgaaggagcttaaagagattcagatttttccttttgtttaacatggctcttcatttagtttttgaggcatatttttaataaattttgctcagtactgtctactggagctgaaaaaatctaagaagacacaaaatggctgaagcataggtacttacagaaaagcatgcctttcttttaagaatataaaattaatacattatttatttattatataatgggatgttctacccttgttgaagattttagcagatataactcatgcacagtgtaagtgagcattcacccctgttttgtttatatggcaggactatttctacaaattttacaaattactgtttaggatctttatgacatccattgagtgctggcatgataaatgattttctatatatctgtctacatattgagggcctgattgatggcccttctgacttggggtcagcagtgagttcacatctcttggtatactttggcttattccctggaagtataaacagaaatccaatgaccactattttcattattttccttcaggcataatctgacctaatgatatgtaactgtattactgtgatttaagagatttttaaaaaactataaacattttgaggaaaagtgaaaatggtgattttaaatttaacacatttaaatattcattttatgaaaagaatatttgaaaaatagggatttatcaggatcaatagaaggcttggagtaacctaatcattttaaattttattccttcttgtttttttctgttttcccacaacttattcactaccctctatattctcatactttgctaaatcatattaatccttcaagagttggtttagatgaagcttcattcatttgataaagattaaatgagtgtccagtagttgctagctcaccttgttctgttgtgcttcacagacaatgtgttttatttttatttttattttatttttttacaaagtgaaggtttatggcaaccttgcttcaggcaaacatgtcatatattagtgctatttttccaacagcatgtgctcgttttgtgtatgcttcacattttggcaattctcacagaaatttaaatttttttccaatcattatagctgttatggtggtctgtgatcagtgatttttgatgttattataatttcagggggtgccatgaaccacaccaatatgatatggcaaagttaaccaataaatgttgtgtgtgttatgacttctccaccgacagaatgttcttctgacttgttccttctccttgggcctccctgttccctgagacacaacaatattgaaattaaattagaccgagtaataaccctacagtggcctctcagtgttcaagtgaaaggaagagtaacatttctctcacttgaaatcaaaagctagaaatgagtaagcttagtgaggaaggcatgtagaaagttgacaggttgaaagctagtcctcttgcgccaaacagccaagttgaatgcaaaggaaaatttcttgagggaaaattaaagtgctactctaatgaccacaaaaatgataaaaactgaaacagctttattgctgatgtggagaaaatttgagtggtctggatagaagatcagaccagctacaatattctcttaaaccaaagtctaatccagacaaggccctaactattccattatgtgaaggctgagagaagtgagcaagctacaaaagaaaagttggaagctagcagagattggttcacaaggtttaaggaaagaagtagtttccataacataaaagtgcaaggttgaaagagcaagtgctgttgtagaagttgcaagttatccagaagatctagataagatcactgatgaaggtggctacactaaacaacataatttcaatgtggatgaaaaagtcttctgttggaagaagatgccacctaggactttcatagctagagaagagaaatcaatgcctagtttcaaagctccaaaaataagactgagtctcttgttaggggctaatgcagttggggactttactgcacaggtggtaggtgccctaatccccatattgttaaagggtcaatggtttatagaaataatatagaagtaagtgtgtgattctatctaatctatctatctagtagtatctgtctatattcatattccctatatatccatagtccctacagccatccactgaggggagagagtgggcctgggagtagtaacactgaaatagcacgaatctacttagcaccgaatctttgttcctaaagaccactcatctcttagaggaaccaggattccttggagaaatggctgattccagggctgtggtggggaagtacaaaatgagcctagaacatcttgtgtcataaagtaagaagatacttaaagaattattagaacatgtcaatatgatccagaatgcagctgtatggggtctatactgtccaaacctggaacaacttgagcactgaaatacatattgagagtaattaattatatcccactgagtaaaatagagactcatgagtctatatagataaaaataagcctaagcatatattgaatttttaataagcaataggatatttatacagtcttgaagtatctgctcgcaaaatgtttgctaattgcaaaggggaaaattgtatttttacagtgtggaagcctggcagatatattaatgcaaatgattaaagttaacatcattaataatggaacaaatagaaatggtgtaagacatgataagatataatatgatcactgtatcacctgaatttaatcatgaggaaaaattagacaaacccaaattgagaggcaatctacaaaataactgggcggtcctctttaacagtattaagatcagaaaagccaaggaaagattgaagaactcttttttttttttgggtcggcactgcttttttattttattttattattattatactttaagttttaggttacatgtgcacaatgtgcaggcttgttacatatgtatacacgtgccatgttggtgtgctgcacccatcaactcatgatttagcattaggtatatctctcaatgctatccctcccccctccccccaccccacaaaagtccccagtgtgtgatgttccccttcctgtgtccatgcgttctcattgttcaattcccacctatgagtgagaacatgcagtgtttggttttttgtccttgcgatagtttgctgagaatgatggttttcagtttcatccacgttcctacaaaggacatgaactcatcagtttttatggctgcatagtattccatggtgtatatgtgccacattttcttaatccagtctatcagtgttggacatttgggttggttctaaatctttgctattgtgaatagggccgcaataaacatacgtgtctctttcagatcaaaagaaaactttatgacaactaaaggcaacatgtgatttggggctggaggtgttttttctataaaagactttttggggtcattgacaaaacttgaatgggctttaaagataaaatggtaatgatatacgaataactttgatgtttacatcgtgcttatgtaaaagaatgtctttttgtagcaaatacacgttgcggtattcagggggaatgggtcattaggtcaaaaatttaatctcaaatgggtcagaaaaaattctttgtactactcttgtgactttcctgtaacgttgagatagttattttttaaagtaataaaaaacagaaactactgattgagctgcattacagatagaatgggaaaagagaaaatggacagaggaagtacaaacaacttacttgaggaacacctcaatagagagaagaagagtaacagggaaatatttggtggaggagacttccaagatattttcacgttctcatctttgttcctaaccactttattcatatttatttattatattgcctcctttcattgaaagtattttatacgccatttctattacagattgtaaattccttgaagaaaaggtctgtgctttatataccccttatgtgtagtatatgtagcatcacacttagcatatcataatgtgcttgtttcatattcaaacaacaggaccattttcaaacaagtgattggattttagtgagagtatgaagagcagttttctttataaacatgggagacaaaagaggttgactcacttttaaggagaggacattgtagttataacaagtaacttctagctcattgggatgtaacatgctgaaaaagttttctaaggtattttacagctaacttgataatcttttggaaatcatctgttctccatgagtaaaatagaaaaaggcacaatgatatattgaaataattaagagtatctaatattgtgatgaagtgtgcaccaaaagctttcttaaatgtagaagtgtacatgacacctctttaagcagtatctacaaaaaaccagctggaactctccctattccttaggaattcaataaatcagactgttggcagattttccatcatgtatatgtgtaaattaatagcttttttttggcagtagagagaagagagtaatctaaatgtgtaggaagaagaggccatgagagtttcacatccagtcaagataggacaaaaaaaaatctacttgcattcctatgttaaatttttaaagatcaattaaatggagacttgtttggtggaggttgcagtatatgaagagctttaatagagatgaggggagaacagcaaatccagagaatcatacccagggcacaaatgtaatacacgtaggctttttctgtagattgcttcaagagcctggcttggcttgtctgagttactcagagaggaaaaaatgaaagtgagtgtatatgttggtttggggtgtgtgaaggtgtgggaatggagagaagtggacagagggaaaatgtgttgaaataaaacaccaggagctcatggaaaatgcaaaacagaaacaaaaccaagaaaaaatctttgaggggcatacctgtgtatgaattcatttttccatagcacctttaacatagtcaaaacaaataaaatttaagcagttattcagtcaaactagtagcaggtgcacacacacattccaaacattacaaatatttgtgggccacccacctggttaatttctgccaaagcaactatccctgaataatttcctcaagtacttattcatattgtttgtataaacgtcactcaatagagaatatttaataaactggagcatttataattatataaaaattcatgtcagtaaacaaggccactctgaaaagttatgtgaagaatcacagtatgacacattttgttagaaaacggtgccttttctttattgcttagagttgtaacatcacatagttcatgttgttgttttcattttcggggtatcaattagttgatcaatcagttagtgtttattaagcttctgtccagcaggtaaagcatgctcatcaaatttgcaaatgacataaatgttagagggatggtaaaggcactgcatgacagacatagcatccaaaaagattttgacagctcggagcaataggctgaatctaacaagatgaaatataacatagataaatataaatgcctacctttgggtccacaaagccaactgtacatgtatagcattgagtagatgtgaattagctgttgatgtaagcaggaaaaaaaagacagtattttagttaatagtcagctcaacttaatttatcagttttagctgcatgatgtcattgccaaaaatctagcctgcaattttgaattgtattaaggtgacaatcctgtaccagtttgacaggtcagaccacatctagagattgtagtatttctggagccacattttaagaagagagacactaaaaactatgtcatatttagaacatcacagaaactaaacacatttatcctgaagaagacttaggagaggaatgacatccttctttacgtttatgtaagctctcacatggaaaagggattaaatttgtttggtgcagtctcaataattagaactggaacttgtgaactgaagttataaggagatacctttgggttcaatcatttataataattacatataatagtaaaagctgttcagagagaaaggcgttcccaaaatctgcagaggcagaatactagcacagtttagcctgagtgtcctcctttgcaaagtggggacaacaccattgtgaagcagcgatctgggaaggcagtgggatgatatagggaaaatgttcagcacaatgaggggcatgtagtaagtaagtggttatagtacacaggggatgtcacctttcctattgtgggaggtggtgacaccaatcctgaatcatcactgggtagaggtatagaagagatgctaaatggatggatttgacaaactgactgttacttcaaaaccctaactgactgcaacttattaattaaatttgccatttaaaactgtctctgaaaccaccagtcacgcttctatagcaccttgagtattttttttttttttttttttttttttgagacagagtggctctgttccccaagctggagtgcagtggcgcgatctcggctcaccacaacctccgcctcccgggtttagcaactctctgcttcagcctcccgagtagcccggattacaggctcgtgccaccatacccagctaatttttgtatttttagcagggacagggtttcaccatcttggccaggctggttttgaactctttacctctttacctacctcgtgatccacttacctctgcctcccaaactgctaggaatacaggcgtgagccaccgcaccaagctattctttttttcttttttttctttttttggatagagtctcactctgtcgcccaggctggagtgcagtggcgtgatgtcggctcaccgcaacctccacctccccggttcaagtaattatcctgcctcagcctcccaagtagctgtaattacaggaatgcaccaccacaactggctaatttttttgtatttttagtagagacggagtttcgccatgttggccaggctggtctagaacttttcacctcaagtgatccgcccacctcggcctcccaaagtgctgggattacaggcacgcgccattgtgcctggccaaatttttgttttcaatcctctgtgcttatttttaattatctttaaaatggagaaaaaggtaaacctgccttaggtaactgtaaagttaaaaagaatgaatatgcataaatattttagaacaatgtctgacatactttttttttttttggcagagtctcactctgtcacccaggctgtagtgcaatggtgccatcttggctcactgcaacctctgcctcccgggttcaaaagattctcccgcctcagcctcccgagtagctgggactacaggtgtgtgccaccacacccagctaatttttgtatatatatatattttttaagtacagacggggtttcactatgttggccaggctggtctcaaactcctgacctcatgatctgcctgcctcagcctcccaaagttctaggattagaggtgtgagcctccatgcccggcccatactagctttttaatatatgttaactacttttgtaatgccaaagtaggtggcaaaggattattggagaagagaggacttgagatgtgtgttttgaaaaatactaaaaatttagttaagtgcctatatggaaatagcttgaacacatcatgagattaagtggtgtgtgatcgtcagacagtgaggagactttaccagttagattggaggtcggctgttggtgaaggttagaaataaattgggtgagatgagtgaggaaaaatctcagaaggccttaggtttaggatggtaagcaataggatgggatgtgtggggattccacgtgttcgtaggtaggggaatacaacatacatgtgatttttaaaataaacttatagagttttcaggatacattgccttactttagcttaaaaattatggatggaatagtggaatctttttatgcaaatccttctttcacttagaaatagaaatttctatttcagggcaatttctatttcagaaagtccaagacttttctcctccataaagttttctcttctgattcatattacagtggttttctttttgtttgaatttcttagcattcaaaatgatgttccttatatttgtatcatccatcatgatcttttaaggggaaatttaaatttaagatacgttgtcaaatcgcttaatgttaatctattagaaaggtgttattctgaatgcataaaatggttttgctttaaatgaggccctccaaattaataaaactgctcttcctgggaagcttctaagttggttctgggaaagcaagtcacacagagaaggtccaaaaatatgttatacaccacatatattaacaaattaagacataatttctcaaagcaactccttggaaaagataatccttcttgactgcattaagattcagtatttaagttagaaacaaccatcatcatttatagtgattcaaacactatctagcatattaaaatgtattttgttgtcatcatacatacaagctccttgagagaaaggatcatgacttaactcttgttggtgtagctcatagggccactgtgggtaccgagttgatgctttatgaattcagtttaaattagaagaatgtaggcaatgggattaccatttgtccagtaacaaattcagcacaggtattctgtctctctatttcccagcctgagtcagcagtttcttttagttttgatggccagcaggagtaaaatagcagcaaagatctggcatttcagtggcacaggtgattgtggaaaattactataatctaggtggactcgattctattttccccttgctaggtactgagatattgtgtaactttctggacttttgaattatacttctcactaatctagcatgagaatgggtggatagtgtcaagaattctacttaaaaaaaaaaaatctagtgtactcttgtactcaaagggatgagtacaatctatcacagggacacaaatgtgaccaaaaaagtggttaaaataaaatatgaaactgaagagaatgaagatttgagcatgaccttctctgtatcttctttccaaagtgttttcggatctcttatgaaggggatttaaaggcttttctacaactgctactgcttttgtcaattcattcattcaagacacaccaataaacatgcacgagctcctcttgtcctcatagggctagagaatgagataggtgcaaagtttattttagcagaaggctttcttttcacaaatcagaaattccattgtatgtattcccttaaataactggcaaggggaccatcggaatgagctatggcaaaaatccacctcagtctttacagcttcagggtgatggggccccagatcagaattgtaaaatagtttagagaatcttggaacataaaacatggtgcagaaaaaccaaggaagatttaatcttatgtatggaaaggtggttggtagtggagggggcaatggaagagagtggcttgggatcatcattaatcattatttaagtacctataaagtgaaaatatccttctggaattcactgcaagtgacactgaattcttctactaagcaaatatgtgatgagttgataaaaaagaaggtcctgaactcttgacaacagatataatacagtgaatacagaaaatcaaaaacatgctttctatctgactcaaaataaaggtgcacttaaacttgtaaaagacaacatttttatttgaatgatatgacagaagtgtcacgggagtgttacctgctataaagaaagcctaagaattattacctttattagaccagtgacactgagctttagccatacatttctaacttctgtccctctacagagacaattttcttttcttaaataaactgtcatgctagtgttaatatattgttggctctctcatgctctgagaatactgctgatataaaacgtgtatatgttagattggtaatagtatctttagtgtagctgactagaacaaatgtgtttccctcatggctgtgctaatgtgataaaggaaaattggctgttcatcagcttttggctgggtaaagacagtagagatggaaccacattcttttttatgcattaataccactgagaacttttcactagttatatttcatgtgcctgcatgttgtgcaaagatgttgtaaaacatgagataatgctacaaataacaaagtagaaaagcctgtatcttttataatgataacagtcaaacaccaaatgacagtaacaggctgtaaaaaatgggatgcaaaaaaaatgcagccctactacccaacaaagcggaatatatccaggcccttgaggacttggtatatgatttgaggtatattaaagctttgttttaaaattaaatcaaatgcaacactagatcaatggatttaagaaagaacatagtttaaatgaaagtagggtggttagaatggagaaaagccattgtgggtaacttcttgaaataatccgtattaccaagtaattattgtagtaacttcctgttttttttgttttgttgtgttttgcttgtttttttggggggggacattgaaaaagatttttaaggcaatagtacacatgattttaagatgtttgagaataaatgtttatcttcattaattattgcaagtctttttaacataaaagcattaaaagtataaccagtttcaggctcacagcaaaactgagtggaaatttcagagatctcccaaacatgctgtacccccatgtacccacagcctccccctctattaaagccctgcaccagagtggtatatttgttacaattgccggacctacactgatacatcattaccactcaaagtccatagcagaatagcatgttgaatgttttgctatcattttaattaaaatgttaacatccaacctttcctttgcatgaccttaaatctcactctttcctcccctctctcaacccctcccctttccagagccttttatttgccatttcagctccttcactaattagagtaccaattattcctttttcatttaagctaaaagcacttgaacaaaaagactatttgcagagatgaagttgatgtccaaacagctgattagtttatttagaagtgtatgcaattaaaaattttgtgcaggtatctatgggtgttttccataaaagtttgatagcattggctattctgggctccagtcgcataaacaaaaatcccatagctttttaatcatgtaatccaagagttatcaagctacaacctgtgggtcaaattggctggccacctgtttttataaataaagttttatttggacacagccatgcccatttgtttatatattgtctgtggatgcttttgcattacagcattagagttgggcagttgtgacagtaaccatttggcccataaaaccaaaccatttgacttgcagagaaaaaaacattctctagctatttacagaaaaaaaaaattgctaatccctaatatgtgcagttattaggctacttgcttgattgattagtctagaatatgattggcaactttttgttaccctacattggaaaagtatatctgaaaatcaccaaccggataccaatacccaagacagtaaattcaagaaatatttgatcctagtaacttgaattatatccacatgcaattctttgttgttatatctggttttaattatttctttcccttgtactcattttgctctatttccaaatatagccataacaaatttaatttgtatttaaagaagtaacatatcctcaaaaaccctgtaaaacatggcaaccagagctgttacatgtatgggacaaactattatgtatacctgtgaacaccctgggagatatcatcacagcacaaaatgacactatataggtttatatctagataaacacatggagatatcactgagctattaaaataatgttttcagtcttcccagctgaacaaagtaaagaagaaagaaagttacttaataaaaactgctgaaatgtgtttaatataaaataaaagtttatgcacttaaactaataatggtggtaatttcttacaggtgcatcagacaaaaatcagcttctttatcaatggcgtggagaaggatcatacacctttcaatgcaagaactctaagtggttcaattacagattttgcatctggtactgtgcaaataggacagagtttaaatggtaagtttctgacttcagaatgttatttatttcatccaattacattgttcttaaaaatgcatcaaacaaataatattttaaaatatctacgtgtattcatcttctagggctactgaacaaattaccaccaactggatggcagattaatgaaagtaaaatttattttttcacagttttggaagctggaagtcagaaattaagggttcagtggtgttggttccttctggaggctctgagggcaaatctattccatgtctctcttcgtggtagctactggcaatccttagtgttcctttacttgctgcttcctaactgcaatcttgcctcagtcttcatgtggccttctcctctgaatcttttcccctttacctctgttataaggacacttgtcattggatttagggcccactcacagtcaggaggatctcaccctgagttccttaacttaattatacttgcaaagaccctttttccaaattaaagtcatagttacaggttccagatggataatagatcttttgggatctactatataacttactacatttgggaagctttcaaatataaacttctttattctgatcagtttttaagtaatttcaatgtgtaataaactatatttcctttctgtctcttttctgaggggtttgcattttcatgtagagaattgttaaagtagaactacgaagtattagatggaacctgagaaatagtattgacatgtaattaactggactgatgtttacatttactacattaaaaatgggccatatagtttaagaagatatcatatactatatattgaataaaaccagaagttgaaataagaaattatcttgaaatatctagtacagtggtctttaaaatgcctgcatattaaaataaaaatagtattttatattattatataatatatgctcattataaaaaaatctaaacaatatggaactctgtgaaatagaaagtattttccatatttctatcttcagagatagatataatttaacttttttatactcctacagatttttagtacatttttagctagagatatagttataaatacatttttccaaaaataaaattacaatacatatgcttcctctgagccttctaaaaataaatacttctccttcaaatgttataaacaacgtttcatgtcaatgtatcttctcatttagatatatgttctcatttaaaatggctgtattctatgcaattgtatagttgcaatccatgagatttcttaagctcctataatgaacatttaggtttttttaatgtttcagtgcaattagcagttattttatggaaaatattatatatatatccacatatatttatatatctgtgtctatatctacatttccatttatatatatcaaccatcaatctatcaatcatatacatagatgtatacatacgtacatatgtatttgagcagttgcctgattgcacagttccttaatatcctatttggtgccaacctgcgtgaattcatatcccatttcctcacttactagctatatggcctggcaagatattttaatatctctaaagtgtagtcaccccaactttaaaatgatgatgatgatgatcataatattgatttcccatagggccaatgtaaggatcaaatgaagcaatgtcatgtaaaacattactgtgtttcaagcacctggcatgtattagatattcaatatttatttgttaaatgaatgaatggatgaagtgctaagcacaatgcctgtatataaactatattttctctttcttgggcatggggctggattttaatgtacagcattgttaaagtaggactgtacagtattagatgaaaactgagaaataatattaacatataattaactggactatgtggtttatattttcgcacactaaaaattggccatgtagtttaagaagataacatatatgctatatattgaaaaaaattactaaactatatcagtaaataataataatattattattttattattttttttttttgacagggagtttcgctcttgtcgcccaggctggagtgcagtggtgcaatctcggctctctgcaacctctgtctcctgggttcaagtgattctcctgcctcagcctcctgagtagctgggattacagatgtgcaccaccacgcctaacttttgtatttttagtagagatggggtttcaccatgttggccaggctggtctcgaactcctggcctcaggtgatccacccaccttggcctctcaaagtgctgggattacaggcgtgagccaccgcaccctgccgtaaataatactattattaatgttattataattatttcctaaaaataaatccatagaagttgaatggctgggttgaagtatatggtcattttatattttaatacatattacagagattgctctaatgcataacaatgggctacctccagaaaggttgtgaaaatttataacctcattaaaatatatagccaagtacttgtttccttaaacactaactatccttacaaattatccacttttttttcacccttgacattcctctaagtgaaaaatattgttgaatgctgactcagaattatttggccattaatgagtttgagtagctttttacgtatgtcttgatcatttgcatttcatttatgaattccttattcatacaatgtgtccatatttatactctataattccttatttatttataaaaactcatttatgttaagaatattatgttgtataagttttcttcagttttttgatggcttatgaactttgtggtctagatattttaaagtaatcctttaatatttaagcaaaataaaacatgtatgcaagatagtgcataaatataaaaggtatagcttgatgagtttttaatatttatatacacctgtgtaactctcatttaaaaaaagtcgtagaatatttccagaatctcagagtcccctaatgaacatccactgtaaagataaaaacagaatagcatcaatgtagccctctataaccatagattaatgttgcctgttctcaaactatcatacaaataaaatcatgaagtaggtactcttttgtgttctttttgcttagcactatgccaatgagatttttccatagtgtatgcagttatatctttagctttagcaaataattctgtaaagttttccaaagtgggtgtcccaacaagcaacatttgaggatttcagttgttccacatccttatcaactgttagttttgccagatgttatcattctttgccattcttgtagccatgtagtgcatttcctgatcattagtgatactgagatcttttcatgtgcttatttgccaaatgaatatgcttttttgggaagccttttgccaagttttaattggacagtttgtatttttcttaataatttataggaggtcttccatattttgaatatgagttctttgacaaatacatgatagcaaatatggtcttctgggctaaggcttacagtcacattctcttgatggtatttgtcgataagcagatcttcttaattttaatgagtctaatttagtcattgttttatacttaatactttttgtgttctgtttagactatttttgcaaaccctgatatcacgaagatatcctcctacagtttattcaggaagctttattattttacttttcaaattttggtctatgttctatctggaatagattttttgaggttatataaggtaggggtcaaaatttttgtcccacctgaatgtgtaattaacctagaaaaccttgcctcttgaaacaaatcaatgtttctaccattctgcagtggtaacgttgtcgtgaatcaggtctctgtatatgtgaagatgggtttctttctgaactttctattctgccccagtgatctgtctgtctgtctatacttgggccaaaatatttagttttaattactgtaacttcatacatgtcttcatatctagtagttctccaactttttttcttttaagattgccttggctattatatatgaattttagaaacagtttttcaattttcataaaaaattctgttgagatttaaattactcatttgtatttaggagaatgggcatctgaacaatatcaagtatccagcccataaatgtaatatattccttgatttctcccagcaatgtttttagttgtctgtatagaggtctcactcctatttgttagacttgttcaaacatattcattggttttccttcttaatagactatttttttagagcaattttagagtcacagaaaaattgagtggaaagtatagagagttccagtatactctctgctcctacacacgcacagccttccccattgtcaatatccctcaccagagcggtatatggtatatttgttacaattgatgaacctacattgacacatcattatcacccacagtccatagtttacattaaagttcactcttggtgttgtacaacgacaagtatccactactccagtatcctacagagtagcttcactccctaaaaatcttctatgttcctcatattcatccttatctctatcctaacccctagcaatcactgatcttttcactgtctctgtattttcaccttttctagaatatcatatagttgggataaaaaaatcatgtatcctcagattggcttgtttcactgagtaatatgcatgtaagatttctccatgtctttcatggcttggtggttcatatcttcttagtactaaataatattccatggttagatatagcatagttgatttattcattcacctactgaaggacatcttggttgcttccaagttttggcaattatgagtaaagttgctataaacatcagtgtgtaggtttttgtgtgaacataagttttcaacttataaataccaaagagcgcaattactggatcgtatggtaagatatgtttagttttgtaagaaactgtaaaattgtcttccaaaatgactatatcgttttacattcctatcagcaatgaaagagagtccctgttgccccacatcctcaccagcatttggtattgtcagtgttctggctttttggcctgttggttttcatgcaattatacttagtattgtttttgaacttcatttgctaattttgttactattgcattaaaatctaatcagtttttatatttacctatgtttagtgaccttgccaaactcattattatgataggtacacaatcctatcatttgcacatatcaggaactcaactctttttgaatgtttgtaataaatgtatataatggacatgccataaatatctcctgtagatatttttgtctgatgcacttattaattctgaaataatataaaatgttattttgtttttctgtatgacctgagttattagaccaatgtctagttttaaaaaagaaggtatatatttttgatattcaaaacactgtggttaaattgccaagctctggtttaaatataacccaggtgtgcttctttgatcaaaatattaactctctttaagtctggtttctaatctattaaatggtggtttaatatataattcataggaatcttataagaattatgtgagatgatgtatgtttagaatataagttgcttgttgtatagtaaatgtgcattaagtggtaactatttttaaactctttgaacatcaattttcttattgtgaaacaataagatagggataacactatatttccatatgattgttgtaccaatcaaaagagaaaatatgaagaccgtattactttagtttgtgtatgctcttagatcaagctaaactcatgtgaagaagcaatattttaaggaacttatatatttaggaacttggtttgagtaattagtataatgcataatcttataaaatactctgcgtgaagaatttttaaataacacattaaatcttgtgagccttatttcaatatttaatccccattagtacttctaaaagtgttttattgcaccaaatgttgctcaaagtatttgatagcgccataaattagtcccctatgcactgcagggttaaaatggcttgcttctattctacttcagtatactaaatgttggattaatgcttcaaaagaacagtgtgaactgaagatgatatttttaaactgtgtagaaataaatttcactcctgattagaaaacatgtaacaggaaaccggtttatttcaaatattatttagttttcattacaactttctcctttatgttcttgacatctgagagctacagaaggaaaaggatattttaaataatttttatctttattctatcaatttatatgtacagtcgtacctactgtatcttttctctaattagagatggcgtatagactggctcattacttctgcctaatgagccaggctccatgccacctctctaatcagaaaagagataggtacagaatgttcctatggacttattataaatcattttctttctcttacttgctcctttttttaatcaaaaaattaagtcactgtcctccatacttttgtccatatccaagatggtttctttcaaaagaggtaattgtgcaagcgattactgagctgaattaaaggtgctctcatgcagtgccaggccggctgtctctgctttggaacagacactgcctcaaacacaagcacatcaaatgaaggcctatagcagatcaagatggatcttttctgtctttctctgattaggtttgacttggttctctgtttctgcacccagaaagtaacaaccttccatatgagtgttggctactacagagctttttctttgagtcttatctctagcataactctctagaaaaatgtgttgccagtgacactttctgttactgcaggacttgtctttgctttccctggaaaagtaatcaatggaccaaatgcatgctttttactgaaccctcatttatccttattaatggtataatctgatttgatcaggctgaattttatgtatacaaatagaaacaccttagaccatctatatcaaccaaagtgtgatggctcctttttagaacattttcttttagttgtagatttattttagtgcttccaattgggtatataacctggagcacttgtgttagcagatatgtagttatgaggagtcagcaatgtcatcgtggtaataaaccatactagctctccaaattttggatttaaaattacagaactacatgaatcaaaacttttcccagttatttctgaacttgtttatcaacagagttctagttgccgattaaaggtgagaatttctacattatacattcaaatgtgcatagcactttcttaagaagatcattggtcattaaggaatcaataaatatttgttgagtgtctgttaaagtgaatatgcagggaagaaaaggatcatcgtctaaagctaactcctacttgccttcctttctgtgttttcaacgttgtgtgtcttagcccatatgcttgtacttgattctaaagttggaatgctacttctaatttctaccagtttcccatgggttcacatttctaacctctgctagatacacaaactccattttagttcagctgaaatcatgctaatttttttcagagagaattatttttgggaattagatttaaaaaaagcttagaaagtattgaaattgactaagagattggaatggaagaagagtataggaatatagtatatagataggagtttacttagtttcagaacattgcagacaaggtatctagcaatattatcagacaagttatgttgtatatttaaaatgatgttaatgtagctctctcaaccatactaagtaaaaactgctgattaattaaaatttgaatgcaaaatatgcaatcataaggtagtagaggaaaatgaaggcaagtgtttctataattctagcatattaaggacctttattagcacgataccatgtccagaaacactaaaggaaaatattgaaacatctgactattaaactgggaatttaaaattcaaacaacgattatcattttgtacttgatagtttggcaaggactagaaaagcgattataccggtgttggaaatagtttggggtaacctggcaaactatcaaaagtaaaaatgcgaaaactacttaatccaagatttctacttccaggacactatctcgagaatataattagacaaagacttaaatacatactcaaaatgttcattgtagaatgatttaaagtaacaaataactggaatcagttaaaaacttcaaaaaggaattgatttaataaattataattcatgcctactgtggaatagtatacaccatcaagaggaatgaaatatgtctctttctatgtacatggcaatgggttcatgatgtgttattacatgaaacaaacaagattgtatagtacaaaattctataaatttaatgtatatgttataaacatacatatacatattaaagttctggaaggaaatatgccaaaatgttcttcagaatgttagtaatgttaatctctatgagtgggattgcaaataattgctttttaaatttctttttgtgcaatttttttcagtaaactataattttataataagaattaaaaatattttccaattttggacaaaataataaatggaagcattttcagaatagatttattctatgaatgtaacaagttcagccagagacacctaatttgtatagtacagagggtggtcttgaaaatgttagtcatttaaattctgtacttgtcacatggattcaggaaacacaagcgttcattggacatttaactcattgtacatacaattattattactataataatttgtgcctgagaagcaaagcatgagatttagaatcagacagatttgggtttgaatgctagttctgcttcttaacagccaagtgactttggcaaagaatataacttctcaatccaatttcctaatatgttttctcatttataaaatgtgttttatacacatacttttcagggtgatcagagagcttataaataacacatgtttgattcatgttaggtattcaataaaatttcgctatcataaatattattgttaatttagttattaagtttattgactgtgatacttaaaattttaacataatggccatgaccatatttaattttttttggctgaaaatcaaaatttacttagggtgagggagaaaaaaagtccagtttagattcattatgtagcagatattttaaaattctgtgttttgtctatgtaaaccccacaaaataatttctctctctttttaaagatctgtcctttctagtgttcttcaatgtttcctgttcatcctcacttccacctgatgctatttcttcttaatccgaagaacctcccttttcattgcttgtagctcagcctgctgaagcaaattctctcagcttgtgtaaaaatgtctttacttttgcaggatattttcatttgatatagaattctacattgattactgttacttcttttagaactttaaagatgttgtttccttgtcttcttgccttcattgtttctggtgagatatcagccactatttatataaatgttttcttgtatactatatgtttctttctttctttctttctttctttctttctttctttctttttgaagcagagtctttcactctgtcaacccaggctggagtgcagtggtgcgatcttggctcactgcaacatctgcctcctgggttcaagtaattctcatgcctcagcctcccgagtagctgagattacaggtgtatgccaccatgccaatttttgtattttcagtagagaccgtgtttcaccatgttggccaggctggtctcgaactcctgacctcagatgatccaccctcctcagcctcccaaagtgctgggattacaagtgtgagccaccatgcctggcctatatattgttttccacttgatgctgttaagattttatttttatctttcatgttatcagtttatgatatgcctaggaatgattttcattatatttgtcctgcttgaggtttgcttaaattcttggatatgtacgttggtgttttcattacatttggaagttctgatagttgtatcttcaaacttttctttctttttttcctttttttgcttccttttctttcttctgtaataagactctagttagattgatgttagagcactagatattgtcccatagatattgggtacagttttgtttgttcctttgttttcattttccccactcttttttgtgtttcagtttggatactttctatttgacttgtctttatttcactggtcaatttctcttttgtgtctaggctgctgctaagcccatctagcaaactgttgatttctaaattatacttttcatttcaagtattttcatttggccgttttgtagacttcatctattggctcaaattcacccatctatttgcatgtattattcactatcacccctagatcttttagcatttatattataggtattttcaaatccctatttgataattccaacatctgggccatgtctgcatctccttctattgactctttcctctctttacaaagggccacattgtgttgatttctcatgtgtcttaaatatttttattgtatgataaacactttgcgtaaaagaatgaaagaggtggaagtaaatcatattttttggcgtttttccctttacaaagaagagcactgctggttctatgagaccttttgaatgggggtgggcagtaggaaagaaaaaataccaaactgacttgaagttgatctgtacgtgggctttactacagttttaatattatttagctcactactggtttcagatatctgtggatagaattgaaaatagttagacacatgtctggtggggcctccttagaattctaatatgtcattctggcctctgtatggctgcttctttcttactccttctatgcctgaatcctctatttcttacctctgagctaagtatgggagtagccctgggtctcgtccaatgagttacatgtccagtaaatgtttgtgtttcctacaaaaggcttattactttctagaatttaattcatttagttttttctgtgcgctctacattttgattggttaaaaaataatgactttagggcttatctggcttgttttggttgttagattgacagcaaagtgatggtcccttacaactttttacatttaaagcagatgttgaactattataacaacatctaatttatacccctttttttctttggcacaactctgtctatacttaactctccaaccctctagattgtttcagctatggctggtcactgactctgaacaaaaaaggtgcatattacttggccccaaagattattttggtagaattcaggcatcgacgttttaattacctcctctaatttttcatggggattttcagcttttgtgggccctaatttatccctgactcttaacttttatatctgtttctttggtttgcctgaaatctgtttactgctaatatttaaaactgaaacatgtttttttataaatctagccattggatcttgtttcactaatgatcatgtggcatcgtttaatctcggtgcccccagcggctctgtttgttcagtttgtatagcacatgcatctcttgtgtttctttttctgtcagatacataatcatattgattagtgtataccccttataccctgagtccaaaaattcctcatccctcccgggatcttcaaatgatttaacgactttccactatctctcactttttgatgtggtctgttccctccttactcaacttaagtttcatggccagttattataaccacttcttttcatggaactggacttccctgccgttttttcttcacttctactatgatcttggcactaccacagcataggttaaatatacccaaagaggacgactcttcccaccttaaactcatgaccatgaacttcctatgtttcctgatgctgccctgtgatcattccatatttccctcattcattcactttcctgtcttatgccaactatttatacattttcctttctcattatcctgatcctcagtgattatattacctccaactttaccataaaaattaacaaaaagaataaaagagcttctatagatttccactgctatatttatccaccactggcataccacctattaatagatctgaccaagaatatcttgcctcatttttccccaatttactgctgtattgtaaaattttcttgtattaatggaacattttcaagggaataaaggcatgttgttatttttccatgaaaaattattcttgaccctcccccatttcttctactagccattgtcttatttatttgctctccttttagcaaaacttcaccaaagtatattcaaccataggagcctttaattcctcttttcaaattccaccatctacagtcagactttagctcaccactgcacttaagctacacttgtcaaatctctactcaccttcacattataaatctaatagttaatttcaagtctttatctttttgacctattaacatcatttaatggagttgatcgctccttcctccttggtatacgttcttcacttggcatctaacactccatcatctctctgagtttctagttgctgcgtctcagtttgatttactggttcctcttcatctacttgacctcttagtattggtaccccaagccttaagacttagctctgctcccgtgtctacagacactcactcccttaaagatcacctccagtcttatagctttaaatgtcatctaagtgacttgacctccaaatataaatctccccaccccagcctctttcctgaactccagacgactctgttacatgtatcaaactacccaaagtctccatttgaatgtttaatttacatttcaaaattaaacttactttttttcaaaatggaactggttttcttaagctctctcactttgatccatatactacttcttccatggtcttcctcatcacaagtgaaggcaatttcatttttccactaagacagagaaaaagatttggagtcatccttgtcaattctctttatctcatgttcaacatttttttttttgttttgcaaaatcttgttggtgttagaatcaaaatatatccagattttgaatccttcttagcacttccactagaatcatcccagtccaattcatggttgctgctttgccgggattactgcattgtcttttaactacttccaggcactccgctttattctcaacacagcagccataattgttctgttaaatatcagtcaagcatattacttctctgctcaaaatgctctattgtttctccattttaccagagtgaaaaccaccattcttactataacctacaagacctaactgagctaacagcagttacttctctggctttatttcttacatttgtttattttgttctccttgttttacacaaattggcctctttgccgatttttgactatgggaggtgcacttctgccttgataccattcgctgttctttcaacctggaacttttcacctcctgatatccatcaggctgactcccttacctgattaggtctgctcaataccagtttcttaaatacatctttcttatcaccccgtttacatctgcaaacaccacctccccactttgggtctcattatgttgctctattcttttccatagcacttagcatctttaatgtattatagaattgacttatttttgttgaatatatctgtttttccctctataatataaaagagaaagcaagattttttttatttgcattactcactgatataccccaggatccagaagattgcctatcacatggtagctactcaatacatattttccaagtaaatgaatcgatgggcagcttccatgcagcattaagcctgtgggtgtgtggaatgcaagaattgaagcttgggagcctctgcctagatttcagaggatgtacagaaaagcctgggtgtccaggcagtggcctgctgcaggggcataaccctcatggccctagaacctctattagggcagcgaaaaggggaaatgtggtgttgcagtctccactgagtcccctctaggacattgccttgtggaactgtgagaagagggccaccatactccagaacccagaatggtagccactggcagctttcaccctcagcaaggaaaaactgcaggcactcagtgccagcatatgagagcagccactggagctaagccctgcaaagtcagaggggtagagcttcccaaggccttgggagctcactcctcccaccaatgtgccctggatatgagacgtggagtcaaaggagattattttggagcactaaaatttgatgactgcccttttgggtttcagacttgcatgggggctgtagcctcttttgtttggctgatttatcccgtttggaatggaaatatttactcaatgcttgtatctgaattatactttggaggtaaataactgggttttgattttacaggctcataggtagaagggaattgccttgtctcagatgagactttggactttggagttaatgctggaatgagttaagactttgggagactgttgggaagggataattgtattttgcaacatgaaaatgacatgaaatttgggaggggccagaggcagaatgacatggtttggatctgtgtccccatgcatgttcagttgtaatccccagggtggaggtgatacctggtgggagatgattggattctggaggtggatttttcatgaatgatttattgtgatagtgaatgagttatcacaagatctggttattttaaagtgtgtggcacctcctcccactttgctcctgctttccacatgtgatgtacctgcttctccttcaccttctgccattattgtgggcttcctgaggcctctccagaagccaaacagatattagcactatccttcctgtaaagcatgcagaactatgagtcaactaaccctcttttctttctaaattacccagcctcaggtatttctttatagcaaagcaagaatagactaatacattatcctttgttactgatgtctaaaaatcttttttaaaaaaattaaaagcaagtatattaagacagtaaaggaataaaaaatggctactccataggcagagcagccccaaggactgctggttgcccatttttatggttttttcttgattatatgctgaataaggggtgggttgtttgttagttttccctgaaaggggtgggcaattcccagaattgaggatccctccctgttttaggccatatacggtaacttcctgatgttgacatggcatttgtaaactgtcatggtactgatgggagagtatcagtgaggacaaccagaggtcactcttattgccgtattggttttcgtgggttttagctggcttctttactgcaatctgttttatcagcaaggtctttatgacctgtgtcttgagccaacctcctatctcatcctgtgacttaggatgacttaccctcttgagaatgcagcccagtaggcctcagccttattttacggagcccctattcaagatggagttgctctggttcaaaagcccctgacaattaccccctcctttttaaaagaaagctcttaatcttaagagttgtagagggatgaagatccatcttctctaacttcttcaagctgaataggggtgatgatattcctgcctaacaattagggtctcttgtctttgggatagagaggaactcaatcagaaaatgctggtatgtcaaggtccattcagaatacttgagttctgacaaaagttgatacctggaagattaataagtatttaatttaagaaaacattcggtaagcttatcctacacaaagagtataacagcaatacattccgcagcagtaaagcaaaataaataaaattatcacaactaaactaaattagaagactttccatgaactgggcaattgttagaaccaagctaatatgtggttgctagtaaatcccagtatgtgcccagaattagaatattgatccagattttgacattgcccattcattttggttttttttgaatagtagtcagagatcacttggtggtacacagaaataagcagagtctgtctaaattacagaaaaaaaaccttaaacacaactaatgagactagaatctaataacaggtgtaccatagtttttgaagcaattctttttcttttcagtctctcatttttactaaagacaaattataatagaatcgatttgtgcgcaaaaatgagctttagtcttatacttggcctgattacttgtataaaatgctaaaaaataactatttttcacataggattttaaaattggctttgatggaactttgttccataaaaaggaatctcagataagacctttttaaagctgagcccagccctgggtttgtacaatcaaatacctatgagttgggttaattcctttactcttgaggtcctaagatatcttcgggcccctgagtctatcagaaagtgacattctttacttatcacaggtcaggaaccctgtacagggcatgtgtaaacaaagaatgtgaccagttttcccaaggggtttttattggctttataagtcaagattgattccttaaaggaaagcacaccattccagtgaaagtcttggtaaaataacaaatttttccaattgtgtcctgttacaaaataaaacagatgcttattgcacttatgcaaatatctattgtcataagttaagaatactcacaaatagtttctaaattctgaagaaattaggtagaatcaaatatgccccaaattttgtttacaggagtaaaatttactcaattgttaaaaagctgtaaatagcttaaaagaaaagttgccttggctctgatagcaaaacaaaggatcagcaacattttaagcaaaaagttttaaaagattacttcagctatctattattcagcccatgcagttaactcttgttcagcttgatattcatgaacatttcagctctccatcagtactgaaagttttatcctctcttctaatgtcacaatcttcaaagttattagaaacgtgcattcaagagcacctgtcaaaatcctatagctgactctaaacttactttttaaagaggattaaaacaggtcaacaattttctatggatgacaaaaagttttagaacgacatatattaaagccacaattgataaagaaattttggttagttctgtgacatacaatgattttactgacaattataactattactgataatgtacactaagtcatatcagaattacaggactttcccataattttggaacacaaaccaataacatatttttacaaatacagtccaaagaaagcaaagaccatttcatatttttctatgcttcctgtatgatatttataccaaataacctgaatatgccattttggactttaggccacctaatagctaagagattaattaggtcagaagaagacatactttgtaattttattttggaaagcttgtcaaatattaaaggtttaaaacactggatatcacaaaatataattccaggtcatcataagtcattcattaggccaaaataataactcaaaaatatttaaaggggaaaaacctttactcattaatagagggaagacttagatctccaaaccatctgtctcttttctttcctttcctatataaaatttcttttttagaaacaacctctttgcatagttgggaatatggctaattccacatgtccccaggccttatctagaatctaaagtctccaaagtaggtaaattgaacaattttcaaaagtcaaagaagcagtttctgaccttaaagcatttagtaaacttaatatgtgacctgcctaatttagaccaaatgtctttattttatcaataatttttaaagctgtttttatttcccaaacattcctaaagtcacatgaactaaaagtgattacactttttacttttctgacaaaatatttgatttagacacttattatttttaaaccgattaatcaaagctcttttatatcacatatgcagcacatataaatacacagacagaaaaagatccagtaagatttttcatttttcggtttcttaactggattactggcttcagggtggagccttagaggaacagagccaagaatgcgtgaaatttctaaagcctaataagcaggcacagctggaaggcaaactagatcttcaggaattaagggttccattttaatagcagattctggatcccaaaaagagggaattagcccatctcccatgggagtcttacctctcagtggggagtgggggcatttccataacttctaagtgaccaagagcatgcttctctgatccaaatgtgcaaagagccaagtattccataactgccattagccattctcaaaagtgtatttcctacctagttattgcataccaaagctctttcctaatgtaaagtgatttctgatacccccaaaagtaaaaaacatcagataacgcaatgcgaaacacaagacagccttagattttgagagggatctatccatttccaattcctgggatttcatgaggaaaacagatgttttttctcaaaatggggtctgtggtgctcctttttttcccaaggagtcccaggctgttagaacttaaatatctgcttttaattaagctgacttttaatggtactgctgtttttaaaaagtcctcttaaatttcttattacctgactttagccaggcgaaactgtcaataattctggcttttgaactttatcaaaggtaacctcccaggtgttcagagaaaggaaaattcaagacagaccattgaggggaagagaatcaacaaatgttcatgcgcatatcaaaccagaaaggactcattccctaagctgggaattgaaccctgaacctgggtcaccattgtgaaaagaaagcctcagctactgagctactcactgggcagtttccattgctcttcccagaaggagtctagagcagcagattttgagcttgcaaaggttttaaatgctcaagataattttgtagagctaactatgacatgaacccccaaattcctgttttctggatggtagagacctagagaaagtaccgccatgtggtcacaaggtcaagctcccaaggacataactagccagtttgctgggccgtcttgaacagtaggcttatggggtcctaagcttgtgttctatcctaaggtacccctctttctaacagaaatatacaggaagacaaattcacagtgcaaagtacaacagattcactgtagcttaaaactagcctcacaaatcctttttcacattaatcagaactttacagaggagataaacagtgatttttaccattctttgaactagtttgcacagagagaaagagagaggacagaagtctcactggtaagaaattcttacccttttgctggcatgccaggcttctgggttccctttccctgagcagtcctagtgacccagcttgacgcatcatagccctgggggccaagctgcaacacaaaggaaaattgtctttttttctgtcctggccagagcaaaatatgtgtgacatagacattagccactctgctcagcatccaatatcaaactaacaaggctcaaatttgcccctggttggaccctgtcatcattaatccaacctctgaccagaagtttcaacatgtggtctctgggcaagatggtcaccctgagtaagagaaaaggtaagaaagggaaaggagagaaagaaagaaaagcattggctgcatacagcagggtggggaaggcaaaataatcaaggataccagagaaagaccctcccattgcgcaaaagttcaggctgccgcttgaagggatctgtcatgaagggatcttttccagtagtcccattagctctcaaacatcccccttttgggaggaaaaagctccccaagtcccacattcacatgcatgcctaattatgtcacccacagccatcagcaaagagggcaaggcagattaacccaacgagaatagcagttaatatctcgtattgccaaacccattattagctgagagggactttactgagaggggcctgaaaccccctaaatcttaggaaggactctaaccttcttaagttgggccttgaatccatgttctgtcaagtgtccttgtcttttattaagaggggcctttaaccacctctgtcttaagagagactctaacgcccctaaattaggcctctaacccatttccatcctttacccaagcaaatgtaccccacttacccagagtcagccaataagtgctgaagtctatttcctttgggtcaggggagtctcctccgtgttgtcccttccatggttcaccagaaagatgttaccagaaagaggtccagatccagaccccaagagatacattaaaacaaagcaagttttccttttgaacttgtcaaaaattccatcttgtaaaggatattaaatgttgctttaagctgaaccttgagcaaattaggtggtttgtgtgaccatacatgtatgtggtggcttcttgtttgcaacttcaaggaacaagtattaatagttcagtgtatgatgttgatttgagttgagcatttgcagtttggataatcttaaattttgacagacactagctgtggagactctttctgttactaaatccttttgttttgaagctattgccattcgtctttctcttgtcctttatattttttgtctgtttctttaagcttttattggaaatgtgcataagtaaagaattacttgtgttacttgccaagcaatgcacatttcatagttttaaatctgtaatcagcaataaaaatcctaaaatatgtatctaagaacatcttaaaaaattctttctcactcaagaaagaattcaaggtgagtccatagagtaaagtgaaaccaagtttattaagaaagtaaaggaataaagaatggctactccgtgtagagcagcacccccaatgtctaaaaatcttaacaatgataataaaagcagaaaacatatggtaattttttggcataaaacccttactgcagtgagcattaaaaacaaataaactgctttggttcttcattctagagacatcatatttaaaaacttagatttcattatttgattttcattttgttacaaaataaaatattcttagtgtcacactaaacagagatcagataattaacctgaccccatgatgcataattttaattttaatttcaatttgagttcttaatagaaataatgaaaggctgttatcatattttggttgaatggacacagatctatttttttatggtaccacattgagaatttgtttttttacatatataaatctattaatggtattgtcaaaatactgtcttttttttttttttttaagatgtagtattgctttgtcgcccaggctggagtgcagtggcatgatcgtatcctagtgcagtctcaagtaatcctcctgtcatagcctactgcatagctgggagtacaggtgcacaccaccatgcctggctaatttttttttttttttttttgtagagatggttcttactatgttgtccagtccagtttgaagcaatcctcctacctcagccacccaaagcataggcatgaaccatcaagcccagctagtcttttaagctttgttgttttgaaaataatgaggattattactttgatatcatattagaattttttctaaaaatttaacaagaaattatctttagttctgtataatctgtgggcagctatatctatttataagcatctatgccaattattactttacttctagttgtaatttaaatttgttttagttttcaaggacacagctagtcttaataacttgatttgtttttatttccatttattgagtttagcatttataataacttaaaaaaaattttatttcactttaagttctgggatacttgtgcataacgtgaaagtttgttacataggtatatgcgtgccatggtgatttgctgcacctatcaacctgtcatctaggttttaagccccacatgccttaactgtttgtcctgatgctctctctcccctccccacacctgaaaggccctggtgtgtattgttcccctcccttcgtccatgtgttctcattgttcagctcccatttatgagtgagaacatgtggtgtttggttttctgtttctgtgttagtttgctaaggatgatggcttccagcttcatcagagtttctgcaaaagacatgatcttattcctttttatggctgcatagttttccttggtgtatatataccacattctctttatccagtctatcattgatgagaatttgggttggttccatgtctttgctattgtaaatagtgctgcagtaaacatatgtgtgcatgtgtctttctagtagaataatttatattcctttgggtatatgcccattaatgggattgctgggtcaaatagtatttctggttctgggtctttggggaatcaccacactgttttccataatggttcaactaatttacattcccaccaacagtgtaaaagtgttcctgtttctccacagtctcactagcgtgttgtttcttgactttttaataattgccactctgactgaaatgagatagtatctcatggttttgatttgcatttctctaatgatcagtgatgttaagctttttaaaaatgtttgttgactgcattaatgtcttcttttgagaagtgtctgttcatatcctttgcccactttttgatggggttgttttcttcttgtacatttgtttaagttccttgcagattctggatattagacctttgtcaggtggatgggttgcgaaaattttctcccattctgtaggttgcctactcaccctgatgatagtttcttctgttgtacaaaagctctttagtttaattagatcccatttggcaatttttgcttttgttgcaattgcttttggcatttttgacatgaaatctttgcctatgcctatgtcctgaatggtatcgcctaggttttcttctagggttttaatgattttgggttttgcaattaagtctttaatccatcttgagtcaatttttgtgtaaggtgtaaggaaaggttccagtttcagtattctgcataaggctagccagttttcccagcaccatttataaaatagggaatcttttccccattgcttgtttttgtacagcttgtcaaagatcagatggttgtagaagtgtggtgttatttctgaggtctctgacctgttccattggtctatatgtctgttttggtaccagtaccatgctgttttggttactgtagacttgtagtatagtttgaagacaggtagcatgatgcctccagctacgttctttttgcttaggattgtcttggctatatggactctttgttatttccatatgaaatttaaattagttttttctaattctgtgaagaaagtcaatggtagtttgatgggaataggactgaatctataaattactttgcgtggtgtggccattttcatgttattgattcttcctatccatgacgatggaatgtttttccatttgtttatttcttctcttatttccttgagcagtggtttgtagttctccttgaggagctccttcacgtcccttgttagctgtattcctaggtattttactctctttgtagcaattgtgaatgggagttcattcatgatttggttctctgcttgtctatttttggtgtatagaaatgcttgtgatctttgcacattgattttgtatcctgagactttgctgaagtcgtttatcagcttaaggaattttggggctgaaacaatggcgttttctaaatatagaatcatgtcgcctgcaaacagagacaatttgacttcctctcttcctgtttgaataccctttatttctttctcttgcctgattgccctggccagaacttccaatactatcttgaataggaatgatgaaagaagggatccttgtcttgtgccagttttcaaagggaatgcttccagcttttgcccattcagtataatattggctgtgggtttgtcataaatagctcttattattttgagatatgttccatcaatacctagtttattgagagttttaacaagaaggggtgttgaattttattgaagcccttttctacatctatcgagatgatcacgtgattttgtcattggttctgtttatgtgatagattacgtttattgattgtgtatgttgaaccacccttgcatcccagggatgaagccagcttggtcgtggtggataaggatatgctgctggatttggtttgtcagtattttattgaggattttcgtattagtgttcatcagggatgttggcctgaagttttccttcttttttttttttttgtcatgtctctgccaggttttttgtatcaggatgatgctggcctcataaaatgagttagggaggaattcctcgttttcaattttttggaatagtttcaaaaggaatggtaccagctcctctttgtacctctggtagaattcagctgtgaatctgtctagtcctgtgctttttttggttggtaggctattaattactgcctcaatttcagaactcattattcgtctattcagggattcgacttttcctggtttagccttgggaaggtttatgtgtccaggaatttatccatttcttctagattttctagtttatttgtgtagaggtatctatactattctctgatggtagtttgtatttctgtggggtcagtggtgttatcccctttgtcattttttatgtgtctatttgattcttctctcttttcttctttattagtctagctagcagtctattttgtttgtttgtttgtttgttttcaaaaaaaacagctcctggattcattgattttttgaagggtttttcgtgtctctctctccttcagttctgctctgatcttagttgtttcttgtcttttcctagatttttttatttgtttgctcttgcttctctagttcttttaattgtgacactagagtgtcaattcgagatctttctagctttctgatatgggtatttagtgctataaatttccctcttaacactgccttagctgtgttccagagattctggtatgttgtttctttgctctcattagtttcaaagaacttcttgatgtctgctttaatttcattatttacccaggagtcgttcaggagtaggttgttcaatttccatgtagttgtgtggttttgagtgagttttttaatcttaactctaatttgattgcattgtggtctgagaaactgttataatttcagttcttttgcatttgctgaggagtgtttactaataactttttaaaatatcagtgatttttccaggtaatagacatttatggctttgaaatttcaaagtatgtttaaacaaaaaaattcatcaacaacctcctcccacattctgcatttacatttatcattatcatgtgtgttcttatacttttattattagattgaaaaatatacaattgccattcttatagattaaaaatggtcaaacattggctatttcaaatagttcaatatgtaagtatctcaaaataatataacacatgctgttatctttatgttgttagtatttatgtaagtgctcatatatatatatgcacatatataaaaatacagagtatatcttcaatttgcctttttcataaataatttttctgagaattacccattttgatattttgttcattcattttagtttctctattagtattccactttataaaaaaaagtatggattatgtatttgtttccatgtggagagttagcttttctctttatataatttatagaagattgcaattaatattttgtatgtctccttgtgtgcatttgtgagaatttgcacagaaaaagcacagtgaaaggtatcataggcttcttaagtattcttatcttccattttgatatatcgccaaactgttatctaaagtggttgaaccaatttgccttcctatggcaacaggtaaaatacccatttgcctgtgttatcaacatgttttgttttccaacatttttgccaaaatcatgagtataaaatactcccttattttcgttttaattttaatttctttagtaactattaaaatattgaaacatatggcatttgagttttcgcctctgtgaattgcttgttctggtatatctttcattaaattttccattgcatttccttgtcagtaaaagttacacttataatctgcattttacatgttttaattatattgattgtaaaaatatttccttcagtggtttgacttttaaaattttttgtatttttggtctgtcacacaagagttttaaattttaacattggcgaatatatcagttactttttatggttcagatagttttatatcttacttaagaaattctcttttatcatgatatatattgccttctattttttctgaaattaatttttgtataatgtgtgaggtagagatttaattttaacttatctttattggcacattcttgtcccactgatttttattgaacacacattatttcctcactgatttttaaagccacctctactgtatctcaagctccaatttgatggtagtgtgtttaacatcttgtttcagaggtcaatttgattaacttcttgccaaaagctatagcacttgattatcttttgatatcttgcagtggattccttcttaccagccttcttcagctattgttaggtcttactcctccaaatgaattttaggatcagtttatataaaaatgtttattgagattttttattggaattgaattaaatttatacaacagcttagggataatttatattgttatgctgatttttttcatccatgatcatagtatatcattctatttatttagatcttcttttatgtcttttagtaaatttctataaataaaatactcataacttataataaaagggataaatataaaatttattcctaggtatctcaaggttttggtgctattgtaaatagtatcttttattaaattgcattttatatttattgctgatataaagaaatattataaattgttatatatcattcttatttccaacaccattttggaacacattaattcgaatatttgactatagatttatttgaattgttgaggtagaaaaccatgtaatttgcaaataatatatttatgtcattctaattcttatggattttacttcttttctttgtctgattgtgaggtctagacattcctttaacaatcttggaaaaaaaagcagtgagagcaagcatcctcaacttgtcattgctttaatggaaatggctttacattttttcctttaaataagatgtttgccatatcacgttaaaaactttcccacctattcctaattgtttagggttttctacttgtatattatgtatttttcaagacatggcagatttaatttgttgagatataattttcatgcctatgctaccaagtgagattggtcctgtcgttttcctttctcttaatgtccttgagaacatgtttcagctctcccatttatgacctgttttaccttgggcaaatttcttaatatctatatgcttcagtttcctcatctttaaaattagcatcaaaagaatatctttccatagtgtttttatgaggattaaataaaataatatacataaagcacacagaacagggcctgctactcagtatgcaatagttattagctgtcattgtcatcattaatattaagatattttaaaacacttttcccctaaaatacttagagtactttgatgcatatcctaagatctgtctctggctgctatttctggacatttctttgttgtaatatttctggtagctcttacttgtgactgtgaattgtagacatttgatgcccacagactattcagctctttcaacttctaccttgttcctaaggaaatctgaatcaattcatcagggtctttcctaaagaaatttgtcgaagttatccaatccaatgccacgattatatttcttcttgtatgattgtgtttttgttgtttgtcaaagaaatttttgcccaagtcaaggtcacaaagaattttcctgtaattttttctagctatattatagttttaggttagttctattatccatattgagttaaacttttacataaggtgcatgatatgttttcaggtgctttaaaaaacataagatatccaatattccaggaccgttcttggaaagaagagtattctttttccatttaattttctttgccacttagttaaaatacagtggactgtgtatgattttattatcagcattttcattgctactgaaatgcagtaggtatgcaattgattttcatgtattgatattgcaacttgcaactttgctgaactcatttataattcctaatagattttagtagatttcttagagttttctatgtacaagagatagttttacttctactttttcaatatggaaagatttatttcttctgcttgcctatttgccctgtctggtaactacagaaaaatgttgactagaagtggcaaaagtggacattgttatcttgttcctgatcttagggaaaaagcattttttcaccactaaatatgatgttagctgttggtttttcacagataccctttattagatgaggaagttgtcttctttaatagttagttgctttttaaaaattttatcatgaagtgttaactttgactatgtagctattaagatgatcatgacgtttttgtcctttatttttccaagtttgtgtattacttgattacttttcgtacattgaaccagccttgcatccttgtgataattccacttgctcatgatgtatgatcctttttgttagtactgtatttggttcactagaattttgttgaagacttttgcatctgtattcataaggcatattggcctatagttttcttttgatgtctttgatgtttttggtattagggtaatactggtttcatagagtaatttggagagtgtttcttcctcttctattttttggaagggcttgtgaagtaatggtgctacttcttctttaaatgtttggtagaattcgccaatgaaagcatctggtcctaagcttttctttgtggaaatttttaaaaaattactaatttgatctcttttagtggtatagatctattcagattgctaatttcttcttaagtcagtttacatagtttgtgtgtttcttggaatttgtctattttatctaggttgtctaatttttggcatacagttgttcatagtatcccttatgatccttttttgtgactgcaaagtcagttgtaatttcccttttttaattcctgattttaatcattagagtcatctcttttcttggctagtctagttgaatgtttgtcaaatttgttaataatttctaacaatcaacttttgttgtttttcttgttgtttttctattctctattttatttgtctgctcaaatctttataatttcctttcttctgctagctttaggttgagtttgtttttctttttctagtttcttaaggtagaagattaggttattgatttaataaatttctctttaaatataagtgtttacagctctaaatatcactttaaacactacttaaatcccataaagtgtgatatgttgcatgttcacttccattaatctcaaaggatttttaaatctttttgtaatttcttctttgatcattagttattaggaatgggttaattttcacacatttgttaattttacaaatttgcttctgttattgatttctaattttttctattgtgatccaagaatatactttgcatgatctcagttattttaaatttatagagacttgttttatggcctaacatataatctatcctggagaatgtaccatatgcacttgagaagagtttgtattctgttgttgttgggtggagtgttctgttggtgtctattaagtctaattggtttataaagtcattcaggtcttccatttctgtttgtattctgtgtagttgctctctccatgattgaaagtaggatattgaagtctccactattgttgttaaatggtgaatttttctctttaaatctttaaatttgtcattttactgttgttagacacatacatgattataattgttttattttcctgatggattgatatcttaaaatattcttgtctctactaaaaattttgtctaaagtctattttgtctgatgttagcataggagctcaagctctcttttggttattgtttacgtggtgtatctttcttttcattcttgaacattcaatctatttgtttcctcgaatgtagagtttgtctcttgcagaactcctatagggggtcatgtttgtttgtttttccattttgtaaatatctactttttgattgaagtgcttaagccatttacatttagcacagtgactgataaggtagttacaatgtcactttgctgttggttttttaaaatatgatttatgtcttctaaatttctctattctttcactgtcttctttgggttaaaaagttatcttctagtgtataatttaatacccttgtcatttattctactatgtttgttgcccaggatgttatcattaacatcttaattcataaaaatctaattcaaattaataccaacttaattttaagagtatgcaaaattttgcacctatatagtttttgttcactctgctttcttttgtgccgttattgtctatggagattttttacattggatgcccatcaacacagatatataattattgctttataaagtcatcttttaaaacaaatgtgagagagaaaaagaattacagtaaaaatacatttataatctttttaaatatttacctatttaattacctttacaggtactctttatttcttcatccggattacattgctctctaatatcctatcatatcagccagaaggacttcttttggtatttcttgtagagcaagtctgatagtgataaaacctctcaatatttctttatctggaaatgtcaatttatcctgcatttttgaaggagagttttgctagaaaaaatagtttttggtgtacagtttttttttacgactttaaatatgtcattcttctcccttctggacgccatggtttcttcacaagaaatctgtggttaatcttattgaagatcccatgtaggagatggccttttctcacttgctgctttcaagattttctctttgtctttgtctttcaacagtttgatttttaatgtgcctagggtgtggatctatttgaatttatcccacttgcagttcattgagcttcttggatgcatagattaatagttttcatcaaattttggaagtttttggtaattatttctctaaatattctttcagtccttttacctcttctctgaaactcccattatgcctatgctggtactcttgatggcgtcccacagctttctggggctttgttaatttctcaacattctttctctttctattgctcacactgaataatctcaattgacctgtattcaagttcattaattatttcttctgatcatttagatctgctagtgagctcctctagtgaatttttcatttgaaagttttctattttctatttattttttctttttttgatgaaatgaggtctcactacgtttcccagggtggtctcaaactgctgggctcgtgatcctcccacctcagcctcccaaagtgctgggattacaggcatgagccaccatgcctggctaaaaattttctatttcttttctcatattctatattgtctaaagcatcattgtcatactttgctttagttctttggacactttgttttgttttgtttttagttatttgaacatatataaaatagttgatttaaagtctttgtctggtaagtttaatgtatgagcttacaattgacccatttccattgcccatttttcttcccctgtatattgtttgtaggagtttctttgcatatgccatattctttgttgaaaaccagacattttaaacacatagtgtagcaaatctggaaatcagattatttccctttccagagttgttttgttgctgctatttgtcactattactactgtttgcttgtttagtggctttcctgagctaattctgtgaagtctgtttctttgtcatatgtgataaatgaagtcattgtttgctcatcttagtagtcaggcaatgactgaacagagaatttcttaaatgcctagaaccaatacattttccagtctctggtgagagatctgtacgcatgttgcagaatgccatcaacactgaggcagtttaacactctcctttagtccccacttcctgcttgtgcagagcctcaaagtcgagctgaggtgagaccttaggactttctcaggtctttctttagcatgcgcatatacctgagcacatacttagccttttgcatgttcataatcttgtagattcgcaggcattttttaaggatttgcaaagcgtttatggacatgatgtttcacatcttctccttttaagtattttggattgtttgttgtttcttctgactgttgttactgcctgggtcaactgcaatgttaagcagttgccagtgattatttttagcaaataattgttttaaacaaacagagtaaatgctgtttccagtggatgaactctgagtcaattcaagccttactagtggggctttccatggtacttccaggcagatcgaataatgacaatcatctgaggatagagctttgaaacagctccactcccattctgatcctctagcagtaactaggctgctggttttcaccctgattgcaaactgttcattttcagggcttccagagagtggcagagaggagtacgggaataggaaagctaaaatgccatagaacatgttgttcttaccaatattcagtcatttaaaaaataaacactgtccacattgttgcaagtctttgctttatttccagagttctcaataagttgatgtgatattctttgccagtgttcccattgcttttatggaagacagactcttccattgttttcactctgccattgctgatgtccttttattcgtttcctcaatgtcttatagtttttacctatatacattgccttgctttaatagatttataactaatatttcacattttcagtgctaataaaatagtatttaaaagttttaatttccattggttaatcactagtatatagaaattaaattattactcatttaacttctatcaaacaaaattaactaattcacttgttatttctaatagcttttatgtacagtcatggaaattttctgagtagataattatgctatctgcaaatgagagtttatttctttccttctgattgttgtgacatttgttacttagccttattatctgtttttaccctgatttatatgttggattacttagttttcccatttgactaattttgttgtgccacccagttgtaatgcataacaacttctttccagtcatcacctgtctattttctgactagacagctatgaggtctttcttgtatgagtcatgtctatttccttgatcaatttatataatttagacatatctttgccatatgaatatttttcaaagaagaatttttatggaatgtttatcccaatgaatatctgttgttaaaaaattggcaagtagcaaaggaataagtaaaatttatttctatggctgtccttgaaatatttgatagtattctcacctcaaatcataattcttttatttgggatggatgattcacattaactctaggtctttagaaaacttgctgtaactcttttttatgaagaatttcttcaaatatgaattctttagcaatggatatgattgcaagctccaaaatttaaaactaaaatggtttttaaaggttataaaacccagcccctttattttatagataataaaatagatttcattatccccctgcagcagagcttccctttagctattattaaaatatagggagtgaattctaatttatcagcattgaaaggtacacctccacttctaataccctggtctgactgccaacatttttcacacatatgactgtaatatcctcctaactggcctcttggcttctactcttatcttcctatattctagtctcagaacttttgaataatcctgagatcacatcactcctcttctcaaaaccctccaatggcttcccattttactcagaccagaaatcaaatttcttacagtaggctattagactttgtatatataacaatttgtacctccatcctcccctctcccccagccagctacttgtctgacctaaccttctaataacctccccccttttattctgctccaggatgctagctccttgcacctcctctaacatgccaagcatactgatttagaggtctatgtgcttattaatgcctgcctggaacattttgcccctagatatacgtatgactcattcccattcccctgtcaatgccacattctcaatgaggcctctcttggacataacatccccactaaaatctagccatgctctccaacctgctctaatccttctgtttttcataaaatgtattgcattctaatatactatatgaatttctcattcattatgtttatctacgtgaatgcaagctccataaaagcaagggtattttgttgttgttgttaactgattgtacttttggcactcgtgaaagtgcctggcacataataggcttccaataaatacttgtgaatgaatcaatacgtaaaagaatgaagccaccctgacatttaaagccatggttcaggctttagcaacatcacagtgttcatcagttttgctgtctttcagttatggtaagtctttcaaaattatgaatggctagcccctgtttgttatgatctgggttctttgagataaaacacttccctagaggttatataaaatattttagacaatattttatcctgagaaagcaaattggataacatgaaatgcaggtaatttctttttttctccttgatatctcattatgttggcaaaaataggaaatgaagactgtcagttttccacggctgccatgcaaaagtactgcaaactgggtggcttctcccagaaagagaatgcctaggactatagcggggcacagaaagttccccacaaggagtatttcaaagctgagacattaggggctgtatgaggcagaaaaattggaagcagaggcaaaatgggaaccttagggctgagagagcctgaaggttgtggggcattaaaaattcatgctgtagattaacagtgtggggtgtaaaggatgctaggagaggaagaactgagcatggttagggatagttgaaggtaaagaaaaaacgggacacaggcccagcttccttgacaacattatctcttacctcataaataaaatttatgctatgaggagtgactttcctattcgtctttcctattccccaaataaaagcataggcacacaatggctttgctgtatttgcatgtattcttctcatctttcttctaagaatgacatgtccatctttctaccattccctctttgtttaactttagatcctggatccaggtcaattgatcataaatcatgttgcctggatggccaattaactgaaagaatattttaccatgttttcttatttcttgtaactaattataaattttagaacaatttgtgttggaaatcttctaaagatttctgcaaagttttagtagatttagttttgtcttcataacaccacttggaggaataattctttgcacttgtgccagctgcctgttttaggatagatagagtagagaaactctccctacgggaaagtcagagcaggaggctgcctagagcacatcttcttgtgggcctcagctcatggggtatgtggaagactgagactaatgggtagaaagagagagcctataagtgtatttttcttagactacatcagctgagaatacactaatgaagaaatatttttatatgtaatattttggttattttctcaaatatattatttaatataaatataacatgtaaatatatgaatatacacaaatatatgcatacacacactcacacacagacacatactctttttaggctcctaagtctcacactttgcttgtgagtttcttcctgattctgagatcactatctcagactacttcgtgtgctaattctcctctccatgttttatttatcagccatatcctcactctgtcccagtttcctccaagcaaccaccaaggagcagcagaaaacataaatcaaacattctttaaaactctatcaagacagagtgaaaactgaatagttaaaagaaaaaacacattgggaaaatggtcatttgatgattaaaattgctccaattttatttttttagaactattgaaataaacaattattgaaataaattttgttattaaaaatataacaaaaaacttggagtcggtagtttttctgctttattctgtctccactctcttgggcttatttgtctcagtaagttctgaaaaaatatttgccaaacaaataaaataataccatgtggattaaggttgatagctacatttgccttgaaaggtcacctaattcaaagtagattggtctttgaacctggttttcttagaagattttccctgaggcaataaaattctgagagtgaactatgatactattgatatatgtgaatgacacagaacctacaagtaggaagtcttcgatgagtcctcatttggagattttctagaacagacattaatttaactttagagagaacccaaacagatagcctggagcttggagctataacaggtgggatgtgagagtgaggaatcttccttttggcattgcaaatactctggaaattgcaatcagaagcagatgacaatcaaatttagggctgatgagataatatatctatggagttataaactagagagaaatttgacttgggaagggacttctggagaaagccatgagttcgatcagtaaataggctggccaaagtattcactttgacttaagtcctacagtgtccatggagataactatgattatttttgttattaatgtggaattagcaaactagagattgatctgtaaaagtttcaaagggcagtgacataaatatctttttaaccttaacatcttcaaaggaatatcacttaaatacttgtcaggtattgcttggtaaacagagacttcttatattatgcacatgtgtgtatttgcaggtttagagcagtttgtcggaagaatgcaagattttcgattataccaagtggcacttacaaacaggtaagcagatgttgcattgtaaacctcaagaaccgaaaggataaatgctgaattcacttaaataagaatactatgtagattataccattttttatctttataccatttggcaaacttcacctaattaatgtttacagtgtttgctttggcttagtctatggttgttattcactagtgctactcttgaggaactccttgtaatatgaaattgatcacatttttcctaaggatattctgtaagaaaacttgatatttgaacattttataaaacttgggatacaatgcttaaattttctatatgaggtagtttctattaacaatacttgagaaacttctacatctgccttttttaaattggtttgttgactttatacctactagagaatgtagaacaataaacgtgattaattattttgatacatgggaaattctcaagagactgatctattagacttggagacaagaagaatgagcatttgaagtattgtgatatatttttctattttcagtgaacaaataattatatagactcaggctagctttaatgacattatttccttatcttgagagtagatgggaaatctttcttagggcttcttaaaagcacacagaattttaaaaaatttaagtgaaattctgcttaggatgcctttgaactttcttcttcagcttatgatatcatggtataatagtatattgttgtatggatgagttgatcttatttacttctattaaaaatcaaaaagaagaatgttcattcatatttcttcaaggcagatataaattagtgtggtgggtttccaaatgagaagactagcccttgtaaatttagaagcattgcttttgatgtggttcttagtccatggcagatcattaacaatataaacattctttcttaccaggctatataatcaaggtatgcctcagtaaagggtgccatggccctggaacacagtgttaggtgtatttactgccaaaagccttactatattttagatcacctttgtctaaaatgctgaagggcaatgttgtagtaattctttgggaataaagtttttccttgggagtgaaagattttatactggattctatactggtagcttttggtcccattcaaaacttggtatcagttgaaaagaattgatgagatttaaagaaggtatgacttcatgtgatttaatgaatggaaaagctgcctgactccttcactgctccactggggtctgagaggaaaagcctggtttctctggtaagaccttgattactaattttggcctacctgaaatgtctgggaaggtgctatgtggaagaatgcctataaatagaatgactaattctggtctagaacaagtatattgcccctaatggaaaaattaaatatatctacctggaattggcattctttgactgttggcagccgccatatgatctgaagccaatgaagcattacaggatgtcaggatctgtactgatgagtcacaggaaaccattgacaaatggccttggcctcagtccttcacttaaaacagaagcagataaaatgatacttgctttcgtacttctttcccatggatgaactgaaaacattatctataactctcattgttctccatatattattgttcactctcagtagttagtttagcatcctaagtaaatgtgatcatttctatattatcacaaatagacacggtaaaatattgtggtatttaaataagtatcttaataatcagacaagggcttatgcatgcttcttgatataaataaaaagttaatattaaaatgtgtgggttttgatatacattttatgataatgaatttgtttatttggccaaaaataagttttattttatgtttcatgcatcaaattattaaaactaaatggatactcatgaaagcactaaacgagtgacattcatttgtaacgactcctagaagttctattactgttaagctctttgtccttacagtctccctcttgactcccacagagagattctggaagtcttctctggagatcttctcagattgcatgcccaatcacattgccgttgccctggcagccacccgcgggtccaccctttggcacagcggtactgcattcctaatgatgcaggagacacagctgataatagagtgtcacggttgaatcctgaagcccatcctctctcttttgtcaatgataatgatgttggtacttcatgggtttcaaatgtgtttacaaacattacacagcttaatcaaggagtgactatttcagttgatttggaaaatggacagtatcaggtaatgagaaacgataaggtgtacattaatttcctgtggttattgcaacaaatgcccacaaacttcatgtcttaaaacaacagaaatatattccctaacagttctggagatcagaaatatgaaatcaacatgttggcagggctacattcccttaaagattccagaggaggatccctccttgccatttgcagctcctggtggcccttggtgttacttggcttgtggcaccacaacttcaatctctgcctccattttcacatggtgtccttccttgtttctctgtgagcatcaattatcccttttctttctcttatataaggcccaccctattagacccaggatgatctcatattgacatccttaattatactgcaaagaccctatttacaaataaagtcacatttacaggtttggacagtagtacttggacatatctatttgggaacacaattcaacccactacaaggtgaaaactgaactaggcaattgaaccttgcctcaataaagtagtgtattataatgtatacaataaaaatatctaaaagacaacatgtaggaccttatgtttgagatttgtatcaaaatgatatttatgaaatgttgaaaataattatttttattaagtagcaaaaattaatacaaactaaggtgctttttctaaattaagaagtctctatatatgacatttatttcatagaagtaatgttctttgtttatgtctttatttgcatgttgatttataaaatccttgagcaaatgaacagatacacaattatagaatatgttgcttttaccacagggctatgaagtttctggatgtctaatacatatttgataactataattatgatgaagtgagccaatatatttgaatctaataattccatggtttgatatatactgatggttaaacttaaaactttaattacattaattaactttccattttcaggtgttttatattatcattcagttctttagtccacaaccaacggaaataaggattcaaaggaagaaggaaaatagtttagattgggaggactggcaatattttgccaggaattgtggtgcttttggaatgaaaaacaatggagatttggaaaaacctgattctgtcaactgtcttcagctttccaagtatgaatatttttaaacaattaatttaatagactgattggttattaataatgtacaagtatgctagctctctaggctggtggagacttcccttcaccaccaacttccttgaggcagattctcctaagtcttatccctaaattgggcttaaaactatgtttaaagttcttgtaaaagacattagagtgactcttatttcaatctcactgatgtttcacaatctgattttcagattgtttggcaagttatctatgtaaatagaattttcattatgttttcaaggaactgttttagtgtggctttctatgataatcctgtattgtttatatatgaaatatatggaatatgcttttcctagaatgaataatttaagcttttattgatactgtgtagtaatttctcaacattttgatttctgttttgccaaaaatgtgaatagattttcatgacatcgaatttctttcattaacagttttactccatattcccgtggcaatgtcacatttagcatcctgacacctggaccaaattatcgtcctggatacaataacttctataataccccatctcttcaagagttcgtaaaagccacgcaaataaggtttcattttcatgggcagtactatacaactgagactgctgttaacctcagacacagatattatgcagtggacgaaatcaccattagtgggaggtattattatgaattttgttttcaacaaggtttttgtcatacttactgtcttaacagcacattaagatgtcagagcaagccagatttcaagctttacattttgaaatgatttcatactctaagattttaggggaagatctgtatgtgagtcttttctctatataacattgttatatatatatatatatatatatataaaacgtattttataaataaatatatatatatttatatatacaggaattgattttcaaaagctgttgcttttagaagctatgatactctgaatctgacttagaagtgatttatccaatattttacttgatttgttctggaatataattttcaaatattctcaaaagcaaagagatggagctgaatttggagttgtaactatagcaccagagagtttttaagtacagatcttgatctacctgagttcatagtgcacagttccatgggtaatacttgtttttctttagtggaaagatctgatatgccctaagtagtttataaatgtctgatcataattgagaacatgactcacaatatttaaaaagaaatgacagctgcaaacctaggcagcatactgtctaatatagaaatgtacatatagagtatatttagaatggattgttctggaggaatgataggccttgtgaataaaatatgtctttaaaagcagaccaaaataccagtatataagcattgtttgtttgctaagtcatagcataatgaacaaagcaatactattaaatattcatcatctaactttggaaaaaaaaataaaaaaattgaaatatgttaactgcattctgcagtttattgtcaactttatattcttttttctttcttttttttttttttttgacaggcttttgctctgtcacccaggctggcatgcaatggcatgatcatggctcgttgcaacctcgacttctgggcctcaagtgatcctctcatctcagcctccaaagtaactgggactacaggcatgtgccaccatgcccagctgattttttttttcactttttgtagagatggggttttgccatgttgctcaggctgctctcaaactcctgacctcaagtgatctacccgcctgagtctcccaacatgctgagattacaggcgtgagccaccgtgctcagcctgaactttatattcttaactgtattttaaatagtgtagtaaatgccttcccttggtacgtggttggtatagatataaaaaattccatttccctttagaggttggcttgaaaattatctttacaatacacgggtttggatattggtgacagtccttctgacatttccagataaattaaaaacgtgtatggatatccacacgattaaggagaaactgattttgtatcaattaaatatacaaaaatcttccctgttaaattcacataatgcatatagtcctaggaccttaaatatattcacagttgagttggtgttccttaggagtgtgtgatgctcatgtttgcagatgtcagtgccatggtcatgccgataactgcgacacaacaagccagccatatagatgcctctgctcccaggagagcttcactgaaggacttcatgtgagttctattttatgcatggaaatctaaaaaaaaaatagtagagatggtgactataaattctatgaacttaatcttggcctaacaaatgaaaataaatttaaaaactgatatgaacttaaaatgtcaattattgcagattttttaagaaaaataacagccatcaattaagttgaaattgtagtttttaaaaataatttcagccagagaaattacaactgaaaccaaaccctaaggttcttttctcttttgtttttctttctttgtttcatcagcattatcatgttttataaaacaatttttaatgtgtttggatagcatggcactaaacaaaaaatagtttgattcttactaaagggtatttatacaaaagtatcaataaacaaaagcatcgttagatgaagaacaatgtttatgtatttatgtcaatcaaggttcatttattgctaatatcaggcattttaattaattgaaaatctatagtaaaatgatttatgagttatgttactttagttttctgtgacgatcaggggaattccatagttgaggtggaattttagcttcatctttagggaaaagaggtaagtggaaataaaatcaagaaacattcgttggtaggaatatctagcaacaacatcagaaatagctgatatgaaagacggttcagcagcagtaacaattataccaataatgagagtagataatatagactcttcagtaaatatgtttaagacaactggctgctaatttgcaagaaaataaaattagagctctactgattgtatgtacaaaaatgtatgtggcttaaacttttagtgaaaaataactataaatatattaaaataaagattagaattctatatcttaagttgagggcttttatcagctaagcaaatgaaatacaaacagaaacaaacatctggagctatgaaggaaattaatgacatattctgttatataaatatttaaaattctacacagtataagggttaacataaatgtaaggtagtgataaatgatggattgatagaaaatatttgcatcatgttaacaggtaaagagttaagattcctaacacacaaacatttacaaaatattaagaaaaatataacagtctgataaaaatgagcaaatatatgaacaagcaatttacaaatgaacaaattgtaactttaataaacatataaaagattacccaacctcagttttaatcatattcaacaattgtttttaacatttcaaattagcagaaaatataaagattggtaatatttagtacttgtgggaatataacctttaacacatcactgatgggattgccaattgacacaatagttttggggaaaatttgtccacctctactaaaattaaattttcaaatatagtgaactacattatataattgctgtcattctgaaaagcagttcttcaatgacaagtgtatggaatggtgtattagtctgtttgcattgctgtacaggaagacctgagactaggtaaatataaagaaaagaggtttatttggcttgtggtactgcaggctatacaagcttggtgccagcatctgcttggtttctggtgaggcctcagaaagcttacaatcatggcagaaggcaaagccagaagccagcctcttttaaacagccgtgtctaaacagccatgaactaacagagtgaggtctcactgctgaagggaaggcacttcatgaaggatccacctccataacccaaacatctcccaccaggctcacctccaacactggggatcacatttcaacatgagatttggaggggacaaacatacaaactatataaaatgcttatatttctatcattttgttacataaatatgggcttatatgttagtgcattttagcttttcagatggtagcactgtctcatacactcatgtatgacttgtgaacatctctgcctcttggaccttgccctacacttgtgttttagttagttacttcacttctctgtgaaatttattttaggatattatagagcatcttgctttttaaaaaaccatctgtaaaggttttggcaaattccatttctgtcttctgattcttactctgatctaatttgcttttgactgtaacattagtgagaatagttcaatggtaagaatattatctataatgcagactttctctagcacattcaaaacgtagtcccactcctcagtttcaactaagagtctttgatttagttatggcctactttctttctttctttctatgtgctcagaccaaaactttcatgttctaatttagatattcttttgaatttattttctagatcactactttatatacatctagtcctcaccattagtcaatacttgctttaaaagaagaaatcttttatggttttcttttggatttctaatgcctagagtctttgcatttgatttcattagtatattatgaggaaaaatcttttagaagaactgattttaatatgcttgattgtatggcttatcatattgtcacagaaatgaaattaattggattaacttgattgatttattcttcactgagccataattgtgtgtttaaatttttgccaattttatttgttctagattttaaagttaaagcaacatttattatatttttctactgtcttcttttgatcccttaagatggacacttacttccttataatcagtgatttctttcattaaccttgtcctctcctccacaaagccactaacaccccaattaaaaaatgctttgggatgaatttagcagggcaccttgaactgaatatgtctagtatttgcaagctacagtttggctaataccttcatatgatatgttcttttctgagcttctcttgctttctgttgactagtcagtcggtattagtctctctcatttgcttgtgacgtcctgtcttgttttatctttctgtctttaattgctcacagttaagtgttggatattttctgattcttggatgatttcatgcttccccttaaaaatagagccattaaatgaatgaaggctcatgattggtttcagaagacaagttgggattttcagacttggtctcaggtggtgaatgttggattatgaactagtgaattaattaactataatttgggttgagaatacattttaatgcttcttatttagaccttaagtaccttttgaaaacaaaaatgaaaaactaaactttttttgttattttcctccttgacatattttgatagtttatgaatttagccataaattttaaaaagcaacaaatataatttacttagcaaactttggcaaatgcaaatgcagctgcagggaaaaagtcaatagactgttaagttgaatgatttctcagtcctatgatattttcaataatgtgttgaaaatgaaaaatgattttatagaaacattcataggcatgacattctcctttgttaccattcaaagtattttaatacaagtagagacttacatatctgagaaaagtcgtcttacggtaatttgaaaatatacctattctaatgcttttcttgttgttctactttttaaaattatacgttttaatataagccattcacttcctattgggatccatgttctttttaagacctggacataatccaaaaagaatgtcttcaattccacagtgttatgctatccattaataatattacttaataaacagggcttttgtgaattatattacagacatttggcaaacagatgaaaatgtaaggactgaaaatatgccaattcttggcaattgtctttcctatgagaaagtgtttttagtagaaacaaaaatgaatgaagttgagaaaaggtgaatggtgaattcaggggcaggttcacatatttagccatcctaaggaattttccgtacaaaatactattcatttgtttataaggtcaatgtcacaaattggtggctcacaggtagaaacagtgtttaaacagttttaatttaattttctgcaagagttttcactttaaaatatttatttattcttcaatcttttttatttatttatttttttgagagggagtctcactctgtcaccgaggctggagtgcagtggcatgatcttggctcactgcaacctcagcctctcagcttcaagcaattcttctgcctcagtctcccaagtagctgggactacagctgcacaccaccacacgcggctaactttttgtatttttttttttgtagagatgggtttcaccttgttggccaggcaggtcttgaactcctgacctcaagtgctccacctgcctcggactcccaaagtgctgggattacaggcatgagccaccactcctggccctcaacttttattttaagttcagaggaacatgtgtaggatgtgcaggtttgttacttaggtaaaggtgtgccatggtggcttgttgcatagatcatcccctcacctaggtattaagtccagaaaccattagctattcctcctgatgctcttccccccacagcccccaccatccctaagaggccccaatgtgtgttgttccccgacatgtgtccatgtgttctcataattcggatcccacttgtaagtgagaatacgtaatgtttgattttttgtaccggcattattttgctgagaataatgacttccaactctattcatgtccctgcaaatgatttatatttctggtaatacacagtaatgggattgctgggtcaaatggtatttctgcctctagatctttgaggaatttccacactgtcttccacaatggttgaactatttatactcccaccaacagtgtaaaggtgttcccttttctccacaaccttggagcttctgcacagcaaaagaaactatggtcagagtgaacagacaacctatagaaggggagaatatttttgcattctatccatctgacaaaggtataatatccagagtctagaaggaacttaaacaaatttacaagaagaaaacaaccccattaaaaactgggcaaagaaccctgagttagcgagttgttgccaggggaggacattaatgtcttcttttgagaactgtctgttcatgttcattgcccaatttttaatggggttgtttgtttgagaacagttctcaaaagaagacatatgtgtggccaacaaacgtatgaaaaaaagctcagcatcactgatcattagagaaatgcatatcaaaaccacaatgagataccagctcatgccagtcagaatggcgattattaaaagttaaaaaatgacacaaatttttaattcctcacttctcttaatcagaacatagtctaacactgtgtccatttcctgccatcaacaactcactgattcagggtgacatttaccacatttacaacagtatcactcttgggcttgctacaacattcactactatgtatatccttatacatgggcgacatcactttggtgaactacctggccttgaaagactcggagcttcttaacctcctaaagcaaaactgatggatagattgagacactagaagctagaatacatttttaattattctgagtagagaaagaccagctgttcattgctatattcattgttaactcctatttcttttacccctttataaaaataaaaactcacaaataaccgaaaacaactcaagaaaatctattagcaaagacactgtttactctgagatgaaattaaagccatgcttactttttttttaattacatttttgacatctaaaaacatttaccttggggagcctcactgattctcctctgcactctttgaccaggaactccgatacatttttgtattgtactggcaattttaaggccttgactttaatgtatgatacataccataaatacttcactcatagagaatacttttagaatacttgtcgcatttctttccaagaatgaaaaaaaagcagtaaatgcttaatttactaggctcactttagaactgatttagggtgaaacaaatccaaaagcctagatgctattcattaactttcatacaaagttaaatatttcaaagtagaaattagaaatacatggtattgaacttgcatgaatcattatatatctcacaagttacaaacatgttatttataaatgtttaatttcatttgaataaaaaatagccactgttacttgcatttttaagtaaacttttaattttgagataattatagatttatatacagttgtaaaaaataatataaagacaatttgtgtactctaccaatttgtcccatggtaacatctggcaaaactagtgtttttttctttttacatcaaaagtgtgatttgtgtacaataaaatatacccacttaaaaatatatagtttgatgagttttggcatatgtgtaccctgtgtaatcaccatccctgtctagagatggaatgtttcactctcccaaacgttctcttatgcttctttgcagtcagtgctgtctctgaacccccaatcccaggaaaccaccaatcttatttctatcaatacagattagttttgcctgttccaaaatttcttagcatagtgttatttggtatgtaatattttcgtacataggcttttaaatcccacctcacccccacttttagatcattccctaattacatgtgctgttagctttactgcaacatggtatctctggcccacttaatcagaaatccattataagtatcaaagtgtatatattaagctcataggtacataatacaagctaggaattggaagcctgggtttatctgtcaactaacatatttgcaaagctataatatatttattacttctttttcttatctagtactttctttacttgatctaagagttcaagtgttgaatagaatctagttttaagaaaagtgttgtcagttgaaacttgaatccttatgagttgtctttttcctttaataactacatttacctttcggggctctggccaagagtgatgcaatgatcagtgtctcagccaagcattggcacttcattggctacttagctattctttcgtcattttgtgacatcattacctgcaagggtagccaagccttcacagagcaatttattagtaaccatgaacacttcttattctttggctctaacttatgacccttttataacattaatcatagatcttatgaattaactacaatcaaactatcagtataaatttttgttagcattataaatagcacagccagcttgaaactttttatataataagccttcctaccactcaataatttgaatggtgccaacatcacactctagaatgcttattatataaatgaatatttctgttatttttgaaagattcctttagagcaccaaagtccaaaagtatgaatcatcatgactaatttgtgtcatatttatattatatatcaggctttaccactgcttattttttctctgtttgttcgcagattttaccctaaatatattttatttatattttaattattgtaatgctagtaaattaattcatttttatataactagcattcacacagttcatattataggatctacatttgatatatgtttagtaagtcaaggtaaagaattttctttcctcactgacatgatgatattattaatctttgaaaaacacttgtactagttctttccgtgagataggtatgtgcataaatgcttttaaaatataagttgaaaacatgaaaaagaggttatgagcatggagataaattaagacagccttacagaagaagcaaatagagatagtgaaagtataaacatagtaaaagaaaagataatatttgaagggataagagtaaagaattatctaaaggtgaggaatgacatgatttttctgaatcccaagtaggctaagaaaagtaaatgcatacataggtataatataatgaatccaataatcaccaaagaccaagcagccagaaagacagaaatctgataatcaccaaagacagaacagcatcctaaaaacagccagagagaaaaatacaaagtgtaagaaattaatttctaagacactactgatatatttctcaacagccacaatgaaagccagaagacagcagagtagtgcctttgaaatgcagagagaaggcaaccaagaaatatggaattgtatttgtagtagtaccatcaattagaaacaagaaagaaagaatgcatttttagtttacagatatatatatcaatattatcaccagcagactctcaataaaagaatttttcgagaatacttttcataaggatatataatgtttccagaaaataggcctggtgtgaaggaaggaattgtgagcaagtaaaccagcaaatatgtggataaatatagaggaaaatttactgcgttaaataaaaataaggttatatgtaagaaagagtataaaaagtagcaggataccattaaatggtcattaaaaatagcatttaaagggaaggggtaaactccaacttcagctccctctagccattctgttgcaccttggggtaagaagagcagttactgagaaatacttgtaaagttcacagccaatgagcacagggctcattaaaaactgaaaactaatcctagaatcatagaacaggggtccccaacccctgggccactggtcagtagtggtctgtggtctattagaaaccggactgcatagtaggacgtgagcagctggtgagctatcattacttcctgagctctgcctcctgtcagatcagcagtgacatgaagttgtcataggagcataaaccccattgtgaactgtacatgtgagggatttaggttgtgcactccttctgagaattcctgatgctttgaggtggaataccttcatcttgaaaccattccccatgtgctgccctcacacccagttcgtggaaaagttgtcttccacaaaaccgatccctggtgccaaaaatattggggaccactgccatagaacgctttccctcccctctcatcttaccaccacaccatgaaaggcctgtttgccagagttccctttactcagtacatcatgtctggatttcaacaaaaagttacaaagcacactaaaacaccaaaaacaaacaaacaaagaaacaaacaaacaacctcacagtttgaagagagagagcaaaaatgagaatgagactcagacatggaaaggatatggaaattatcagaccagaaacttaaagcggctctgatgaatacactaaaggctctaatggaaaaagtagacaacatgcaaaaatagatggcaatataagctgaaagataaaaattctgacaaagaagcaaaaagaaaagctagagatcagaaacactttcatagaaataaagaatgcctttaattggatcattaatatttggggacagctgataaaagaatctgagtttgaagatgtgtcaatagagactaccaaaatagaaaggtaaaaagaaaaatgactgaacaaatagagcagaatatctaagaactgtgagacagctaccaaaaatgtaaatacatataatggggaagaagaagaagaagagaaaggaacagaagaaatatttggaacaataatgactaagaatttttcatattccaaatgcagaaaaatcaaagttagggaaaaatatcttaaaaggagcctggctgaagggggaacatctagcctatgaaaaagcaaagataagaattacattctacttctcctcagaaagcatgcaagcaagaaaagtggttaaatagttaggtgttgacagaaaaaaaaaaatccacctagaattctgtatcttgcaaaattatcctttaaaagtaaaggaaaaatactttctcaaacaaaaaccagtagacttttcttgccttgcaagaatgttaaaggaagaacttcagagagagagaaaaaatgatacaggtcagaaaactcagatttatgtaaagaaagggagaacattagagaaagaataaataaaataacttttatttttcttatccttaattgatctagtagataccagtttgttcaaaattataataagaacaatgtatttcattattatagcatgtgtgtaagtgaaatgaatgatagcaacaatacaagacaccagagggaggaactaggaatactttattattattaggtactcatgccaccttttaagtggtatcgtgttatttaaaagtcaacttggaactctcgcatgacattattttgtcttgatagttcaagctccacctgcggttctcccgtcctccatgccaggtgtcaggggctgctctggatgttaactcttccgccccatgacttccagttccaaaatggcggcacagaaacaagctgccatgccacaaccccaccgcgcccctctcccgccaaaaagaaaaattaacaaatatacattgctgagattatcaccagaaattgtcacgatagtccagaactcaaatatgaagatataactgttcccagggccataaggaaatgagaaacaccaagtggatggtaagaaacctgactttcacatttgtagcactcgttaccccattttgcctgacaccaaatatgcagaagattttcctccaactcacttttttctacactggaaaaattaagattgaggtaaacaaccagcttccccagccattctgggttaccggaaagagacctgtcctatccatgcctcaacccactggaagcgtcatgagtgcctaaagggagacatattcctgaagataggcagagacaaagggggatgtaggtctgtcatccccagcctgggaaagtctgctctgtaacttgaccaatgcagacacaatgtcagagtagctgcttagcagcactatgatgcaggaggattatttcactgttctcctcggcacaaacccttaggcagccttcccatactgtcaggatattccctttgggacctctcttgttaagaagggcacaattggattgtttactgaagccaaggcgaacctgggcttaaagcgccccctatagctccctagaggaagcaatttagcagcaaagacatagatgtatgtccacaagaaaaacagcagtaggaaactatgatgtctccaaacagacaaagcagggaaccagggactggccctaacaagacagtaatatgtaagctccctgaccacgaattttaaaatgcagttttaagaaaactcagtgatctccagtagaacacagaaaaataattcagaaattcattagagaaatttaacagagattgaaattttaaaaaatctatcagaaaccttggaactgagaaataaatttaccgaactgaaaaattcactagtagctctcaccatcagaatggattgagcagaggaaagaatcagtgagcttgaagacagaatatttgaaaatatatggtcgaggagaaaaaaagaacacaaagaaatgaagatttcctacaatatatagaaaattattaatacctcaaaaggccaaatgtaagaattaatggtattcaagagggagttgaagaggaaggattagaaatcttattcaacaaaataataacaaaaaattccaaaatttaaaagtatacttggattagttataaatgtatattataagctttatagggcaacccccaaaaaagttttaaaaaggtatagttgatatatttaatacttacaaaggaaagaaaatggaaccatgtaaaaatgctcaactaaaaccacaaaaggtaaaaagtatatagaaaacaagaatagaaacaaagaacaagggcaatgaataaaaagtagtagatattaatccaactatgccagtaactactttgagtgtcaatggtctaaatataccaattaaaagagagagattgttagaatgaattgaagaataaaaccagctcattttataatgccaacattaccctgtaccaacatcagacaaagaaattacaagaaaagaaaaccacagaccaataactctcataaaaatagatgcaaaaattctcaacaaaatattcaaaataaaactattaagcaatgtgtaaaaataattatatatcagaaccaagagggatttatctcaggtttgcaagactggttcagcattcaaaaatcagctaaagtaattcctcacatcaacaggctaaaggggaaaaattacaagattatatcaataaatgtagaaaaagtatttgacaaaatcaagcatccattcatgatcaaaactctccacaaataaggagtagaggagaacatactcaacttaatagaaaatatgtataaaaacctagagtgaacatcatacttaaggataagaaaccagaatctttcctactaagatcaggaataagacaagaatgtttcctctcagcactccttttcaacaacgtattaggaaggaataaaaacaacaacctcatttcaaaataaggcagtaaaggagaacgaaagaaaaaggatatatagaaaatagaaattccaaataaataaacaatcacaacaaatctaaatgtgctgaacatattagaattatgagactgtctggctgaaagagaaaacaacatccacctattgtctgagcagaggctgaattagggcaagagaatgtcttaatcacaaactttacaaaagcaccaaaaacaccctattaagcaagatctataatatttttatgttatatttcaaaaagtcaaatgatttagaaatgtataattaaaaatcaaaattttaagtaaagacacattagtgttgcttgttttatggtcctgtgttattttgtaatgggagctgttgtttctaatcagtccataattcctacctaccagttttataaggttggcatgtacctgtctcatagaaggttttacaatcgtctagaaacagactaggcatgatgggacattatacacagctatttttttaaaactgtagagtgtttattaactttttccatttggctccaaagattggtaaatattttctagttgtatacagaggttcgtatttttcctttgccctcatgctgcaatgcagctcagcatggtacttgtgctgagggtgtgagagacatactcaaaaaacaagcacacttcaagtttgaaaatttaagaaagctagcatgagctacataaatattaggcaaaacagacattactgtttcattaaagaaaaagaggcttattgtataattataaagtataaaattctaagtttacatgcatctcataatatagtttcaaaagtataaagcagaattttatagaaccagaaagagaaattggcaagttctaccatcagcatagaagaatttaatacatctcttattaaaaatgtctttttataaaaagaaagaaaagctacatactagcagttgtcattagcaagacaacacatatataactgacaaaggtaacatttaaattaagcaaactatttgaaaaacagacaaaagaagtgaacaagtaattcacagaagaagccagaagtggcaactgaaatggtcaatatacatgtaaagacatgtgcaactttactggttatcagtaaactaaaaaaaaagaatgtgataatattttatactcatcaagttgtcaaagatggcaaaatctggaaatttcaggaactggtaagtggggactcatacaccacttatgggaaggtgctgctgcactatggaaaacaatttgcaaatgtctacgtggaacactttacagtagtggatatgaaggaatatagctatcacatcaacatgaccagacttctcaaacaatcatactacagaaagcttgttttagaataatacatacactgtatacacttatataaattttaaaatcatacaaatagaaagaagaaactgataaaaggataggaggcaggactaacttgcagctccccctcggacagacagagcagcatgtgaagacacacatcatgaacttttctccaagaactactgcagcaacataccaggaaagccacgagaatccacagatcctttgaaggaaatagattgctgctgcaggctccaggagacagccgaaaaactgtaagtgcccaaagtgtgaaagggggatcttccacccctgaacacatagccttcctggggaacctgaaggtccaggtcacaggtgatggatttggccttacctggagctgagacaaacttagagagctgaacaaaatataagggtaaaggaagcagggggaagagccctgtggactctctcagcccccaggaaaaccatttctgactttgtctcctagggtccttgggtaggactgccagtggaagtggggaaagaccacaaggagaaggaaacttccagatgaactctgtaacaatttcgactgaatgccaactttcctagcagaatctgggggtgagggtgaactgggagtgcagacacagcacagaagttgcatcaggcagggaggtgtgaaacctgaaacccctgcttgcttttccagtggggagacctggagcaggggcaagtcctcagccctgttcacccattgcctggaaataaactcagtgctgttgtggagagtattgtgggagtgagactggccttttgggttgcatgggagctgggtgaggcctttcactgccagctttcccctactttcctggtgacctgtatgatgtagcagaggcagccataatccccctagaaacataactccatcgccctgagaaccacacccccaacactcagagcagcttcagcaaggcctgcccaaggagagtctaagctcagacacacctaaccctgaccctacctgatggcctttctctacctgccctcgtagccagacaaaggacataatctcttgagagctctatggccctgaccaccgcctgagaaacttatccaggagactctagagcaagcttgtatcctccctatgctactgccgttgatgctctcttgaaagcgccacctcctgtctgaaggccaaccaacacaaaactagtgcaataaacaaaaatacaacaaaggaccctcacagagtctacttcactcccctgctatctccaccagagcaggtgctggtatccagggctaagagacctgaagactgatcatatcacagggctgtttgcagttactccccactaccagtctggaggctgctagctccactgggtggctagatccagaagagaaacaacaatcactgcagttcagctctcaggaaggcacatcctggagcacccacatccagggagcacccacatctagggaacacccacatctggggagcaccctgtgggaagaaagaatctgaacaacagcacttgagccccagatcttccctctgacatagtctaaccaaatgaaaagcaacctgaaaaacagttctagtaatatgacaaaacaaggttctttattatccccaaaagatcacaatagcttaccagcaatggatctaaaccaagaagaaaactctgaattcccagaaaaagaactcagaaggttgattattaagtgactgaaggaggcaccaaaggtgaatatgaactcaaaggaatttcaaaaatgttacaggatatgaacagaaaaatctccagataaataaatagcataaataagaagcaatcataatttctggaaattaaggacacacttagaaaaatgcaaaatacactggaaagtcttagcaatagaatccaacaagtagaaggaagaacaccagagcttgaagacaaggcttttgaattaacccaatcaaacaaagacaaagaaaaaaaaaaattaaatgaacaaggcctccaagaagtttgggattatgttaaacgaccaaatctaagaataattggtgttcccaaggaagaagagaaatctaaacgtttggaaaatctatttgagggaataatcaaggaaaacgtccccaaccttgctagagatctagatatccaaatacaagaagctgaaagaacacctgggaaattcatcacaaaaaggtcattgccaaggcacatagtcatcaagttatctaaagtcaagatgaaggaaggaatcttaagagctgtgaggcaaaagcatcaggtaacctatgaaggaaaacctgtcagattaacagcagatttctcagcagaaaccctgcaagctagaaggaattggtgtcctatccttatcctccttaaacaaaacagttattggccaggaattttgtatccagtgaaattaagcttcctaaatgaaggaaaaatacagtctttttccgacaaacaaatgtttagagaacttatcaccaccaagctagcactacaagaactgctaaaagcagctctaaattttgaaacaaatccttgaaatacaccagaatacaacctccttaaagcataaatctcacaggacctataaaaaaaaaacacaatttaaaaaaaagcattcaggcaacaaatagcatgatgaatagaaaggcatctcacatcctaacactaacattgaatgtaaatggcctaaatgcaccacttaaaagatacagaatggcagaaaggataagaactcaccaagcaagtatctgctgtcctcaagagactcatctaacacataaggactcacataaacttaaggtaaagaggtggaaaaagatattccacgaaaatggacaccaaaagcaaacagcagtagctattcttatatcagacaaaacaaacttcaaagcaacagcagttaacaaagagggacattatataatgataaaaggactagtccaacagggaaacatcacaattctaaatatatatgcacctaactccagagctcccagatttagaaaacaattactactaaacctaagaaatgagataaacagcaacacaataatggtgggggacttcagtactccactgacagcactagacagatcatcaagacagaaagtcaacaaagaaacagtggacttaaactatgacttagaacaaatgtacttaacagatatttacagaacattctacccaacaactgcagaatatacattattcatcagcaggtgaaacatcctccaagatacaccatgtgataggccacaaaacaagtctcaatacatttaagaaaactgaaattatatcaagtactctctcagaccaccgtgaaataaaattggaaatcgactcaaaaaggaaccctcaaaaccatgcaaatacatagaaattaaataacctgcttctcaatgattcttgggtcaacaatgaaatcaagatggaaattaaaaaagtcctttaactgaattgtttgatatagtgacacaacctatcaaaacctccatgatacagcaaaggtggtgctaacaggaaagttcatagcattaaatgcctatatcaaaaagtctgaaagagcacaaatagacaatctaaggtcacacctcaaggaactagagaaacaaaaaccaaacccactcttattgacttaataaggaaattaaaaaaagtatgctgagattgctaagatctattataataatgaatcttctatctgtgaaatagtgaaaaaaaaagaaattagtgctagatttgctgtcaaaccacaaagtgcaaaagttacggccgcagtgctagataagtgcctagttcagattgaaaaagcattaaatttgtgactggaagacatgaacagaaaatatgtactatatggaaccaaaatatgtactacatagtacacatagtaccaaacccagttgctgtcacttggcacatagagatctggcatctactggaggtcttcaaatgtattccttgtggaaaacaggactacttactatactactaaattcagatattattagcggagtggaatatatatggcagtatcttgtttctaagttgagtggtacataaaatggtacaattctttttttaattattcataaatttatttttaatatttcagtataatttcccttaaacacaataatatgattgattaatctatcaggaatgtatcacctatgtaaatactcatgctactactaaagacagagtggaggtgactctattcacaatggaataaccattactaaattcatgattactgtgtacatttatagttttactgtaaagattgatcatttgctagctttagtcactcaacaaatatttataaatgccttctatgtgtagtgcattatgctagagtacagccattatgtcttgattacagatgcaagtatttgaaaatattgaaggaccttcatttgtgaaattcaaaaaagattccctggcagacaccaattactataataaatagagatgacttcagtgcaaacaaatgattcaggctaacaattagtaattaacaaataatataaatagtatagacattttaaatcttaaagaaaaatttaaatgcagcaatacttaagaaagggttttttaatttactaatgtagtaatcaagtctaatactacaaaaaatttctaatatgaaataccctttatatttaaataatcaaataccttgtataccagttgactaagtttagaggaatcttaaatattaaaaaacatcaataacgccttatacttcttagtatgtgaattcgtatttgtatgatgtatattattttggagagttgcctgtaagcaccatattaatataatgaatgaagcttttcttcattgaagtcctttgtaaaataatgcaggttatcctgaataaatatggtctctattccaggccatatttcctggaatatcaatagggttaaattattatggttgcaataaaatagaattgctttatcttgtccactatctacaatcttgaataaactttaaaatcctccttctgttctcttaagggaacgtggtgtgtccccatgtgtcttttttatttagtgccctgaacaatccataaataagaggaagaaggaataaagaaggacagagatttcaaaggagaaatcaaatacctaacaacatgcagtattgaaaattaacaaataagaatgcaaggcctctcatgcaaatggttccatctcattcaaccactagacataattacttctgtattcacaaggcctacagtaaggaaatactgtttaaaaaaataggctatcaattatatttatatatagacaacatgtagactgaaggattatccgaataatcctgcctagagtttctgtttttctaaatataggttttatgtcacgtattacaatttgtttcattggataattttccaatcttccatttcactttacccatagaattagactaggcattacttgaattagaatgtttctaaaaatagccacttatattaatagttgaaatattgaagtaactatgtatgatgtgtttgtcgtcattgtattgtcacctatgtttgatcagtattgtccaacagtattagtagttatttattttatgctattaatttcagtatctagagagtgagtaagtacattgtatctgtgaacactttaattatgtaagaatttctagccaagggaaagataattactgaaaaagggatatgtcattgaaggataaacacgtggcatttctgtcttctcagtggtaaagaatagtatttgttttggcttttccaattgaaattacataatctgtaggtaaaaattcacaggtgaagtattattgcatttgcctttaaacctttaatgttactattcaattaaatgctagtcacattaaagtacagtcctgtaatgtgtcataaatgcaatgagtctgttaggacattcactcacacattcaccaaatatatatgatcacctcccatgtgcaaagcacagagccattttctgtctagattctctatgtagttgggcactttatctgtgttcccctctgaaatctatcactgataataaattaacaagtttgtctaacattacctttgccatgggaacattagagctacctagggacacttccattggaaaaaagatacctgagtacactaaagtttttatgtttataaagatgatttctctacctagtagacaaatcacagtgaaactggatcctttgaattacaattgaattgctccagccagaggaaaggggaagccttgaatagagccagaggacaattactattattagagatttaggctcttaacatttccaacatagggggctggtttctactgatgagaaagggaaaatgtacagattttcagagggtctgcaattcattcaggccatctgggaatagttaaaaaaattacctcttttattcagtgagcagtactgtaacagtactaaaaagtgatcattttataatctttcactttgaagcagattgtctttctctccttctcacataggcagtgctgcatccatatctctaaattttatagccaggagtggaataactacatcttttggtttctagggctttgctgtccagtttagactcagcagaaagtaaagatggactgagccagagtgactccagtcaacacctctctccctcgaatactattttcggtccctgaagccagtataaacatggagattagaagtgaggtctttgaaggaaaacatccagatatataaattgagtacctactatgttctagggctccttctaggcacttcttcaacatattgaagacaagttgttttcgatgactcattgtgatcattatgaacttaagcttccaaaggtcattgacactgggagctctcaggaccttgaagggaaattttctccctagcccccagccttttgcaaggacttcatatatctttgtctaagaggatatttttcttccttcttttttcaaagatacatagtaggcatttaagattgttgtataagtgactgaataaataaattgctcttgcagttaaattacttaaacttgtattttacacaagtttctactttctctgtaaatttgaaggtgttaagaaataagtaaaattgagtgtgtggcttgtcatggtggctcccgcctgtaatcccagaactttggtaggccgaggtgggcggatcacttgaagtcaggagtttgagacgagcctgggcaacaaggtgaaaccctgtctctaccaaaaaatacaaaaattagctgggcatggtgatgtgtgcctgtagtaccagatactcgggaggctgaggcatgagaatctcttgaacgtgggtggtggaggtttcagtgagcccagatagtgcctgggctccaacctgggcaacagagcaagactctgtcctttatctccaaaaaaaaaaaaaaaaaaacattgagtctatcaggagtggagttgataaaaatgctttggagactatgggttatctttgaaagattgtctttgctgctctgtaatggtaacgaagaaacactatacttcagtttaatgatccataagaaataactgtcattgtgtattattagaatataatgtaataaaataaatttcatcagtgtcttctagattcaatgactattcaatgattttcatacctgaacatgtcaaagtatttggctgcaacttagcggagttgattagtagcctttaagaagctatcaaaatgaaagcagttaaatgaatcagtggtaaaggtccttgaccctgatatagccattgtctaatctcataatttgggcattcagggacatatcgggggaatccagttgttacagaagaaaccgaaacataattgaaagtgacaaatgatcaactggagattgggaaaacatgaaatagaaaaccatttgcttcaggagctgcctaaaatataagatacacacagagttcttgattttaaatcaaactttaaaatcactggtagaaaaggcagttgaaaattatgagaattcaaaaatttacttataatgcacttaccaattattatttcttccattttgtcatggttatccttgtattatctgaaacgagttgttaagaaccaattatgggaccaagaatttaatacttcatgaaactttataatcaaagaatagactacaaagtattccttctgtctttgcaaaccatacaaaatgataatagaacagtatcatctttaggatcaaagacccaaataggcattggtgtgtcatttagttgcatatgtcttaaatcaaattttaaaacaaatttaggcatcatctctcaaaatctttgcttctgtatattaatcccattgttttggaaaaaatgtatattttttacaaatcatactctgtttactggtggctcaaaaactttttagcttacatagtagttgaaaagagaatcattttttctgcagatttttgctcatctgtgtgtaatttaaaactgaaacatattaattttcttaggttttcttagtgaaatgttacatgcaaatgatgtataattatcttgtaactatccatgcagttacattttatttgctctcaatttttaatacattagtaataaatgtacactgtggaaaaaataaagttataaactttatctgtaaacctaccacccaccggtaaccccagccaataatcttagtttatatactttcaggcattatattattgttattattagtaaacctgtctcatctgtctctatcttcttaaaattgcatatttatatctatagataagtccacctttatctagaatagaggattatactctgtatattatttttaacttgattttcaattcaagctgtattatgaatatatttctctatttatatttataaatgttagcctttttttttttaggaattggaacatcttaaaccactctcttgcttttgggcatttaatttgtttccttctcttcagtattatcaacaccccattattaaaacagaaaatctttatcaagcagctttaaaaacatattctcggacaggcacggtggctcacgcctgtaaacctagcactttgggaggccgaggcgggtggatcacgaggtcaggagatggagaccatcctggctaacatggtgaaaccccgtctctactaaaaatacaaaacaaattagccgggcgtggtggcaggtgcctgtagttccagctactcgggaggttgaggcaggagaatggtgtgaacctgggaggtggagcttgcagtgagccaagattgcgccactgcactccagcctgggcgacagagtgagactccgtctcaaaaaaaaaaaaaagtattctcctaaattctcagtggaatttctgggtcctgtggaatgtatacatatgttgctcctcctaaaaggagtggataaactcctctcctacaagcagtgttctgcactggccctttctacaaattcctttcaccctggtattatcataatctaaaaaataataatttgagaatcaaaaaataacagctatgcttgttttcttcaggaaaacagaacaggttatccatatatctgcagggtttttttctccacaaaagaaaggccagccattttcaataacaagtagtttggcaggaccagaaccattccattgggtcactggtaaaatttgtctttggctttaaacattaaggcagccaggactgtgtctttggacattgatacagcatttagtccagtcttatttacaattaggctttttgataatggcttttgggctgacgttaagtataaaatctgaaattagattttttaaagattataatcaaaaagcaaaaatgtcttcctagaaatagcaaaggaatgcttttgctggatttgctccactaactcatgtaggcaatataccaaactcaaacagccagcagttgttttgtaaaagacaaactgcatctgaaatcagtatgacaggaccacagtttccatctcatcacttccaccaacttacatttaagaaagcacaacttgaataataaaaaccaccatagagtaaacaaattcttcaatgagaatgctttgaagtcaagagaaaaataggctcagggcattgtgttacagcaaaattttgcctttggcaaaagttttacgatggaatagggtttttaaaatattgggaatcaggtaaattgcatggctaattgaactggggaagacagcttaatgagctcatttctctccttcaaatccaagaagtcagaaggcaagttttcatctattctttcatttatccaattagaacatatcgtccccacacatagggctactagaagaagtaatagttatgtctgatggctcttaggaagtattgtcaatagataggacctcctctgtagttataactacagatgatcaaattaaccagaaataaattttggtcataaatttcttcttgctccactctgtaggctacctcctccaaagcagatcgtagaccagtgcatttataaatcacagaatcaccttttaatggttatagactatatatagcatagtgacagtcatatactgctggtgctggtcaaacttgagatcaacaattctgttggatttttacccctctcttccttctttttcctcctcttccatattctgactttcaggtttgagcatgtaataacttccaggatttgttttgggcattatttatatattaccacttatcctaagattattttgagtcagataaaagtaagacattctattaagttatcttcattttgaagatgaagaaactaagattcatagaagtaaagaggactctaggagtaactaactgtccattgtcattgttaatgttacttaacctctttaatcctctgtcgtgaatccaataacgatcaaagtagtaggcaagtttgctgagggccaactgtgtgacaagcactttgataactgattggtctttacagcaaccttatgagagaagtattattactctcatattatgagtgagaaaaataaggattaaagaggtacaggcaattactcaagaacacagggctagcaaatcaagaaacagaagttagatgtgagatattgtatcacccaggcctaaaagatgcaatgaaacaacccattttaaatgtttaatatagtaaccagagtatactctcatttgatgagagtatactcatcaaatgagagtatgcatttgatgttacttttcacagtggcctttttgcggttaggaaacagcagcaccaataatagaactaagctgtctgactcccagcctgtacctaaatctctaacttttgattttatgaaataaatttgatttgcagatgggcattgctggtgagggaaatgtaaagaggtcaatttccccactttaaatttttttggctaaagacccatagctgacaatattttaatggttgccacatattcttcttttatgaaatgagtttcattttatatttgtaagtggtttttattgcaaatcatcacctaacagtcaattctgaagactttccataaatgtcaccttgtttgtgaattgttctcattctgtctcctctctaaattccctcaagaacaactttctttggacattaatatcattattaattgtgaattgtcagctaacagcttaacaattgtctatcatgctcctaatgcatggatgatacagagaatataaagtcaataacttgtatttcctgaaagatacatatacagaagccaatcatttcagtagagtgacaggagcaagattgaggtattaatagagtactctgagagatgagaagcgggacaactaccttagcctaaaggtttgcaaatgattgtggggaaaaataatctttatcactccaaaaagaatattacagtgatattttaattgaccatagagtttaacttgaccattgtaaaatgaccaaaagggtgaattattttttaccaattattaaaaagtagcactacctgatataaacagtgtgacctaatgtttacattcttattattttttctcctttttgtctttttctctctccccagctaagtagaaaaaactcactttgttttcatgctaaaattttggaataccattaaacagcaacacactggacaactacattcttatgttttatcttctccctttaagattgttaaaggaagaaattgaactagtggggaaaagtaaatactggccaaaaaaaaatgcttttgactagtgtatgttccaatgatgattatgaaatatgtcaaactgttctaaaatactaaatatgtgttactatttattctgtattaaaatagaacaatagaataacctttgttgtcccaatatgaaaatagtttttaacaatgttaatataaaacaaagagcaaaggaccattatcttggataaacagagagacattactttacatggtttgactcccctgattcataatttaacatgtaactctggcatatgctgggcacttagggaagtcacattaagtatttcacagcaaatggagagtgagaaaaatgattttcagaaatcctggtatttacttattataaatcttgtcttgaatttattgtactttacatgaaatataatttgataaaatgtaattggtttcagtgtgtatgcaaaatgagaattttctgatcattcagatatcaaaattaactttataaatacaaatacatataattacctattaaaattctaaggtgtatttattttaataaaagtctttatcaaacctagataaatctcatttatgattataaatgtaaaactcctaaatttttttttacttggctttatttactattaatgatgttgggtttattaaaaaatgcaagcacagactccaattagcctactaacctattgtataatttatcaattcaataggtcaaacaattaaatcagaacatttaataaaattgacaatatttttttatttttttacaaaaatccatattggttgttttgaagtagcaatttcttcttcaaaatgataaaaattgtctatgtaaaatcaatagtcaatactataaaagctgcaacattatagacattttcattaaaatgagtaaaaagataattatgcctatcacactactataccatataaattaactattatgctgaaaattctggccaataaagtaggggaaggaaataaatataactgtatatttaaaattatgaactaaatcttcactgttttacaggcaaaggaaaattctaatatctgataaaatctttaaagtcaattaaaaaagagtatactaaagaaaaatgaataattttctcaaaaaggactatatctaaccaagaactaggtgaagattggcattactagtatccaaagacataaatactaaaacagtaattgacatattatctaaaatcaaaatagtgaagatataacaattatgggcagaacacaagaaaatggacattctcagatattgctggtgtgagtatgagtttaatttttctagaaggaatttgaccatatttaacaaaatctttaaaatgtttatactctttgataatgtaatttcatctcataattttcttaaggtaatacttagatatatatccactcccgatccccaaaataaaatggaaaaaaaaaaactaaatgtgtaatgattgcagaagggttgaatgttattttatgagaaatataagaaataatgcagcaaaatacatgatgtttaattatacaaaactatgtagtaatacaaaatatatgatttttaataacacaatacccatgtatattcataattttgaaaagaagaaatatatgcatatacaaatttgaaagaaattatctcatgttgacattttgacttatcatttgctagtcaaattaccagtgcttttaattttctacctcctgcctttgttttataaagaatatttttattatgtctatagttatactaaactcagttcagttgaattgttatttaaatctatggaaaaaattttgctttgtccataaattgtatttatattagaaagttaaaataattaattataaaacatatatccaggtttttttatttgttccagtacataacagacctattacataatttgagtaaattttgtcttacagttatacaggcagttctctccttacacaattctgatatgcatgaatatcagttatcatagtttagttaaatgctaacagtcctccaacaacgtaactcaagtgttgggtaacattgaatattactgtgagtaattacataaacaaacattgctgctggctctgcagtccacaaattaccacataaaataacagatgcacattgtgatcagtgaccgatcacgtttatttttttcagtatctgttggtgattgcgcactacacatttatcattcagtttatttatagaagagaagcgtgtggttgtgttgcctccttgtgagtgataaacccgagtgacactttacaaacacagatattcaaaaaagaagaggaattggacagcaaagaggaaagcactgcaaagaaagaaaatacttgaagtaaaattcagattgaacctaagtggagtcatagaagaaatagtcactactgaggtttgagagattctgaatacgtagccagagctacttagtgaaggtaaacttaacataagtgagggaagtgcttgccacaaatagggtgaagatgtcctggaggaagtgacacccaaacacttcacattagaggaattctcacaggtacttcacaacactaaaagcataaaagttaaaatgttggaagctgattcaaacttagaaaggagcgtgacaattcaccaaggcatagaaaagatgtggccgggtgcggtggctcacgcctgtaatcccagcactttgggcggccgaggtgggcagaacacgaggtcaggagatcgagaccatgctggctaacagggtgaaaccccgtctctactaaaaatacaaaaaattagccaagcgtggtggcgggcgcctgtagtctcagctacttgggaggctgaggcgggagaatcgcttgaacccgtgaggcggagcttgcagtgggcagagatcatgccactgcactccagcctggggaacagagtgagactccatctcaaaaaaaaaaaaaaaaaaaaagatgcttgtgttcagtgtgataagttataggtgagatgaaggcaagcactgttcaaagtacttttagtgagtattttacaaaggactaaaacaacttctccaagtttttaatgttttaaattacagagtactaaataaatggtcatttttactggtttatttctttacatttataaccagcattggagagttgttaacatgttgaagttttacaaagtcttagagctatcataacctttcctgttgattattaagatcactttgcatgtttgtaacacaaaggttaaacacttgaggggatagatgtcgcattttccaagatgtgatgattacacgttgtatctctttttcaaaacatcccatgtagcctataaatacatacacctactacgtacccacaaaaattaaaaattaagaaaaaaaaagatcattttccatggttcaagtttgcatggtcacttttacaattccaccctaccatgcccgtaaatatgctatttctgacttacgaaatatttttcaaataaaatcattgctgacttttaactcactgatatgtgctttacttctggtgaaaggcctaacatatcaataaaatgaaagaaaatcacagctttattttctttactgttctgatattttttgttctagtgtgatcgctgcttgcctctttataatgacaagcctttccgccaaggtgatcaagtttacgctttcaattgtaaaccttgtcaatgcaacagccattccaaaagctgccattacaacatctctgtagacccatttccttttgagcacttcagagggggaggaggagtttgtgatgattgtgagcataacactacaggtaagtagcaaataaattcctgagttggtttggaggcctgtgtgcttctatctacaatgcatattattttaaattatgttattgctatcttatttaaggatgtactttcatacctttaagtttgaaaatcaaagctagttcaccaaatcttcctatttccaaatcactaggtagttttcagaaatagcactctagtcttaaactatatcttttcaggaaaaggattttgttgttgttgttttgttttgttttgttttttaaagagttcacaccatttgactaaaccacaaccatatttagaataactcgggaatgcttactttgaacacatatccttaaagtaagtttccttttgtcccctttattgtcctttatgtctggattctcatgtggagatggcattcattcagatttggcatggacactggtagtctgagaatactctttttgaaaatactaattaaatggagacgatgataatcaaagtcctgttctaaaactacaaagcctttgactagtcattgaaaaataccatccttattttgaaaggcaagaaatggccaacatctgaatttgtgaaatataatagcatatatctgatgggtttcaaagtggtactcttaagcatgaatccatttatcggctgattattgataacttaaatatcacaagatcttgggtaggtgctggggacatgaagatgaataagacaatgaattttctgtctttgggttattgtacagtgggaaagacagactattgaaaggaatgattacaaagttgtctgatgattgctaagatagggcaaggacagtaggagttaaccagttgaaagattaggatggtgaactaaggcttacaattagggaaacattttgtgcagtggcctagaggagggagaaaaatgacacgtttgaaaaaccataagatgggcaaatggctggtggtaagagatattaggaaggaaggcaggacaatatcatagaggactctggagccatgataaagcctttggcttttatctaaggtcaaggagatgacacttaagggttttatatgggaaaggggcataatgagttacttgttattaaaagatacacctggttataaagtaaaaaatggattggagaaggttagagtggttggggaaaactagttagtgaggtgctgcaatagtccaggtgagaaataatgtcagaatacatttcagatggtacggatagagagaaatggatccaagagatatttaggataaaaaagtgagtgttttgtgagcagagtgtaggcaagggaaggaaggagagccaagactgatacctaacattacattctagcttgagcagtaggctcaacattggtgccagccattgagatagaaaatacaggaggattgagatgagggaggagatggcaagttctgttgtggatatgttcactcggtttctaagagacataggagaaactcctgggggcagttggaaacacagttctgaagctctttccttcaaggaaatcctctcatgatgctttagagaagatcagaatcacttacacatgttagtgacaactatgcttatcatggtttataaatgtgtattactcctggtattatttagttcagattcctcttacctcctagactgtaagagagctttgtgaaagagatgcaatgggtattgtgtatttagttcactactgtattacacagcacttagcacagtatttggtacatagtaatcacgcgataaatattcattaattcataaataaaagagagatttctggattggagatatggatttgggagtcaacagcatatgtaaatggaaatagtctagaaatattataaatcaatttaatttttaactagctcaatagccaatatctatcagaatatgagttttcatattattgattattgattatttctgtagtcttcaaatattggagaaatttcaatattttttgagcaaagtacatcatgtttaaagggggaattgatagtcttgagttctacttcagcttatttcaattatcttatacactagtcacgttcactttaaaaattccttgtagtttaggttttttattacataatatagcaaaggaaatttgtaattataaattataaactatgggaattacctgatatatctaatatgtcaggctattctagtatttagtatgaaaagtacttggtatctctaaatataatgaatttctatttcaatctttgaaatgaaaaataatggccactaacataatcatttgtttttaattgtgttaactacagaataataaattatattaagagaagtctcccattttacatgattgagttctagaaaaatatttccaatactacatacctgcttgcttcttactgtataagtatcatctaccacatatgtagaaatttctcctgctgtattgagtttagataaagtgcctggccccagatataaagttttaagtttaggagcaaactctttccaaatgtatgggcccctataaagcacagctttttagaagtgtggtattatataacagatgggagtttaatgaagtaaagcacagtttgtaacaggttcattgtttcatatgctctggatcactaaattggcaggtagagatgaaaggtgcattaaaacggacgttccgaaaattatagaattccctcaaaggaatacagtctttaattttgaattatgcagctgattttaatgaattagaagtcataatgcataacctttccctgatgcaggaaggaactgtgagctgtgcaaggattactttttccgacaagttggtgcagatccttcggccatagatgtttgcaaaccctgtgactgtgatacagttggcactagaaatggtagcattctttgtgatcaggtgagtttttctgagtatttaaggtaaaggattactctgtctgccagaaacttatttggatgttattccactagtagaattgaagactgcatttgccaggaaatcctctatgtgcatttgcatttcaaagagatggttgttcgtgtgcaactttgagtatggacatgaaatatagcactagttcggtggtcctttgcatataaaaaggcttattttagttttaattttacaaatgtcaaaaaatcgaagggtaggggttctaagtaaattggggtatatgtcttggaattattggtgaattaatattaatacatgatataaataaacaagaatagtttctccaaaaattccatagaagatcatatagcaaaagtcacttacacttagggccaaatggaaattatgatagcctcgcttctcaatttcttagtctaactttccctcttaaaagtacaatggattttttataattttaaaactttctgtttacttacatcacaaatatcgatgtctagcctacatgcacacagattctaactaacctcagttcatgtatcctacctcaagcaggaaaacaggcttcttattgaagctgaagtttttcctgttctgataatactaataagtgaaaattgtgaaaatcggtaaaggagaaatttactttgaagaatcaattcaatgattgtattaattttaaacagttatatattctgttatgaataaataaggctaggagcataaaccacaatccagttatagaatatttgttaaaaagttatattgtgaacataatacacacaagacaaaatatctttctcctataattttgagaattcattaaaaattgctttcccaaataaaagacaaatataaaccaagacaaaatatggattcaaagaccttcagagtaaccatcatgtgtcaataagggggcattacatgcttcattagaaagctgaagagtagaaaaattattaataaagacaatttctactatttttattttataatattgagggactattttctcagaaagtcatactacagttttccatatattaattagtaaactctgactgtatctttagattatatttcatttttacacatccaccctgagttttcagcatggctatcttttgcttatcattcaaatattgatatatcatattttgagatatctttgctgaccacccaattacaaaacattctcaagtctttcatatcaccatgttactctcattacaggctctgtaaaattaatttatttgtttacttttcttcttctctctttccaacataaacagaacagtttcggtcatataaaaagcccccaataagtatttgtcacataaatgttgaatgaataaagagagattatctgagcactgatcttatagttagattgttattttaaacggtcattacaataatctgagcattatgtaaattttcacttgcagaacagtttttctccctgaaaatctaaggtcaagagctttgttatatagtataggaagactgtaaactatagttttacctcccagaatctcagttacgtgtctaacctacacgagttacagtgcatcagatttgtctctccatttcaccattcagatctacaagaaattgaaacctgatttttctgaactcaaacttctatttcaagtccgttttatagggatgctagacaaccttgggtggttctgtgcttgtaaataattaacaactgactaagaaaaaaaaaaggccaccataatcaatttcaatctaccagtgagatgtcactgaacatggatttcagaagaaatgtacttaatctgctcttatgagccagtgcagtgtactccagcatactactggctctagatttctttcttaacatcttataaagtggagctaattattggatggaattatgaaagactgtaccatttataagcaggatattagctgtagatagtgttattttttaagttggagaaatttttctctattcctagtttttctgagagtggtttttatgaatggtgttgaattttgtcagctgctatttctgcatcaattattatgatcatgtgatctttttttctttagtttgttagtgaagtagaatacattggttgcctttcaaatgttgaaccagcattgcatccctggaataaaaccacctttgtgtgtgtctttgtgtgtaattcttttcatatattgttaaattttatttgctaaaattttgctaaggattttacatctgtattcataagaaatattgctctatggttttgtttttataaattgtgtttgtttcattttgttattaggataatactctcgtaaaatgaattataaaatcttccttcctgttgtttttctataagaaatgcagaactggtgttaattactctttaaagtttaccccattctaatacatagtattctagtaaatacagtaccccatgtattagtccatttttgtactgctgggaagaaatacccaagacagagtaagttgtaaagaaaaataggtttttatttatttatttatttatttatttagagacagagtctcgctctgtcacccaggctggagtgcagtggctcaatcttggctcactgccacctccacctctggggttcaagctattctcctgcctcggcctcctgaacagctaggattgcagatgctcaccaccatgcctggctaatttttttcttttttttgtatttttagtagagacagagtttcaccatgttggctagactggtgtcaaatcccacccacctcagcctcccaaagtgctaggattacaggcatgagccaccacacctggccagaagaatagatttaatggacttacaattctacgtggctgggaaggcctcacaatcatggctgaaagcaaaggagaagcaaaggcatgtcttacatggcagcaggcaagagagaagtgccgagtgaggaacagggaaagccccttttgaaaccatcagatttcatgagaactaattcactatcattagaacagaatgggggaaactgcccccatgattcaattatctccacctggttcctcccacaacacatggggattatgggaactacaattcaagatgagatttgggttgggacacagccaaactcacacttggcccctcccaaatctcatgttctcaccattcaaaacaaaatcatgcccttccaagagtcccccacagtgttaactcattccagcattaactcaaaagttcaagtccaaagtctcatctgaggcaaggcatgtcccttctgcctacaagcctgtaaaagcaaaagcaagttagttacttcctagatacaatagcggtacaggcaatgggtaactacacacattccaaataggagaaattggccaaagcaaagggcctacagtccccatgcaagtctgaaacccaatggggcagtcattaaacctcaaagttaccaaatgatctcctttgactccatatcttacatccagggcatgctgatgcaagaggtagctcccacagccttgggcagctcggcccctgtggctttgctgggtacagccctccttctggctcctttcacaggctggcattgagtgtctgtggcttttccaggcacacgatgcaaggtgttggtggatctaccattctgaggtctggaggatggtggcccccttctcacagattcaccaggcagtaccccagtggggactctgtgtggggggtctgaccccacatttcccttccacactaccttagcagaggtacttcattcattagggctctgcccctgcagcacatcctctgcctggacatccaggcatttccatacatcctctgaaagctaggcggaggttcccaaacctcaattcttgtcttctgcacacctgcaggcccaacaccatgtggaagctgccaaggcttggagctgccattctctgatgcaatagtctgagctgtatgttggtcccttttagccatagctggagcagttgggacacggcaccaagtccctagactgcacacagtgggggggccctgggcccatgggaccattttttcctcctaggcctccaggcctgtgatgggaggggtgatgagacatgtcctggagacactttcccccattgtcttggtgattaacatttggcttcttgttagttatgcaaatttctgcagccaacttgaatttctctccggaaaatgtgttttgcttttctactgcattgtcagcctgcaaatttttcaaacttttatgctctgcttcctctttaacacttactacttagacatttcttccactagataccctaaatcatctctttcaagttcaaagctctgcagatctccaggggaggggcaaaatgccaccagcctctttgcatagcaagaatgacctttactccagttccccacaagttacttatctccagctgagaccacctcagcctggcctttattgtccatatcactatcagcattttggtcaaagccattcaacaagtctccaggaagttccaaactttcccacatctttctgtcttctgagccctccaatctctttcaaactttcccacattttcctaccttcttctgagccctcccaactgttccagcctctgcctgttacccagtcccaaagttgcttccacttttttgggtgtctttacagcagcgccccactacccagtactgatttattgtattagtccattctcactcaactataagaacaaacctgagactgggtaatttataaaggaaggatgttaattgacttatagttcctcagggcgggggaggcctcagtaaacttacaatcatggcagaaggggaaacaaacacatccttcttcacatggtgacagcaaggagaagtgccaagtgagggtgggggaaagttccttataaaaccatcagatcatgtgagaactcactatcagaagaataggatgggagaaactgcccctcatgattcaattatctccacctggttcctcccatgacatggggattatgggaactacaattcaagatgagatttgggtggggacacagcgaacacatattgctccagtaaaactatctcagatttctttggaaacagaaataatttattattaattcaaaattaaatactacatatatatgtacatatatgtgtgtatatatgtatatatatagagagagaaagacagagagagagatacaaggaaatgagagtcatattaacatcattaggaatttaatattactagaagacagttcagaataaccttaaaatcccaaaagaagacattttgaagaaaaacttgatactcagttctatccaagctatggcaccaacatgaggttaagattctttttgtacgagagatggtcaaaacattaccattcataaccccatattaaaatattcaatatgcaaagtgaaaaaggaatgtaagactggggacaacattaaacaaaggaaatgacaaacaattatgatccaaagaaataaatacataagtcaaaaaatattttcaaagtatccattggtctttatggtctgcaaggatagtttccttacatacatgtttagtaattcaattttatttaagatcaaatcacaattttttgtgatttgagataaacaaataacaagtagagggctaaaaatactatatccaaatatttcagtgagaaactggatgcttttttcctaagatcaaaagcaagataacaatatcccataacattgtactgaaagttgtagccaagaaaatgaaataaaagacattgagactggaaaaagagaagttatttgtatttgcatatgccattatcttatagatagaaaatcctaaggaattaattcaaaagtattaaaactaataaattcaggctgggcgcggtggctcatgcctgtaatcccagcactttgggaagccgaggcgggtggatcacgaggtcagcagatggagaccatcctggctaacatggtgaaaccccatctctattacaaatacaaaaacaaaattagctgggcatggtggtgggtgcctgtagtcccagctactggggaggctgaggtgggagaatggtgtgaacctgggaggtggagcttgcagtgagctgagatcacgccactgcactccagcctgggcgacagaacgagactacatctaacaacaacaacagaaaaaaacctaataaattcagcaaggttgcagagtacaatatcaatacacaaagatcaattatatttccatatatttgcactgaacaatctgaaaataaaattaagaaaacgtcttttaaaaatcaccaaaagattaaaatatttagaaaaacatttagtaaaagaagtgtaaaattatattctgaaaaccataaaacattgctgaaataaagaagaactaaataaatagaatgacacccaatgctcatgtatcagaagacttaatattattaaattaacaacactctccaattgatctacagatttagtgtaatctttgttaaatgcccaccttacttctttgcagacattgaccatatgatcctaaagtttgtatgaaattcatgggactcaaaaatgtccaagataaccttataaaaaaagagttggaaaactcacccttcccaatttcaaaatttactataatcaagacagcatggtactgggataaagatagacatagagacatattcactgaaatagaattgagaatttagaaataagccctcatatttatagtcaattgatttttgacaacagtgccaagacagttcagtggagaaagtgtagtcgttttaacaaatggtcctgggacaattgtgtttttatatgcaaaagaatgaacttggactcctaccccacctcacatataaacaaattaattcaaattaaacaaaatattgaatataaaagctaaaattataaaatcttgagaagaaaatgtagatgcaaatcttcatgtcctcggattagccagtggctttttagatatgacaccaaacgcctaagaaacagaagataaaatgtgtaagttggacttcattagaattaatatttcaaagcacaccaacaagaaagtgaaataaacaacccaaagaattagttgcaaagtatataataaatctgtaataatgaagaaaatatttgcacagcatatatctgataagaagcttgtctagtatatatgaagaacttgaagtgaataatcaaaagacaaataactcaattttaaaatgcgcaaataatctgaatagatatttctctaaggaagatataaaattaccagcaagcacataaaaagatttttgacattagtcatcagggaaatgcaaatcaaaactactgtgcaagcccacttcccaaccagtgggatgactgcaactcaaaaaaaaaaaaaaaaaaaaaacagacaaaaacaaaatttggtgaggatgtggagaaattggagtcttctcataggctgcctgtgagaatgtaaaatgtgcaccgactttggaaaatggcttggtgtttctcaaaatattaaagatggaattaccatataacccagaagtttcactcctctgtatgtatcatatatcctcataaaatcttattggtgaatgtcaatgccacattgtttgtaatagtcagaatgtccatcaactgctgaatgaatagataaaatgtagtataatcacacaatggaatattattttacattaaaaagaaagaaattactggtacctgctacaaaatgtgctcaagtctcagaaattagagtagggaaaggaagacggacgaagaatagagaaagcttgttttgttttgtttccaagtgcaaaaatctgttttaaaaatatatggaaggaaagacatgctttaaaatgttaacttttttggttttaaaaacatttttccttttatataaacttttttctctttccaaatctgctttatttataacttttatagtcagaaaaaaaggagaattttcattcaacctgatatatagccagagagaattacacataagaataggaatgtaaataagaatgatagaactgttttctgactttaaacccccacattgtttatctttaaatcacattcatatattatcttaatttttattattttctcatgctccaagtatagagacaaagtttatggagtatcgttacatgtggagatattgtgtcaagtctaccttacctaaataatgttataaaagatttcaaaaaatgtttccagacattgtcaataggataacagaacacacacttaaaaagttgtcaacagtgtcagaattataaactgcaaaattgaattcaaggacatttaaaaaattcatgcaatttcaatccttaataatattagggagcacacaaggaaattaggcagtagttcaagtctcattttgttataataacttaggaatgaagccagccccaaatggcctgagtgactgtgtcgtgcgctctatgttctggaagggaactttccctttggcacttgtcatttgaaactcaatccaatctcataagatatggcatgtttgccttattcttccataagaaatgttgttgtaattcttccttatgtgaatgccaaaatcttgagaggggcataaagtaatgctctgagtcactgaatcctaaaaatactgatgccacagtcaagacagagagaacatctaaagcacagtactaatattaataggagagaggaaaatgaagagtaataatgattattgaggaataactaacatggaatccttggatcccttgggttactatatgagtgtatattttatgtctgtataaattgagtaggatacaatttatgtctgtgtcatacaactgtaagtctgtgtatttttccttttttttttcttttgtctgtatttttgagggtgagagctttcagtactttcatcagatccaaaagggatacatgaaccaaaaaagatgataattatttcaccatggaaaagaagtctatcttatgaacaggctgggttattagttcaggtacatattatgtgagtttttcaggataccactgcacttccttcttgtttgcttgaacttaatgcatgaattacttgacatgcatcctgagttggaggttaactgtccttttccatttcctcatctagtgtgacttaagttcagatcaatcaaatagagtcccaggcctagatgatgcctcttctgtactttgacatatctggagaagggtctgtgaatccacacctaaagtgcatacatctagagatctcagtctgatcctgacccaaggtgggagtgagccgcttgtctccatcctttccctccactgaccccactcctccacatattttctggtagccccagagtccctgctatagccacctccacaggtgatggtgataaggtagggagaccggtgaaagtccctaacataagtccctagcatatggcctgactcatgtagaatgcattcaagaaatattgtctgagtgctttcttgcttgggacttttttcatccctgctaccttctctcccgtttactttgcttgttattgggttgagctgaggaagccatgggggttcagccactgtagtcaagatggtggtcatcagctagggtagtcctcaaacttttaatgcacatgtgactatcctaggtatctttttaaaagacagattctcattcaggaagtttggggttggggctcagattttacatgtgtaaaagttcccagatgatacaattgccgcctgtctgtgaaccactttttgataaccaaggagttagaacactgtatatcaaagatatgtagaccaaagaagctgaatgtagatgggggtaggggagttgtgagtgtgtactcacgagcacatgtatactcttggtcagttgtgggtttactttgctccatcctctgaatcccatcttaaaagcaaggattttccaagtcatccaaattaagttaggcttgaattgtgccctgggctctacctttaaaattagagtatatcacctaatagccatttttaaaaggaaataaaaacaacaaataagggaattaaaaagttgtgtgaaaaccaaaaatatagttgtaattatataaaaagagagaatagcagattgtaatgctcaataaagcatcaataggttactgtaatagcaacagaacagaaataaatgattaagagatatttaaaaatagattaataagaaaggaaactgaggttgaaatgaattagacgaaatggaaaggcatcagtgaaagaagcatttctaggtctgacctatggaagatggaataataaggaacagagaccctactcatgaaaattgattgttctggtgaagtgataattttcaaaacaatacatttaaaatttgaacagaatatactttctctgcataatgtaccatttttctgcagttcattaatggtttctcttctgttcagaattaggtatttgtcattaattaccataacatgtccaaaagtcatcaggtgaacttccctgaagtatattcttatattttgtatgactcaaatattaaagtgtacaaatagaaaaaataagtattgcataagtttccttagcttatgagaaacctgaccatgaatagtatgatccatggatattggatgtatacattgaggtggtgaaggatgtgaaaagaggagagttttcccagagcttcaatagagacagaaaggtcttggcacaagccacgtggtctctccttcagagaattagggaagtttagtagtaatatttctcatagagctggtaaattgagtaatatctcattattctgagattgtagaggatgagattcacaaagacaggaacaaaggtcctggggtataaatgggaaaagaagggaaaaattaatcttagctggataggaaggttagtattgagggagttatccaagaatcaaggttgtgacaaactgcctgaaagtaaaaatagatggagttgtaactgagatgaggtcttagcctccagtttatgttgagttccacatgtttgaatacatctgacatctttttgggaacaagctcatcacaagggcccaggtatacaaaattggccaaataccaatacctcaggcatttaaggctagattcaatagccctaaatagccataatagcactagcagaagcattaggtagtgtctggatattggaagaactgatttaactagtaagtgcaagataatgtgatacaaggcccattgccttgctaccaatagcaatgtagttagaataggctaaacagatgtaacaaacccccaaatatctagtggccaaaacaatatacaggctcatttgttgctcatataacctctccaagacagctgttcctacctccttgttggatcttctctttgtgacaattcagggacacatgctccttccattgcctggatatgcctttaactagggaaggaaaagacaatgtggaaaacaacttccacttttaaaatgctttggtccaaaagaggtgtgtgtcgcttctgctatcattgccattgatgatagctagtcacattgctaactagttatatagaaggctgaagacatgtagtctctagctgggtaaccactttgcagctacatttgtgtactattgaagactagggagaatgagtcttgatggggagcatgtcatctctgcttaatactcatgcaacagaaggtagcccaagagcgaaaggggcattctcttcttttctacacacagaacaggataacttctgtttaatgaggacctctgagaatagagtaccccatgagcatctcaggggtgccaagccattaatattggtgggactacctgcttggaggtggaccctgtaatattggtagatgcacctgtgaaagcacatatcatagcagcatgtatcagcaagagagaattggacataggaggagaaacagcttgtgtgcaaggttaaaagatttgttcatgagcacatgtgagagagaagccccaggaacaaggaaatgagaaaacaattactgcctcctacatgttcccagaggagggggctgggagagcaattaagcataaagagcattaattgcatagaagatgctgagggatcatagatttgaaagcaatttcaaaatatgagtattttaagacttttagcaagaacagacaccataggctgtatatagtttcctggagttatgattaaaggatgaaaacaacttttgtttagatatgtaggtaggtaagtaggtagatatagatagatatgagaatagtaagtttgtttaaacaaattattcattacatcatagtgacccttagtgctttttgatgatactgactgatatggtttggctgtgtccctacccaaatctcatctaatagctcccataattcccacgtgttgtgggagcaacctggtgggagatgattgaatcatgggggcaggtctttcctgtgctgttcttgtgataatgaatgagtctcatgagatctgatggttttaaaaatgggagtttacctgcacaagctttctctgcctgctgccatccatgtaagaggtgacttgctcctccttgccttctgccatgattgtgaggcctccccagccatatggaactgtaagtccaacaaacccccttcttttgtaaattgcccagtctcaggtatgtctttatcaccagcgtgaaaacagacgagtacactggcttattgaggaacagaatataatcagcctccttcattcctcactcactaaaccaatgtgctgatcatttctagaggcaaggacactccaagaatcaagaaagagccgatgatgaggctttctattattctcctggactggacgttgtctcagcttctgctgggccatagaaccctgcctctaccttgacttacccacatgttgttttggtgccaagtattgagtgctgcattttggggtgtacaagacagattggcatattgctaaaaatgtgcgaggacagaaatgacagaaactagtctgtaagattctcataggttccacttgtcttgcactcgtcatgtacaaaaatatgccaagcattgtagttcattaattcagtccttaccaaagctggtaaagcagttattaatttatccactgtaaagttgaggacatccagccttttggaaattaaataactcctccaatatcacacaagtaataaggaggttgtgcagaaattgaaaacttgtgaatttccaaagctcatgcccagctggaggttagagacatagggttcctaccaaaaatgtgttcctagcactcagcatagtgttcagcacttaagaggaaacctacggcagattgctaaactgggtatttacttacactatccaaaagtaggaaggaaacatacccatttgtttgtgaattattgtatcaaatcctattaatttcatcctaaatattaaataaaattcctaaataggaaatagcaatgttcatataaagaagcagcaaattaatttattggaatcgacacattcctcaaatggagatttggttgatattagagacttaatgtacctcccttagtgcttaatgtataacagagattccacttatcttacctatataacctaagaaatttgaatattttataaagttactttttagaaaacctgatttatttgttttccttgtcatctcagatggataccttcctctcaaaatctatttggaatttatattttcaagtattcaattaactaacatattaagcaggcattctcctgtgtaagttcctagcaacttttaccacttgtactaaaataaaacagatagttaagccaaatgagttaacttttctgaaagtgtatctttatacaacattaactatagacatggaaaatacatttattcacgttagaaataaatgcttctgtgagatctttcattttgataaagtcaaaacaccatcttattaataactactatattaattttgcagcaaattacaataagaccacactgtatagttgtgccattcagatgacatttatgaaatgctctaatttaacatggtgacatatattacctgcatcttttacacattatagcttatatcctctgagcgaaatagacctaaaccatccaaaaaaaaagagagagagagagagaataatgcaatgggaaattatacccctttgagaactagaaggactataattacattgcttcctcttaaaaccattcaaatatgtaaccattgctgggaacagcagtatgtggggaacctctttacactctttctgtcttgaacactcaaaagattgagaaaaaaatattcctttcctactatagttttatttgagcatgcttcagaattttacctttttgcacactccttagagattatcgtggggaagtttagaaagcagtttcttggaaatgccttttggaggggaagaggagctataaaaatataccagcctgacaaatgacaggcattgtagactggaaaagaaaagacatcttggttttacaccaatgtagaagcttttctttgcaaatgagtatttttgacagctgagcaagatgataaacagaagtatcacaaaacacttaaatggaaacaagtattatgatgtactttattcacctggcattctccaattcatgacatttatatgtggcagaacccactgcagattcatttatttatttttgaagtggaatgagttccttacgaaggtagcctgttacattaatgtggacttttcttctctagatgcagaagcttaaggaaaaaagttattgtatctgtactataaataagtggtaagtctcagaatccacatcttagggctgagaaggctcctagcaagtacaatatactgtataaatatagacaaataaatatagatatagattttttgtgtaagcaccggcagtgttgcaaatgattagatatttcataaatgccttttctaaaaaggtattgctgaaaccagtctatttctagaacttatattcagatgtttagaggtataaatgcttcaatattggctaagcttagaaaggctatgtttctctgaggctcagtgatagacataccaacaatttgatgagatgcatgactaagaagaaaaagagagtaagactgagtccctgtgaattgattgacttggtgcagtggcagagtaggtagcaagtattaaagcaatagttcttaaatgttagtgttcataagaatcatcaacagaactttttaaaaatgaagattcctaggttttaactttagcgacttttaattctttaggtctggtatatttggttgtgggaaatcaaaagactcaacttcggaatacactgaacagttgctgactatagatttgtatattcaaaattttttggtatttaaaaatggtatgtatggtttattgagtcaaatattttaaaaactatgaatgtgtgctggtttgtttttttttttttttctggattggaggacaatttggggtaagcattctctatttaacaagtcataattaactccctgccaaaactaagtagaaattgtgatttctataactcctatatttgataatatctcctaaaaatatttcagtgatatagcatttaattgcaaataattcatctagtcaccaaacaaatgtagggacgttcctatataccaggcactgtgcatatcaaggtgtatattacagtgaataacagaaacactcacgaagtgttcaattgaatttaaccttgaaatgtattatttattattattatgtttaaataaactatgtgaggtttttttttcattgccaatgagaaacccaccctaacttcagaatttttatctttaagtatatcctattttaaccacccttacccatccactctcaatgatttctcctcagtgtggggccttgccgtggaagtgtgccctggtcagtgagttttgagagtccgtggaagctagattgccctcggctcttcagttcccactgcagaactcttgcagtcactggctattggatcagcagaacctcttctattttcagtcgcccattttcaaattggctcactgaactttaggttctccagttttcaggtctttcaaaagtccgacacccctttactatcatctgctttctcctacacaggggctaatgccatgcaggttttgtgactgctggtggtgtgttcctacctgctttttttgggaggcttctgggcacagctggtcacctagtttcattataatcatttttaatggctttgctgttgttgtgttgctgtttagttctgtcagcttttatcctgggatttagagagacccaagagttctgtggccacataaccattgatcctgattcccctggagtctcttttgacttttactgcctaatttaagctgaacatatgaaatacatgaaaaaactgaaagctcaagctcgtttgttgtttgtcttcctaggttatggtttccatttctccctctttctcaacctattttgccaatcaatgtctatccttccttcactttttgcctactcactacaatattcaattacacaaacataatttttcctctgcccaccccagcaccagcatttttctgggagtttaagtctcttatgaatctgggaagaaaggaactaaaaatgagcagggatgaatagcaaaatgagtgagtcaacgagtagcaggcaggacattagagtgaagctgttttcttacccagaagactgatgatgggaaaggaaaaaagaacaattcaaaattagtagaagaaaagaaataattaataaaacatgagtggatattaatcaaatagaaattggacaaaaaatagtgaaaatgaacaaacgcaatagtttgtcctttgaaaaggttaataaagttgatgagcagaaaacacaaagtaccaacatcaaaaacacaaattaccaacatcagaaatttaaaaaagagacatcaatgtcgttgcacattttataaacattaaaaaattacagttttatgaacagctctgctaataaatctgatgtcctgaatgaaatgaacaaatgaacacaaaaccaacaacaaaaaatagaaatagcctcacatatattaaagacatttaattcatatctaaaaacctttcaacaaggaaaatctcagtcccaaatggcttcactaatgaatttgccactaacataaaggaataaataatattagtcctacacaaactctttcagaaaaccaaggaagggcatatatttctcagctcattttgtgagggctacctaactttaatcccataacctaacaaagcactaaaagaaaagcccattagaatattccatatgaacatagatgtaaaataccttaacagcatattagcaaatggaatcctgcaatatataatagggtaatgcatcatagctgattggatttctcccaggaatgcaaagttagtttaacatctgaaaatcagttaatgtagtaagccacataaatagaatacaaaagaattcccaggtaatcatctcaatagatcaaaaaactttgaaaaagaattcaaaacactttcatgataaataccctctgcctactaggaatacaagagaacttcctcaaactgaaaagggcatctgcaaaaaccctatagctaatattatgttaacaataaatgttaaattttttaccactacatcaggaacaaagcaaggaggtttgctcttataacttctactaaaaattgtaacagaagtctaaagtaggacaaaatgaaaaaacaaaaagccatgaatatcaagaaagaagtaagactattattatttgcagaaaatatgccactgtatagacagtgggagtataaaaattgcttggcaagcatcaagtcccccacatacaatcccctcctcacactactctccttcgtaaagccatgaaaaaccgctttatattctaagtaaggacgggatgtttgatgtgcaaatgcagctgtaagataaatccctgagcaacatttttggccaccctgcccttcctatagaaagtctggggctgtcactgaggtagggttagtaatggtatgtgagactggagagatatgtggaaaccacctcatggtatttggtcttcactagttaggcaatagggagctattgaatatttctgagcacaggagtgacacagaggtgtaccaagtaggtaagaggcagtggaaacaatctacctcagtggggaagagtattgtatcacaaaatttgtttagaattgctagtacttggtgataattaaaagcaaaacaattttaactgaatcttattattttaattttacttacagaaagtgcatcctcttttgtgtacccaggtgtttcattctcaccaccttaccgtaggattattatcatcagaattaaagtagatgaggcaaggcacagtggctcatgcctgtaatcctagcactttgggaggctgaggcgagaggactgcttaaggccaagagtttgagtttatggtaagctatgttcgtgccactgcactccagcctaggcagcagagtgagaccctgtctcttaaaaaaaaaaaaaattggaatgaatgaaaattaattgatagcagtttattaaatggattagggagaggaacagactggtagatatcattcagtatacaatagctggttagtgatggcaattctgaaagaagaagtggtagaaactgggaggtgttgctagtgtagtatgacctttcaaaactcacagagtgcatagcttgtggatgtatagaacaatgtgaaagaataaattctccagaaaggaagaagaggagttagagattttataaaagagaagtctatgatgttctctaggaaagaaaagaattttctgaagaatatatgcattgattaaatgatttccttttgccctcatttatatttattttctgttcaaatgaaacacttaaactaacactcaatttccgggacagatttcctgttcttacattcttcaatttgctttttaaatttttactttgtttagcaatatcaacattgcctcattggcttttagtgagtttcttgagaagatgtaatctatagaacattagttcttctctcccaccagacagatgagtgcatagaaagacatatagttatactgctgctgttttaaaagtgttgcttcaaattacctaaaatatagtgactattagataatcactgataaaaactgtgttcatctaatttattcatcttgaaatcatgcttcatatttcctttaagcacaaaatagttatgttcacacatgcacaataaatcatatatggattacttgatgccttgaattcaccctcatagaattttatctcctaatgtaaagaaaactgactggggtaattattgcaggatcttactcttttctgttgtgagtaaccttcccaccaaactcattgtgacaattgtcacccggttgactgtgcatatccaccattgctccagagcctaggccagcagacttttgctgcatggtccaaaatggtgaggtcctgggtgtgatcacaaggcaatatgcagcaaacattagtgaccatcagtgctaacaaagaaacttacaaagtaacaacttgaccacttggccaattcttccactgtgttttcagctcttcacaggtgtaggccatgccttaaacttaattgagtctagcactcttcctgttactattattatatttgtagcttatgataagcagagtgaatttaacataggggttatgatcatgcatttgagagttgggccacttagtaactgtattagtccgttttcacactgctgataaagacatacctgagactgggtaatttatacaggaaaaatttatacaggacttacagttccacatggctggggaggcctcacgatcatggcagaaggcaaagaggagtaagtcacatcttgtatgggtggcagcaagcaaagagagagcttgtgcaggggaactcttgtttttaaaaccatcagatctcgtgagatttattcactatcatgagaacagcacaagaaagacctgctcccatgattcaattatttcccactgggtctccccccacaacacataggaattcaagatgagatttgggtgaggacacagccaaaccctattggtaactgcaccacctttaataagtaatttgatctttctaaggtttaaattcttcttctgtcaaatgaagattcatgtattttcacaaataataaaatgacgaaaattcctgccactatggagcttacattgtaaagtgatttggggagttggaagagaaagaacaatcaataaatataaaaataagtaagtttatttactaagttaaatgctataggagaaaactagacaaagtaaaatgccttgagagtaccatattaaggaaaggaattgcagttttggaaatgtagccaagagacttttaattgaaaagatggcatttcacttgagacctgaaggagatgaaggagttagtcatgtggaaatctggaagaagagacctaggcagaggcagcagcctatgcaaacaccataaggtggaagcacccctgatgtattcagaaaaggggctgtatagctgaagtgagcagaagaaagagtaggaatgtcccaagcctacgggatccttgtgcaagctgcaaataattggtcctttcactttgcaagtactgccccacatccatcaaatactttagaaggtttgaaaaaagtttgactatcaatcacttgatgaattttcctgcccactatttgctctataccagtgtgaaatgtacagagtaatacttccacttcatctttaccgagcacttactatgttccagagatgatgctaaacatgtttacattaataatctcagttaatcctgacaacagacctatgaggtagatattattatgctcattttattgataaatacgtgaagacttcagtagatttaagttgttcagagtatagttaattctgtggctagtaattgtggcacataatcctaatgttccaggaatttatatcatttagttgaggagacactcctcaactcctgtctcaggtgacaggagtaagtgaaattctaaggcacaatatagcatggtgcataagcaggcaggactgcagccacagaaccctcaattttaattcaggctaagtcacttactttcccttttatgttagagacgtctgttagtttttctacaggaagtataatacctcacagggtaatttattcacaaatacgaaaacatgtataaaacatcatagcagtctgcctgcaatatcgtaagtgttcaaaagggttgtggatattattattgttgttgtaagctaaggaacgctagaaaaacatcaaagattcaattactcaaaataacttttgctgagcatctactacatgtaaaatatgtatactgtgggatcaatggatgatgtaaaggtgcaaaaggttctggcccttggggagtgtatggtacactgggaagttatattttcagacaagacataataattctaatacaagctagaccttaaggaattgaatgacagaggtaacaagaaaatgctgtaaaatggctgaggagagaaaaatcctctaatttgggaggagctcagtattgacaaaggctagaaatgggtagagaacactttcccaaaagagatgtcgtggtgcctggtgagacaggctgtgaacttgacttctcccatccgttccattattaatgtgtgtctctgtgctctagcattcatttcatcttgtggacatgctattgtttccatttaaaaactctcttgatcacaatttcttctgtggcgatggtctcatgtcctgctctcctttttggcaaaactccttaaaagacttgtctaggctcatgcctccaaatcctattctgctattatttcctggaaatatatctgtcaggccttcactctcatcattactttgcaacttttcttgttaaggtctccaaggacctctgtctttttaaacaaagctaaattctgtcttcattgtatttgacatacaagcaggatttgacacagttgatcactctcttttcatttagaggactccacattctccgggttttcctcccatatccctgactatttcttctgtatcctttttctgtgccctcctcttacctttgaacacttattgttggagtgctctggaactctctttagaggactttcctgtatctacgctcacgcccttggtgatattttacttcaaataccaattatacacagacaatactcaaatgaatttcacaatcatatttccaattaaacacttaacatgttttatatatatatataaaatattatttgaatttaattatctttatcttcacatcaatacataataatctatcagcaaatcatgttggttctattttcaaaaatatccatagtctttcattcttcctagattcaataattcctttgcttgtctatttagttttctatatgtcattaatcttcctcatgctgacgtctttgctacatgaatatatacatatatatggtacacatacatatatattttatgcacacacacatacatatttatgctcaaggacctcctgccctgctatcagcctagagcttttcatatacctctacatcctcatttcctgaatcccatgccttccattcttgttgctgttgtctgtttactttctttttgctggaactatattactcaatagcttcctgatataggaagttaaagttttgaatccttgcaaatccagaaaatgtttgtattctttctttacaggcaaccgataatataacttagcatagaattctggattagaaataactttactcataatttggaaggtaccattcttagctttttagtttactataatgttgcagaatactgcagtgatattctgtattttctatgtgacttatttcattggtctctggaaatttttgtttcctttttatttttggaatttgaatgcttcatgagattgcaccttgatctgggtttttccaccagcatgtggtgagcctttttttttaactttttaatattttatttttaatcaatcaacacataatatttatacctattatgggatacagagagatatttcaatacatatgtaaaatgtgtgagtatcaaatcagtgtaattagcaaatccattaccaccaacctgtatcatttctttgtgttgggaacattcaaaatcctttcttctagctatttgaaaacatataataaattgttgttaactatagtcaccatacagtactataaaacacaggaatttattcttcttacctatctgtgattttgtatctgttaaccagcctctccctatccccttctccctgctatccttccaagactccagtaaccactattcgaccttctactttcatgagatcaactggtttagcttccacatatgagtcagaacaggtaatatttatctttctgtgccaggcttatttcacttaacataatgtcttccgggctaaacataatgccctctaggctaatccatgttgcttcaaaagacagagttttattccttttcatggctgaatagtatttcattatatatttatatatgtgatatatgatatatatatatatcaaattttctttatctattcctttgctaatgagcacttaggttgattctatatcttagctattgtaaatagtactgcaataaacatgggagtgcagatatctcttcaacgtactgatttcaaaacgtctggatatatgtacccagtagtgggattgctgaatcatatggtagttctctttttagtttttttaagtgaccttcatacttttttccataatggtatgctaatttacattcctaccaacagtgtataagaattcccttttctctgcatccttgtaagcatttgttattttttgtcatttttataacatattttaactgggaaaagataatattgtggcttttgtttgcatttgtctgatgattagcaatgttgagcattttttcgtgtacttgttggctatttgtatgtcttcttttgagaaatgtctgtccagaccatttgcacctgttttaattggattatttggggccattgagttgattttcttatatattctaggtattaaacatttcttggatgaataccttgcaagtatttttccattctgtaggtcgtctctccactttgttggtagtttcttttgctgcgaaagggcattttagtttgatgtaattccatttgcccagaccaatgtcctgaagcacgtctcctaggtttacttctagtattttcatagttttgggtcttacgttgaagagtttagtccattttgagtggatttttgtatatggtgagagacgggggtctattttcattcatttgcacatggatagccagtttccccagcaccatttattgaagaggatgtccttttcccactctttgtttttggtgactttgttgaaaacccgttggcagtaaataggtggatttatttctgggttctctattctgttccattggtttctgtgtctgttttacgacagtatcatgctgtatagctttgtagtaaattttgcagttaagtagtatgatatcctcagtcttgctctttttgaacaggtgactttgtctcaagattgatttgtctagctcagtggggtggctcacgcctgtaatcccagcactttgggaggctgagttggacagatcacttgaagtcaggagttcgagaccagcctgaccaacatggcgaaagactgtctctactaaaaattcaaaaattagcggagcatggtggcgggcacctgtaatctcagctactcaggaggctgatgcaggagaactacttgaacccaggaggtggaggttgcagtgagccaagactgtgccattgcactccagcctgggtgacagagagagaccccacctcaaaaaaaaaaaaattgctttgtctattctgggtctttatggttccatgggaatttaaagaattttttcttctatttctgtgaagaatatcattagtattttgataggaatcatattgaatctgtagattgcttttgataatacagtcatttttataatattagttcctctaatccatgatcatgggatgcctttccattttcttatgtgtcctctttaatttctattataagttttatagttttccttgtacagaacttttaccctttggttacatttattcctcagtatttttgtttttttagctatcgtaagtgagatttcatttttacctagtttgtgcttgttgtataggaatgctactaatttttatatattgatttgatatcctgcaactttattcgtttagtttatcacttctaagagttttttggtggagtgcttagtttttattacatataagatcctgtcatctgtaaaccagaactagttgacttcctcctctccaatttgtattcctgttatttctgtctcttgcctaattgctctggctaggaatttctagttctaggttgaataaagagtagtgaaagtgggcatcaccatcatgttccagttcctagaagaaaagttttcaccttttctccgtttaataagatgttggttgtaggtttgtcatatatggcctttattattgaggtacatttcttccatactaatttgctgacagtttttagcataaagggatgttgaatttcatcaaatgctgtttctgtcttttgagatggtcatatggtttgtccttcattctgttgatatacttttatttatcccatttattcaatttgctcatattgaatcattcctacatccttggtataaatcacacttgatcctggtatgtaatatttttgatgtgctgttggattcggtctgccagtattttattgatgatctttgcaactatggtcatcaggaatattggcctgtagtttttgctgttgcatatttggttttgctatcagggtaatgctggccttataaaattagtttagaagaatttcctctccttcaattttttggaatagtttaagaaaaaatggtattagttcttctattaaagtttggtagatttcagcagtgaagccattgatcctggacttttctttgttgggagactcttaattactgaatcaatctcattacttgtgagtgttctgttcagtgttctattcctccttggttcaattttggccagttgtatgtatccacaaatttatccatttcttctaggtttttcaatttgttggcatatagttattcataatagtctccaatgatcaactgtatttttgtggtttcagttgtagtgtctcctttttcatttctgattttatttgagtcttttttctttttttctcagtctagctaacggtttgtcaatattatctttcaaaatatcaactttttgttttgttgagcttttgtattgtttttggtctcaattttatatccttcttctctgatcttttttatttctatattgtgccttgcagaggacctttctagttaaatacatttgggaacttttgagcttcctggatctgggtatctatgtctgtcccaagacttaggaagttttaagttagtatttcattaataggtttttattaccctttttgtcatcttgtctttctaagctcccacagtatgaatagctgtttgcttaatggtgtcccacaagtcctgtaggctttctttattctttcttattctgttttctttttctttctgtctgcttgagttatttcaatagacctgtctttgagttcataaatcatttttttctgcttgatctagcctgttgtcaaaactcttgattgtatttttatttcattaactaaattgctcagctccaatatttctgtttggttcatttttatgataccaatttcttgttgaatttctgatttagatcatgaattcttttcctgatttttttcagttgcatatctgtattttcttctatcttgctgagtttccttaacatcattattttgaactccttttctggcattttgaaaatctcttttactttggggtctgttactagaggattattgtgttcctttggtagtgtcatgttttcttgctttttcatgtttcttgtgttcctacattgatacctgcacatctggtaaagtaattgcttcttttaatgttatggactagcgcttatagggaaagatttactcctgtagataagttctagagtgttaagtagagggtgataacttgggtcctgagtgggcacagtagtgtagtctctgtgaagtttcttcaactgtaatccatgtcagtaatgtttgtgaatgcttcactgacctaacctgtgggagtttgtggcagcagtgacatgactttactggaatcaggcttattgagtgagttatcaggatggaggcatgtttgtgcatgtgatgggtcacctagcttaggaactggcttgctttgggtgaagccgtgggctgtttctcaggccgggggcatgagtgttcagtggatcagctggttctggaactggttcaccaggagtgaggctgttgggtcgtttctcagtttaggggcataggcacatgttggtttgccagccattaagccttttaaaactatggtttcatgtctggaaaatgtgtattttatactaattctttattaacttattcctttaattttttttccttttggtgtatttctgaaaatttgttttcatctcattattattgttagcctttctgatgtattttcttatctttctcttctaatcttttagttgagatttttttccagcctttttttttttttttggatatagaatcttagtatattgtctaggctggactcaaactcctgggctctaacaatacttctacctaagcctcctgagtagctgggactacaagcacatgccactatgcctggctgtatatttttaatatttaagaattctttctttcaccaattgtttattcttttaggcttttttttgtttctatattttttaatgaatgcaacttttatcttctggggataacagagatattttattaaattgttattagttgatgatttcttccatctctaattccctgcattgtttgtttcctcatctggattatcatttttcatcctcctcctttatttttgtttctgtcattcacattgtatattttgcacatttgatgaattttgccatctgctttattctgtagagaaatggtaaaacatttccaaaatggcctttactcatgtttatgagcagcaatacagctttactttgcagaggttaaaagctcaaatattagttctagagttcttatctttgtagtatttttctgccagtttcctctttatggaaaataactctggctcccggctttctttaaactgtgtagaaggggagttgtggtggtaaaggggagaggcagtgtatacagactttcacttaatcctttcatgtctaccttgtgcctcttccaataacaagttgttgatgttccaatataatggagctggttaatttcaattattcttgacaataagactgatgtcactgtggagtaggattagtttggctggctgagtggggttgaaaaggggacctgaaaatctaaatactttctatgtggaatacctctaattcatgattctcaaccttggcactatggctattctgggctgggtaatttgttgtgagggatggatatgtgcattgcaggatgtttagcagaatccctggctacatatcagtatactacatgccagtagaactcctcccctcactgggacaaccagaaagttcctctggggacaaaatcttccttagctgagaaccattgtttaactttagacctgtgtgtgtcctcttacttctctcaatgtttcattatcttcaagtcttaaggctctcaaagattctataggaaaaatcagttttcatgttttaggaatccaattcagctagcactcaagctgtaacttctctgattattcaagaatgttgtcaatatttatttctatttcttaatttcattttctgtcttcaaaatttttgtaaaatgtatttcttccctattgatttctctgctggcctcattaaaattatgggttatattttttaaaattcctatttttttaattgaagtatcaagaaaaagaggaaaaggcacatgcttgatctgaactttatcaaaaattggtaattgttttcatctcttactattaactcttttttaaatcgatcctcttgctttaggaatccaaatcagcctgcactcgtactgcagtttctctgattagtcaagaacgttgccaatatttatttatatttcttcatttcatttttcgtctttgaaatttttgaaaaatatatttctccattattgttttctctgctggtctcattaaaattatgggttttacttgttaaaattgctgttattttaaagtagtgagaaaaagaggaaaatacatgtgcttaatctaaattttaccaaaaattttatattttagtaaatgtattcagatgcatatttttctgacaatgggcagtcttagttaacacctgtatcctttttcttgagcaagaaaataaatttattataatttttacttattctgccctagtattcctcatggataaatcgtgtcttaattttattaatctttgaatgcatcaattctaataagttggatcctttgtcagaaagcagaatgtgtacaatatacttatcccttagttttgtcttcctgggaactggctcttgatcacaataggatatatacctacagatcagcttcattataatttaatttactgtatttggcagcaacatcttctagtggtaacctagaccgagatgaaatattccatttcaattgacagttataaagctacagaccatagatttcagttatttgagtagttactacattaaaacacatctttttttcccttcctttgctcccaaccacatgtgcagcaaccagtatgtttctaaattttgctcctgtttataatgctatttcttaagcttctaaacatcgcagtgtgcatttcacctctgctaatctccatccaaattctgctatgttttggagtttgtaagaaagtgtagtgctgatgaggggattgaagtttcaggattccaattttggctgcttaacaggaacagttgaaggatggcatgaggtttttgatccatggttttccatttccctggtatagtaagcataggtatcactgccaaacttctttggagctctatgttatttgggatgagagcttggagctatgttaaacagctgaataaatgtttcccaatgcagctctgtctatgatgcagctcctgaaaattccctctgaatgttgtcaactagttttctcttaaattgagtttatagttgttttgtcaggtccaaatgtctttttgagactttactttgactgaacattgtgatagaatttatcctcctgcttgaaatgataaaaatatggacaaaatgtattaaataattgtttgctagatgttggacatcaggcaatgaggacaatgtttgctgagaaataggaaataaattatgtgaatcttacaattgacccggattactgcttacagagtatttctagaccacgacttagggagagaaatcccagatggagctcagagagttctccaaattgaagagatatagccaagtgtttcaggaattcaaagtagttagagtttgcagagagcagatagaggaacacagagataatttcacagatctacagagcatcttccttaagaattcactttactacggttcactgcatgtatgaggctgcagaaagcacaactttcaattattaaaagtaacaataattaacactcatgtaatgctgggtatgtgcctatttccactagctgaactggcgagaaaatttatgattcgtgggatatttgataagagtacacaaaagggtctagcctcaacagtggagaatagccctaggctgataactacttcaataccacctaataaatcttaagagcaagactcaaaaggaactgtttccaagtaatttaactgcatccaagaacaaaacacaaatatatttgtaagaacactgaaatatgtagtacctaacaagaaaaaattcacagtctctggcaccaaatcaaagattatcaggcatgtaaagaagcaggaaagtacaacttataatgaggatgtaaatgcatcaatcaaaattgatccagaattgtgagaaatgttagaattatcaggccagtatgttgaaacagatattacaactctacatagtttaaaagctacataaaaatatggaaggtactaaataaccccacagatcaaaattccagagaaaaacctacactgtatggaatgaaaatacactggatataattgattatacattaaacataaaacatttatgttatatataaaaaattagtgaacttgaagtcatagcaatataacctatccaaaatgaaacagagttgaaagagcatttgtaaaaatgaaaacagcatttgtgagctgtgggacaacttttagaggcttggtatatgtgtaattggagtccctaaaggaatggtggggtggaggtgggaatataaaaaatattcaaataatttatggctgaaaaattccaagtacagtacactgaaaaccataaagccacaaacccatgaatctcaagaaaactaaaaaataagtaacatgaaggaaatcacaaaaggcatattataattgaattgctcaaagctagtgataaatttttaatgataaaataaaatactacagcagccagaggaaaaagacgtgttaaatacaaaggcaaaacagtaagaatgacaacagatttcctatccaaaataatgcaaagaagaagacagtggggcaacattcttataactatgaaagaaaataaatagtgcacttatgattctatatctagtaaagatatctaagatgaaggtgaaataaaaactatttgcaatacatataatgaaagagttcatcacacagaaacctatactataagacacattaaaaagaagtccttcagtaggaaataaaatggtatcatatggaaatatggatctgcacaaagaaacaaagagcacccaaaatggcaactgcattggtaaatacggagggtatttttctaatgatttaattttctttaaatatagttgacagtttaaaaaataataataatatagtaaaagttttataacatgtgtaagtaaaatgtttggcagtaataacacaataattaggagggggaaaaggaagtacccttgacccttgaacgacatgggagttaggggcactgattccctgcacagtcaaaaattcaagtttaattttgactctccaaaagcttaactactaatggcctaccattgaccaaaaaccttactgataacatgaacagtcaattaacatttattttgtatatattatttactgtattcttaccataaagtaatctagagaaaagagaatctttaggacaatcataagaaagagaaaatgtatttactatttgttaagtgaaagtggatcataaagatctttgtcctcttcatcttcactttgagtaagatgaggaggaggaataagaggaagaggagagattggtcttgtggcctcatggctggcagaggtggaagaagattcttttataagtagactcatgcagtgataacccatgttgttcaagggacaattgtataccgttgtaagatccttatactctatttgaagtagtctgtcacttaaagctaggctgtgataaagatgtaggataaaaaccactaaaatcataaaacaaagagttataactaataaaccaacatggagataatttgaatcataaagaaatataaaataacacaaaacaggcaaaaaaaaaaaaaaggaaaaaagaaatcccaagcagatgggacaaataggaaatatcaagataatagatttaaacataatcatatcaataataatgctaaatttacatattctaaatactccacttaaaatatacagattggaagattggttaaaaaaggaaaaagtacaacttaactatatgctgcttacagaaaagatatttaagtataagacacaactaggttaaaagtaaatgttggaaaagataaatcttgtgaacactaatcataagaaatctagggtgactttattaatatgagaaaacatgaatttttagaaattttgtccaagataaaatattgcccaggatgaagaaagtaatttcattttgcaaaaggagtcattttgtcaataggacataacaattcttaatatttctgtaccaacagcagagcttcaaaatgcacagagcaaaaactaacgtaactgaaggagaaagtaaaatccacatttgtcggcaaaaatttcaatacccttctctcaataattaatagaacaaactgacaggaaataagtaaatctatagattagaacaacactgtcaaccaacttgacccaatggccagttatggaacattcaacccaacagagcagcaaactacacctacttttcaggcctacacaaaacatctaccaaaataaatcaaattctgaaccataacacaagcctcaatagatttaaaagaattcaaatcatataaagtacattatggggctgcagttaaattaaattagaaatcaataacaaaataacctggaattactctaaatatttggaaactaactaacaaaattctaaataatccaagattagaagaggaaacccaaagaggaattaagaagtattttgaactgaatgaaaatgaaaacacagcataacaaaattgtgagatacccaatatggcaggacttagtagtatattaatagcactaaatgcctatgctaggaaaggatgaagatttcaaagaaatatcttctactttacaaaactagcaaaagaagggaagacccaagccaggctaatgaaagctatttctgagtttctaactgcatctcatggggatgatcatttcttttctctgctcttgtggctgaaagcatgttaaggccaaaattgtgattcaggcaagacccaaatttataagaccaagattgcattttaagccataaagagcaggagaatctccatggcttgaactgtgaatagatatttgtttgttatcagagatagtaattgtactgctttatctgtatttccttccatgttagtaaaagaaagctcagaagtagttgatcacatgatcatagagaataaactacatttctcagtctccttggcagctaggtgtagaaatgtggtttaagttctggtcaatgatattttatctattaacgtttgctgtttaagttagtggctaaaaacaataaaaattgcgtatttatttaggattctatggtttggctcagtgctggtgtgcactggcttgtccaacctcttctgggctctctcatttgtctgtgattagctagctggtcaagcagcagttagataggaagacctcactctcatatgtggtggttggcaagctggctgttcactgggacagtaggagcaattattagctggggcacctcagttctctgccatccaacctctaatattccagcaggatagcatgagcttgctcacaaggtgatctcagagttccaagcccagcaagaaagaatgaactctaaatttgcaggcattttaaattgtctgtttgaatcatatttgcaagcattatatgtgctagtatttggccgaagaaaaccaataggtcaatctagagttattgtggaaggatcgtaccaaagagtgtcttagtgtatttttaaaggaaaggggaatgcctttctctctttctacttcttggtggacagcaattggttttagagtatgagtagatttgtattttctcacattaaaaagggagaatctacaactgtggaatctatagaagtaaactgggtattttcagttgaatcttgggaaactgactaaagttaacatttttaaaaataataatgctttattttatttttaaactacattttaagatatagttaatatacagaaattataatctatatgtgttacagagagattaatgaaatgggagtaaacttgttattttattaatttgtggcagagttcatatagaaagaattgtttttattgacaaaaatatctcgataagacttaggttttggcaagaatcaaggcaatattatacacttttgagatgtctgtgaaaaagtgaccatgtaaagtcaggtgtatagaaaaaagtgaatatgctttatagcagagcaaggaggaagaagagagaagccacagaagatggtagataattggagtgcaagatggtaggtaattggagtgccaatgaaaatctctagctatagggaaactaaagggatattatgaattgcaaagtaatgatttaattcctcttttaccccgaatctttaataaggtttaacgactacaatttgtttgtttgttttgaacaagacttcttgaaattgaggcattagctgagtttcacctctgggtgacatagggcagtgctggcagaagccagaaagacttcaaaatggaagaagcagaagtgtagggtcagggcgactacgaaatgatcaatacgcatagaattcttataaacttaaggaggacttctgtcattcagggatggaattagggtcataggctgccttatctagatttcaaaaggcaaggacgctccagatgatacatgcattacatgtaaataagaatacaacaaggccaggtgcagtggctcaggtctgtaatcccagcaatttgggaggccgaggcggacagatcacctgaggtcaggagttcaggaccagcctgaccaacatggtgaaactgtgtctctactaaaaagataaaaaattagccgtgcctggtggcccagctactggggaggctgaaacaagagagtcacttgaacctgggaggcggaggttgcagtgagccgagatcgcaccattgtactccaaatttgcaggcatttttaaatgtctgtttcaatcatttttcaagagttaaactccatctcaaaaaaaaaaaaaagaaaaaataacaaaacatataaaagataaaggttttgcacttttatttctctttaccttttgcacacttccttgctctttgaaaaagtattgtttacatgtaatgtttaagattattctttgacggaaacatcacatatgtccaatgccttaaggtgtttactatctctttggagaacaggactgatcctgtaaagtaccagcaaagactcaggcctgagttatgggttgatgtacttgaagtgttacaagtatgtacccacacgcctattggattttcatggtatgcctatatgttacacatatccaccaataaatgccatctatttttgtaggctgaatcaaatctctgtcttgagtaatgattttgtatcctttggactagatctgaataagactgagaaacagccaggcacaagaaggcaattcattgttctcactcatctttctaaacctatatgcatctttgatattgaggttcattattagctacaactacatttggtttgcatataaccatttatttttcagtcttagatattttcatatcaattgtcttaattatccttaaataaagcttccagtgagtctctatttcttggatgaggacaattgaggcagtgatagttctttaaaaattatttaatttctaagtccttcactatatcttgtaactgaatcccaacctagatatttttaaatatccttgaaattaaatataaatcaaataatatctttccacatgtaggttacttccctctatggtaactctgcctccaaatgtgaagagctggattcaatccaagtgaaagaaaatcagtggggaaaatgtcagggactataaaagagatttgaagtctgtacccacattgctgtgttagagtcctgagttattaaatttctcatatttatttgacattttatatacatatgtccacttatgaagagtttagttcttatctttctttaatcaacacagtattaactatgcatgtagtagatgaacactgtattttatgtatttgcattcttttcaaaccagatgcttaaagaataaaatgacacagtgttttagctgttattttgctttaaaatgctttaaaacaagaaacatttttggaatttcttatcacaatataaatcagctaagtatatttaatgtggtgaaatgaatcataaataggctgaaatagtcctaaaaggggagttgggtaagaaaaaaatgtattaggatcaatatcaataggcataaataattctattaacaaataacattaaacattgttacactgtttatgggatgatatcattatatcattatagaaagattctcccttaatttaaatacctagcatgtacaaaacaagtttaaatcaatgagacagtaaacaagaggaataaaatagagaggtgggctgggtgcagtgattcacgcctgtaatcccagcactttgggaggccgaggcgggcggatcacgaggtcaagagatcaagaccaatatggtgaaacctcgcctctgctaaacttacaaaaattagctgagcgtggtggcgggcgcctgtagtcccagctactcggaaggctgaggcaggagaatggtgtgaacccagaaggcggagcttgcagtgagccgagattgagccactgcactccagcctgggtgacagagcgagactccatctcaaaaaaaaaaaaaaaaaaaaaaaaaaggggaagtggtgtcctaaagactaaattaactgctgactattttctattttcagtctctacatatttatatttttatttctttatatagcattgaatggttaattccccatttcccttttattcttatacgactaacttctatgggttttattttcattcagttctgtatattccccctgctgaagcctcccatgttgtgtgtcaagaggaaaaatatcttattaccttcttgtctgttgaacatttagttttcttctccctccctccctgtcttgtacctaatgagcaaattatctaaaaatagatacgttcatcattctacaaaatgttgtatcttctctagattggaggacagtgtaattgtaagagacacgtgtctggcaggcagtgcaatcagtgccagaatggattctacaatctacaagagttggatcctgatggctgcagtccctgtaactgcaatacctctgggacagtggatggagatattacctgtcaccaaaattcaggccagtgcaagtgcaaagcaaacgttattggtacgtgtaacgcaaaagtttacagtcacatctctattaccatctggaataaaattctctatttgatttcttaactgaagagtaaagcaaatttctttgctcaagacaggctggaaaaaaaaacaatttggatgaaattaactgtttaaaatgattaaattaataattctatcaaactgcagcttgaagcttagtttaatcaaccctttagaagtttctttattctgtagatgcattaattcccatggtcccatactaataagtcatagaaaaatataatttgcttactgcatagatgtttcttttagaaaattagcactttttcaaaatgttttacacttaatgagttctaagcaaatcatttccatgctagttttcttaatagaccaaaataaatggattttttcaaaatattctgtgctacagggtcctttgtgataaatctttccatttttttctgttatatttctttgaactgttcctatgaaatgcaaaataagtcaacataattctacagatcatgtatattgctagggttacttacaaagggctacataattttaattttgtaattcagcaccaagttgattataataaacagctgccttcggtgttatttatcatttttttatacaagacgtgcttttttgtttgttactcccacaggtatttttcggaaattagatttgattatagcaatttattacatccaacatttttgaggggaaccaccgccacataaggacaaaatttatcaagtgcctaaaatgcactatgttcataatgcactttgaaattttgatatatgagaatattatgagaggaaagtttcctgatgaagtgagccctgtattgtaactgaatatgtcttggttcctataggaagtttaaaaaagacctttgcctttctattgtcattcaagacaccaagtcatccatggtttttctaacactgacctgaaccttacaatagtaaaaatatgcctggcagtgattacacacactcctctctctctctctctctcacacacacacacgaatgcttacatgtacacatgcatatgtacatatcattctgaatactattttcatttctgtgatatacctctaaatctaattctttatcttttatttatgtaagtgtacatcatgctacacaattcagctagacaagcgtttcaatttaataaagagaatgtaggtgtgtttagtggcattacacgagatttctctggtttaaagaaacattacatgaaaatctgtaccataatttacctatatgcatctcaagcatacagaaactaattttttagaaagaaagaataacgtgtaaagagaagtacatatttgtatgtgctatccatgatgctgaaggaattctaagaccctgaattcaatttgtatggcatcctttgttctttaatgtgagatatattttaaactcaagatgtgaaaacaaaagttaaagcaagacctttaaagacagtgaaataattacttctttgtatcaatggaatctttcttgtgatggttagattccagagcttgaggaagggaaaaatcaaaattaatttagaatgtataatgccatccctactatttgcctgttttgttgattgatccagatggttttctgcaggaaacataaatatatattttgtgaagactaaattacttcagtattataaataattattatttctagtgttatttctgcaaatgtagtactttttataaaaacaaaaacttgatatgcatatatatttactttcctaatgggatcagcaagtaactttattcaatttcaccttgttaatatgaaaaaaaaagaagcccagaaaatacaagtgtatgttgtatacgcttcagaaagcaaactgttagagttaacaaaactgttaaatcttactaatgattctatcaccagtaaaatacattagcaccaataattttattaaagtaggtcattcatctagaataaaaagggagaagaatgtgaattaaatgccaagtgtgctaactcgcctgtacttgttaacaccgaatgtgatgccctgtaggccttcctgagtatcgttaggaatagattacctgtcaggaatatgtatggcatattcaaataagcactgtgcatatttttaaaactgatatgatatgaatccatgtagaccaattttaatagttcaaaatgagtcataattcttgttaacaatacagttatttttaaaatttgcagcaatagtggtccttttttattttccttattgaaattaaatgatatgccttaggtgagtcattcatcactgttaaagaacttgccttcattggagttcttgaatttttatccatatatatacatatatattatgtatttccttccagtttaggaaatgcttttctacatatgagttcctgagtatgtttttgactcttattttaagattaatttttaaattgcaattatagcttgaaataaatgtttcagttgattcaacccatgcagtgagttatttaaattcatggatatttggaaactatctaaaggaagtattttgcatctaaacatttactattctaatttttttatttctttgccttgtaatacccttttatcttttagaataaccttacttgtcagagatttaagtttaggtgataaaacatttttcttcattcgtaaaatgtatatgtgtactcctttaaatagaagtaatataaaaaacagaatttacttagtgtttaaagaggtatgttctgagtcacacaagatgacaagcaatgtgattgctttatgagccaaggagagcatgatttatattaattgaaaatgataaaatagaggagcatacaaaaggattaaaccaaaaattgccctggataagttttatttatattaattacttaaatgtgtggattcagaaataagtgtatatgctgttttcacaaaaatagttatcagctgacatttttttcttttttcccagcttcacgaaggtataattaaataaaaattgtatatatttatggcagacaacatgatgttttgatatatgtacacattataaaatgattaattccagctaattaatgtatccatcacctcatgtacttatcatgtttttggggtgagaacatttaagatctaatctcttagcaattttcaagtatacaatacattattattaagtatagtcaccatgctgtacaatagagctccagaacttattcattctgtctagctgaaactttgtactcagcttaaccttttattaaacatctttagagatttcttatctttagaaaaacaactaatttgttatatgtaattctactataattttaaatgagcacatttgttaaaatagtttttaagatttgttaaagagaaaaagagctccagcatatgtaacagaaacaacatttgcattaagcatttttctttgcattaagtaataattaaaaatttatgaagttcatcgcaaacagttgtatattaaagctaaattaaatattgtcattgaattttgagagtaagattggccccctatggcattgcttgtgagaaaacactcaatattttgtgttcgtatcatctgcagtagcattgtttgtgtctcgtctatcttgaatgaaatcattttcccatcctcaccttttaaatatattttatctttagggcttaggtgtgatcattgcaattttggatttaaatttctccgaagctttaatgatgttggatgtgagccctgccagtgtaacctccatggctcagtgaacaaattctgcaatcctcactctgggcagtgtgagtgcaaaaaagaagccaaaggacttcagtgtgacacctgcagagaaaacttttatgggttagatgtcaccaattgtaaggcctgtgactgtgacacagctggatccctccctgggactgtctgtaatgctaagacagggcagtgcatctgcaagcccaatgttgaagggagacagtgcaataaatgtttggagggaaacttctacctacggcaaaataattctttcctctgtctgccttgcaactgtgataagactgggacaataaatggctctctgctgtgtaacaaatcaacaggacaatgtccttgcaaattaggggtaacaggtcttcgctgtaatcagtgtgagcctcacaggtacaatttgaccattgacaattttcaacactgccagatgtgtgagtgtgattccttggggacattacctgggaccatttgtgacccaatcagtggccagtgcctgtgtgtgcctaatcgtcaaggaagaaggtgtaatcagtgtcaaccaggtaagaaagaaatgtattacattttcagtgcacaatgacattccttttgttaacttaggtaacttctccctgtttctggtttgtggcttctacaaattttatttccaaaatcattactgtatttatatcattatccaacacatatataactatttaacttattcaaaattatctgcatatttatgttactattttgagaggatactttagataaaactcagccgatcggatttatttcataattgagactcaatttctacacttgaagtaaatctcctttttaacagttttttaaaaatcagatcaacaagagtcaattttattttccagagaaaggaaaatttgagttgaatatccatacaatgccaaatattcaaatgatgaactaaatctctgaataaagctggctaaatgtttttgctgaagaggctatatgttctagttttatatagaaatacctagaattgtttccacatgccatcaaattaataaaataggccactgtttaatctcattatatacaaacttatctttccatctctttcccaattgggagagggatagaccccatctatggctctccttacatttaagattttaactaaaatactataccttctttacaataaattcattatgatatgatgataaatataagtacttatccgttgtttaacagctgtgctaattgttgtcctgtcagccaatattagctctgagttatatgggtctataaaaatgagcatgataccaactcaaaagtgtgatttgcttgccagagaaggagtagaacaaaagttctgttaacatagcaaagaatccagcctaggataattgggccatgcttttcctttggcattggtcagtgtgtaagatcaaagagacaagaaggaattgatgaagagttcattctttttgtgatgtaagtattaaaaaacaacttgaactggtttaaacataaatggagactatattataactagatactccataaaaacctaaggagaaggaccactgcagtcaggactcaggaattagaatgcttccactgatacatattcatttgtctctctctctctctctctctctctctctctctctctctctctctctcagaaggggactttacctctctctttctctacatgggtatatggccaccctatgtcccctgaaattgtttataattctaccaccagccacaacagagcgatttattagctacctcttagttataatttctagaggaaaattcgaattgactcagttttgtttggttggttacctctgagccaattcattgtggccaggggtgtcacgtacttataaaatgagtatagcttttagggaccatttcatcaggtagaagcaaggtggtaagtatcccagaagacaggaagattatggagacctgggcagacagcctaaatgacagatacagcacattcactctttttaccttcaggttaatcctttcaaatttgcaatcaattaactttttgatatcctaagatgagatgtttttttctcttttagtgtttatcaatatctctaattttggcaacaaagtcctttgtctcctacacagtcaaataaccatgatttatacatccttctttctaagtaaaccaaaacaagctaatagatcaaatgttatatccttttgagtaattatcaattgttaaaatttactgttccagtctaactttaattgtatgtataatacaagtcacatgttttaaacaatttttctgattttggaaaaactctgaaatcatagttacaaacatttgttccctttggtccttccaatgaaagacccaatccatcatctcaatactttgtacacctaccagatatctaaatgatgaactaaaattgttagaaaacctttgtttttctggttgttttgcatatcattgcagaaaaagccatggataatttaatctacaccatgcataagactgtctcatttgttcccttcctaggatgaagaaatactgacttcattgctctttcctttatctttgtggctctcattgtggtgatctctttgttcccaactctaagcccttttctcccacccaaatctatggctctttcctgtctaccctatatagtattggcagaataattcccctaaagcacttaattcattatgtcattctcctgtagggttaccaaaaatgggttttattttgcttatcatttgagtccaatctgggcaaacctttatgagtttttatcttccggtcgcagtctagacacctagctttgcttcctgatattccctttctcccatcttcttcagtcactgcagccacttcactggagctacacatgtcacatgcagagccgatttcaatctacctgatgctttggttcattctcctttcccgacatggaatgcagtataatcctccttttcaatgttagttggcatcctctgactagttttactactcaacatactgcctaaaattctccatcactcagtgaacaacaaagttgacatgaagcatcagtgttttaagaggtggtttaactcaaacctatagaaaacttgaaaataaggtgtttttgaaaatgtgctcaagcttctattgtcttcatgttcaatttattatatgaccttgaagagaggtttatgttcaagaaataataatacagatctcattgtaattaccccataattatgcttcttttttctgaagaccatatggacctataaatgaagtcaatgagttaagagtagggagcattaaacatggtgaaaatatttttatttactgaaaaaattcaacagcgtattgtaaaatatttagtagaaaatgtaccagactgagaaaacatatttggagctccatttcttcagcttactgactctctaaaggcattcccctgtccttctctacagggaacttccatattttcttccaactgtccatttctagccaggggtaagcagatttatctttaagctgttacctgagtggagcctgtatcagttctactcatatcctattgatcagagctgctttgtatatccatacctcactgcaaaagaggctggcaaatagatgctctatctgaatatcaaggtatatatttaaaacttggggcctcttttattataaggagtaagaaagaaattgatccttgaagacagccttggctatactaggaatgtcctacacctaaaaaaattagctggcagaacattagtcaacttccaaatagatgcttttaatgaccatgagttttgtacttttattgatagatcccattattatcattttttaaaaaaatcagccaaagttaatgaaggcctcttgagtcctgaggaaatatatgcacaaaatcccttcttgggatcttcgactgtttcttacatgctttgccttatagactcactgctattctagtcactcttccttccaaggacatgctacagtttatagtggccctgctgagttattgacccaggatattaacctggttatgaaaagctagaatgatcaagctacagatttggattattatattttgttgaacagtgcagttattttcatatagataaacatttctcttactgagaaatcattttcttctgggtactgttgagttcttaatttaatcagagaacattttatgtgtagtagcaaacggtactttcagtgagcttaaattttgatggggaaactgacagaataatttgcaaataaatatatgatatgaatttaaatagtgatgatttttggatctgtggctctactcaattatgtttctttcttgctaagagtttaagatattatcgaggttaccaaatagactatttatttagcacttttatatcagtgtttagtttccagaaaggtgaactgggtagccatgtttatattgtacaagtgaagtcacattgatattttattgcaatggaaacagtaagtggtttaaaaggaggaatggtgaagtgaaagaaattatcaacctgtttctttttatattattatctaaaactagtcatttttctgtttttctcttttgcattttttctcatttaagatcataagtgcctgttttaaaaagcagcccaatgagatgaccttgttaaaactcctgattatttctcagtatcgtcaattaaatgaaccccttattgtgtgcccacaatgtacaaggaattatatatacatatatatatattttttttttctttttttttcttttgagatggagtctagctctgtcacccaggctagagggctagagttcagtggcgcagtctcggctcactgccagctctgcctcccaggttcatgtcattctcctgcctcagcctcccgagcagctgggactacaggcctggctaattttttgtatttttttttttttttaaagcagagacggggtttcaccgtgttagccaggatggtctcgatctcctgacttcgtgatctgcctgcctaggcctcccaaagtgaggaattatattattattgtagttatgcaagttgaataaggtaatccttgccctcaagatattgaaactttaacaagggaaataagacatttgcacaagtaaataaaatacgataatactttaaatgtgatcattgtttttcagtattagtgttgatgcccattctacatcttcctctaaagaaaagaagacaatttgcaataaacctttggaaaggagttttgttgcgtctgtacttaggcaaatcgtgactaagaagttattctcctaatggccgcacatggtggctcatgcctgtaaccccagcactgagaggctgaggcgggtggatcacctgaggtcaagagtttgagaccagcctgagcaacatggtgaaactccatctctactgaagatacaaaattagctgggcatggtggcacatgcctgtaatcccagctacttgggagactgaggcaggagaatcgcttgaacctgggaggcacagattgcagtgagcagagatggcgccattgcactcctgcctgggcaacaagagccaaactccgtctcaaaaaaaaaaaaccaaaaagacaaatatataccagataaagtcctccaaaaaaagagccaggaaaagagaaaggagaccaggagggggttgcatgaagaaaatttagtattattatccagtattgccattgtttaacataatttgagttttaatcaaaatttacatttgcataatttaaaaaaccaaataaaatgtaaagagccctgccttatcattttcctaggaatttccgtgcttagagaaaacaccttcaactcctttagatgtttattctgggctttcatgtctgtaattctgggttttacatatatttcaccttgatttttaaaatgtagatattatctattgtcttcctcctatagaagatgaatgtttagctcctttcacctcctgcttagcaatccctttatttggttaaatcagtattcagagatttctttattatgactatataaatttactgtacagctatgccatataatatgatttgactatattttctttgctcaaaaaatttgtcttccttagtttttcaggactctctttggcatttctaggaaacaaaactctccaagggaactctgttcaagaaatctatcaggttttgttttttcccactagatatatgagtgggaagttcaggctggttgatctttagttctgttgcacagctatatccaagggctaacatttgctgctatactagggatttccttcccctgtctcctatgttggatcctccatttcctgaatcctacacgttctctcttcttggtttatttgtgtatttggtagagcacatgttctagtagcttctgaaaaagaatacaaggagggaagtaatttgaggagaaaattttgaatatctgaagtgtctttattgtctacaagtgtctaaacataaagaacgatttgaaattttactattatatgaaaacttttcattaaaaaaatttaaatggttgtaccattagctgttagcaatgttaatcagattctttcttcttttctacttttttttttttttttaacgacctggaagtttttaccatctctatatccctgggcactcagtggacccttttgcctatcagtgatggctcttatgttctgagaaaatctgcaaacacattcatagcaacatctagactcatgttcgaccaaacaattggacaccaagcctagccaagttgatgcataaaatcaacaatcacaagcaacctttcacataatgcctgtttacatacttgttgagtccagactttctttagtttaacttctaaaggaaaagcttactgcatcttcctgaagtgtaagagggacaacttcctggttggggaaggtatttagcacaccttatatctgacttcggaaatctctggggctttcaattccaaacctttctgtctagagttacacaacttgaataaattagcttattgtcgggctctccactgcaagagcttagctttttcttataggtatctataattgattgtcatttttctccttctctctttttttttttttttttgtttatttcatctctggggatttcaggagggaaacattattcaatctaccatgttttactgacaatgttcccctagtgtttttgaggttttaatcttttcagaccaaatctttgcagacatccttgagccctctcttttccccacaacctttgtctcatctaataaaaccaattctgctgattttaccttcaagtatatccagaatttgaccacttcttgccacccttacttacaccagccaggtccaagccaccttcctctgttcctggactattcaagtagcctcctactcccctttatctttcttccatcacttctcaacagacagccaaagtgatgctgttcaaacttgagtaacatcccatcactccaccttccatttgcttttcaccatagctaataagaaacaaagttgatattctttaataatcctcatggtctataatgtccatgaactctctgacctcatttccacaagtcttcagatcatttcttcctctccagccaacaagcctcattgctgtccttcacaactgttcaatgctctatctcaggcaggtataaaagtacctccatagcagtgctccctatatattttctgaattaatggataattatatttcaaaaatacctcagtggcattctcctgtttttaggtgtgagcctagcaaaggtctgtggtgtttttttcacaacacttacgaaaagcgttgtgttcaaccttgcaaatgaggaaaaataacagtgacctaagtatcatatattttttaacaaaacaagatatagtctgcacatattcatagcccacgaaaagagcaatgtgtgctttggggtggacatttttttattttttattttttattttttttgttttgcttcagaaattccactttaatgtttttttttttcctggttttatggtctcttacagtaaaacttgcattgaaaagagaaacccttatcctgaagtatctttatcataaacagatgtttgcagtagccagccctgcaatgtgcacagtaaaatgtgctgctacaatctgaagctttcatttacttatttaaacatgtctgagagacctagatcatataccacaggggcagacagcatgctggtgtgtgagcagtggggcatggagggagaaggatggggtaggaagggatgagtagcaagcttaaggacttctgcctccctttcatctgtgattgcaaatactgctgacccatagtagatgactgcacatagattcttgtcccactttcctaaaaaacattattaaggaaggtgcatgtaatgaaacctcatgtattattaacctaaccttactacgaatgtacaaggaataggtttaattcaagtaaaatttataggcaatttgttaaagcagcagtgcacattagaaggtacattagagacacattggttttaatatgccattcaataacttgaacagaggttaaaaatgctgcttaacctccattaagtattttaaaaatgctttaatttaaaattatttggagtgtgtgtacatatatgaatgtacacatatccacactaataaatataacactaaatatgttttcccagttccctttttcagtgctggatgaccttataatgttcagcagtaggcacttaatcagaggccaggccgaggaaggcagggaaggatgtcaacgcatcccgagccagtgacccacccttgtccttgagaactagaggcagagagtgcatattgaagactctgtagctttggaataaaacaaaggctaatttataatgaaaacagcttcctatgacatgttttgtactaatagggcagtgcctcctgcttccccctagtatttacttttggttttcttttacaattcataaaacaaagtatcttgtttcattaagtagcacatcatatttattaagtaatgagctcataaactagaattgtgtacaagaccctgccaatggaattggaatcagatgctgatgttccattaaaaatcaatgcatcaaagttgatatccaattatgccacatttcctagtgtttggtgagacaactttctaggttaacatgtttttcacagagagacctgaatctaaaagtaagaacctcttccttgataaatcatcaggaaggaatcttgtcacaggaaatacagaccacaatcttaggtacatctggaaaacaaaaaaaagtaaaagacactgataagaaaaatttctctgtcatagaaaacttgctaattgacaattacaaagatgataatagataatgtttactgagagtccgctgtgtgccaggctctgtgataaggttttgcctgcaaactttcatttaatatgcacaatatttctaagatggaggtgctgggattattctcattttaatctaattgggggaatgaaatctaattaagtagaagagccatttataagtccaggtccatctgactccagaatgtatactctgaaagagtggaactttttctttttctttcttttttttttttttttttttaagacggagtcttgctctgtcgcccaggctggagtgcagtggcacgatctcagctcactgcaagctaagagtggaactttttctaaataactaactcaatatttatcttacacattcacacaacaaatatttgagggtgagttagataaatactgtttatttcatccactttcaagcatacctcaactcatgattctggcttactgcttcacattctgggatacctcatttgttgttcaaaacccaagtagtaggcataaaatgaaaattaacagagtcctgggaaaccacagagttcaaataatgatgaggtaaattgaaggggtctagaaatggaattatctccgagaacttagttggagaaattctggagatggttggaatggcacaggagacaggctttagagcatgcatttgataaacactgaatgggaacagagaatataagttttgctgtggattttgaatatgcatacacatacatatattaattataatctccaagatgtaatcagagttgtcattatttgggttatttgttgttattggatttgattcttagagaatatgttaatgagggcctttcatgggtattcacataaatagaaaaattggattatttatgaaacagaaaattccaataatgttttcccttacatgagcatattattatgtcctttgtttaagagctaagatatagttttagggtgacattttctttctgcagctctgttccatctgttgctgtgacgagcactatattttaaatttattgtgtctgatccatatacactcctctctagactccctgataggacaggccactctgaccaaccactctcatgactcacagatttatgtttaccattttccttttcagtgttaaagggatcatctcatattttagaggatagaagatatttatccatctatccacccattcatccattcagctatctatccatttcattcatacatctgtttttcaataaacatctattgagtaaattaccagagactatgttggtgttaaggtatacaatcacaaatatactaagacattgtgatttagtaggggaaactgactcacatgtaaatgtatcacaatgtgatgagagccatattagaaatatacaatatagagaagtagtaaagtgaaggaaatgattaattcttgaaggatgaggggtcttaggaacttagagaaaatgatttctgaactgacttttaaaaggaaataggaatcagcaagctgctcaagaagggagtagcagcccagaaaaaaaaaataacagcagaacatttaaagcatacctaatttaattgaaaaacccttaaaaattgttttaaaaaagagaaattataccttgggatgaataatattaatatttatgtattcacttgatcaagtctagaagtaattttagcatgattttatataaaactaccaaatggaggaaaattattattgttttaatttgaaaactaccatcatcaactatactgaaatatagtttacaaacaatacaacaatattgaaaatattgattcataaagccattaccaagatagtcttttgttgcatggatataggtgagccacccatccctccccaggctcttgtgtaactattatgtccattttctgccttaaggtgagagtagtttcttctaaatgtcttacaattagtgcttagccccagcattgccctcctttcttgaataaagcctagaggttacacttcttttctttctccctctcaagaccttggcaaagcctagttgttcatggtcctcaggagagacattgctgggaaatgggctcttcttttatgcccaggacaagtactgtgctatgcaaatagccgctgcaggagataataccagctgccttgctaataactttgaactctgtagattcttctcctaggcaaagccacactattttacaatatgggtgactctttgttttagctggatgatacatttttttccacttgagatttgtcatgtctaaaaccaagggtcagctaaataatatgggaaaataataaactagcgagctgatttggaccatgtatatgtgaactctcagcactacgtaatgcaaggtaataatgttgtcctaatgaccatgcttaagaatgtggtacaaaatcattcatggaatgaaatctcaatatgatcagttacaatgctacagatatataaagatttggaacatgaagaagagctaacaaaggggtatcagaaatgcattacattaaagtaaattgaggtcagttataattaagccacattcaggagttgatgtttaagtggaagggaagggaaaagattgttttctatagttggaagtcataaaaggaggtaatggtctagaattaggcacattcaggtaaggcaagaggtaatctttaagcaggaagttacctgagtcatcctaattagaactgcttaaaaataggacagctaaaatactggtgggattaacctttataatcaggctcctgagaggaggaggggaattaaccccaaggcaaattcccatgcagtcttttcctggaagccctaccttcactttcagtctccctaggtgctttagcatctttttagttcttctctgcttgtacttctgatttttctgtgacattctttattccccaaaacttggactacccaatttctgcaccaaaatgctatcccctacttgtacttacaggtttatctaatacatcatttcttctaaaaatcgcccttaatttttccaaattctctgtggcttggagctattgcagtaagtctaaattaattctacttgtaagtatctgtgctaatgggtaatttatccaaattggagagctgttagcacattcatgatgccatcatcatggatttaagggcctagataccttcacaggaagaaaaatacaaagaatcacaaccacagtggccttgaatttaaatggaagccttctgaatttgactttgatcatgtgatgaatcaggtacaagaatatatactaattgtcatggccatgctctatttctggatatgtatatataagggaaattgctgtcaggtggtacaaataaacaaatagcgtaacctggctgtaaattatgataaaaatgatagtattagttgatttccgccaactgaatggcacatattttgagctctttcttttcctctcattgagcacaatgttttctattttgctgcccttgaaactttgtaagacagaatgtataggatctaggggaaggaaaaaaacccaattgttggtaactataagaaaatggcttgttttcaacaagagcctggaatgagttttagagtatcctaattactttttgctgttccctatataatagataagagaatagattcactttttgctcatgctctccttctttcaatatcattgctattttatgaactttaaattagtgtcatgacaattgtacaattcatttttatttgctgtaactgtattcattagaatccttctgtgatccttctaccccattgtttcagtaaaattctttgcagcattttgcacgggcttgtgtgtgtacccatgggtctgtgcatgtgtgtatatgtatatgtacacatacatgaacacacacatcacacaacactaagaaccatttctccctcatatgcctgctccacattcaactgcctgataactttctaattctataacagttaacttccatctcctgggtctgaagagattttaagtaatttgaataaacttttgaatcatatttgtatttctttcctttttccataagaaaaaaaatatgagttttagaggtaagctaaaatctctaaattctgcaggctttttttgtgtgtgtactacttgcagggctcacagcctgtttaataattgaactcatttttatttgttcatcgaatgtgtttggaatgcctactatgtgccaagcagtgtactggctgctagggagacaatgatgaatgaagcagatgggttttctgcccttatggaagttagattttggtggaaatgagattgattataattttcatgaacacttaggaaacaaacaggatgctatgcatttgtaacaggtatacctagcctggcctagggaaagttgcctgaggaagtcacgagacctgacttacatgagtgaactgagcaacagagataggtcaaaatcatcccagcagacagaacggcccatgaaaaggcctttaggtctcaagaagaggaacaaatatgactgcaatggactgagcggggggatgagccatgagctaaagctagagacgtagctgggacctgactgtaggattgaaagctgagtgagagatttggatttatttcctaaagggaataggaagtcatcaggtagtttcaaatagagaagtgaaatgtccaaactgcactttggaaaaagactgctacgaagaatagattggaacaggacaagagggatgcaattagaagagatggcctccgggactgggtggtctgggtgtaaacctgggttttgctatccattaactctaccattttaggaaagtgtgttaaccttctcaatcttctgttttccaattgacagaatagatgtaataataattcatgcattatttgcatttctatgacaactaaatgagatgctcaagataaagcccctacagtagcatctagtttgaagtattagttataaaaaaagtggttggtgactttatctgggaggtcgtagcggggatgaagagtggaaggtttaaaattgttaggaggcaacatccataggacttggtaattagcaaaatatagggggtcagagaagtggaggatgcaagcttttgttttagtaaaatacagaattagtttaatttgaatttcagataactttttttagtctgagcaaatgctgcatgggctgcacctttgctaaaaaatttcattatttgttagaaattcaaatgtaactggcttcctatattttataagtctgccctaccaaaggtacctcagtgttctaggcaaagcaactgaatgactggtaatatctgttggaatggagctgattagaggaggtcaagttttttgtagaaatattgaaatattgcatggtagattttaaatacattgaattgtaggacctgggaggcacccaagtccaatgtagataatttactcagtttttctttggtcataattgacacactgaaggacagatataaccacatttgtattgggaattagtgccttggtagagtattctgtttttctgtgtaatcaattattatgctttaaataaaagagtggataaaaagtatatataaaacttttaatttctttatttctaggtttttatatttctccaggcaatgccactggctgcctgccatgctcatgccatacaactggtgcagttaatcacatctgtaatagcctgactggtcagtgtgtttgccaagatgcttccattgctgggcaacgttgtgaccaatgcaaagaccattactttggatttgatcctcagactggaaggtacatctttataagctttaataatttaactctttctttagcaacagttaactttttttggcagttgcaaagcaataacttctgtaaaaagtattttttttgcccggcttggtggctcacacctgtaatcccagcactttgagagaccaaggcaggcggatcacgaggtccgaggtcaagaggtcgatatcatcctggccaacacggtgaaaccccgtctttactaaaactacaaaaattagctgggcaaggtggcatgcacctgtagtcccaactactcagaagtctgaggcagaagaatcgcttgaaccgggaggggtaggttgcagtgagccgagatcgcgccactgtactccagcctgggagacagggcaagactctgtctcaaaaaaaaaaagtgtttttttgttattgatatgttttttgttccgtgacatccacatttacttaatgtatgctaatctttgaatatttcctagagtgggttgctatatattgatagatgtggcccatcctagcatctgggaatgttgaatgagataaaatatattttctctcaaaaagctgagagtctggatgtggagaaagacaggaaaagacatatctgaagaagaaaatacacatactcatactttctctctctctctctctctctctctgtctctctgtgtatatatattatatatatatattatatatatatatatatatatatatatgggatatatgtatgtgctttgttcttcattgcccttgaatttattgcatatttattagttcattgcatctatttatattttccttgcgtttctaatttagctttaaagactggcagatgagaaacatagctttgtattctgtgatatgatttttttcagtatgtaaagtatattatgaaagtaaatcatttttcaaagttacactctctttaatattctacttcttattctctgggtatctgtggccatttgccttcactcatttgtgtttattgctgtatttttgaagatgtgctataatgccaattctgtgtctgtgtgtgtgtgtgtgtgtgagagagagagagagagagagagattatgagcttgtctaaagttcagactaaatctatgaattctttgaagctcctatccctgagaagctagtagtgtgtgctgaactcagaaagcatgtaataaaatgagtcaaatctgtctctcaatatgtgtatatttataaatctaattgctaattatttcagggtttgtgattatctgggctcttttaaactcattgcccccctgctgcctgccttttggctgttccactcctcattaacacctccattagagggtggacaggtgacagggtaattactgaaaaagaacttaaactagttcattttgactttcttttaaaatttgatatgatttttaaaaactacaaaaatcatttaaaattttattaaaataatttttgttttcttgacatacatgcatatattttaatctgtgacgctctacttctatcaccgtagaaatgttaccttgatggtctgagaccattgtgactcttttctacagatgttattataaatcatctaaatgagtatacaaagcgcatggtacagtaaatagtaaataaaaagcactgtcaggattttgatagtaaaataggagccagttactgcacatactagctcctagatgtaatttttttgaaataatattctacagattccccagttggaactcttgggctggtttgtttcactcctggccacctctgtctttttcatagttctgaccacatttaccaggagaaaaatatcttccccaacccactgtcctccttgcaacactcattcccatcagtgccattttgtgacattcaattacccatttttgttctactcatcccctttgtcagtcttcccagggttatcagcaaaacgcctgctcagtgacctggggatgtctgattgtctcagctttttcacttaactttttttctttaagtgagatctgattcccttcattacactgcttcctctaccctacaatgttcttaaattcgtggctgagccttttaccccattctgttcctctcccattatctacccatctcactctcactccccaccttactttagtccaggaacaagaattgcttaataagtactgttccatcacctgtcactctgcagtaggcctgactagcactggagctagattccctgggttagaaggtggatttaaatgtttacataaattgataaggaataggaaggaccaaagaagtgggtataagctacatttttagaagataccgaagttacaataaagaaagaattcagtctaggcactatggctaactcatgtaatcccagcactttgggaggctaaggtgaccagatcccttgagtccaggagtttaagaccagcctgggcaacatggcaaaaccccatctctgtaaaaaataaaaagttagccaggtgtagtggctcttgcctgtagtcccagctacttgggaggctgatgtgggaggactgcttgagactggaaggtcgaggctgcagtgagtcaagattgtgccactgcactccagcctgggcaacagagcgagaccctgtctcagaaaaaaaaaagcaaaaaagagagagagaaagcagacttcagattcgcaaaaagaatgaggggcaggttggagtctagaaaatagagctaaagtatgagaagctgagtagatttctaaaaatatgaatgattcagattaagtgtggggttttttttttggacagagtctcacactctgtcgcctaggctggagtgcagtggcgtgatctcggctcacttcaacctctgcctcccaggttcaaaagattctcctgcctcagcctcctgagtagctgggattacaggtgcatgccaccatgcctggctaatttttttgtatttttagtggagacagggtttcaccatgttggtcaggctggtcttagactcctgaactcgtgatccgcccacctcggcctcccaaagtgctgggattacaggcttgagccgagtgtgtgttttaaacaaaaagatccacaagttttatataaatgagtttggatatctttacatattagttggctcctgttatattgatgggggtggtgagattacctttttaaaattacaaattgtccttggaaatggtcgcacttttcttccatccctgtattagtccgttttcatgctgctgataaagacatacctgagactgggcaatttacaaaagaaagaagtttacgggacttacaattccacatggcttgggagacctcacaattgcagtggaaggtgaaagacacgtctcacatggtggcagagagaagaaagcttgtgcagggaaactcccctttttaaaaccatcagatatcgtgagacttatttactctcatgagaacagcaggggaaagaccctaccccataattcaatcacctctcactgtgttactcccacaacacatgggaattgtgggagttacaattcaagatgagatttgggtggggacacagccaaaccatatcaatcccctttgttcttatctttccagttccaggttttccttttcagagggattctatttttctcccttttctaactcctgccattattttaaactactttgacatgtactgatgcagttctttggcctcttcattcattccccactccagcaacccatttccatggctacaccctggattttgtgatcacttataatttctctatttctcaaatcttcctaatcccatgaatgctattctatggatatatcacatctttccaattccaattcaccctggaagcctcacataacctgctccttaacttctcttaatctttatcccattatccctccttaatcctcttttgatcaaccccatccctaacttcactgtcttctacttctagcctgaggcaaaacctttttaattatgacccttttgagtacctgattgtgggctcccttctgctgtactgtggggtcagctccagagacgatcaccctacacctgccctgatctgtgaggacgtggggaaagatcatgtgcctatgctgatctgaagcactaccatgtatgtacttcttatcaatttactttctttccccctttaaactcctaccagtctcctcagttttaattccatgctcttgcccttgcagataatctggccctctgctcatagacaaaataaagccagatatatgtatctccagattatcttttctccacctccagcttgtctacattgtcacacatttttaattttttatctagtcttagaagaaaatcctgtgtatttttgcctaaaaataacctgttcccagtccttgatatgatcccttcctgttttcctactcttgttcctccattccatgatctttgctccatcaaatcctccctttattttaactcaaacatctctctataggtaatatcataactgcctacaaaaatgctattcattctacaaactccttcctttgattctgccctgctttatgagccctgaaagttattgtctaatctctcactcttcattcacttactaacatttaaaaagagcactatgattcaagaaaacatgatttaaaaaataaaagatcagattttttttcttcttcattttgtttctttctcattcattctttattcaccatgtgtggtacatacatgttagcagaacatacaagttagcagaacttgcaacatgcagacattcaagaactagttatgtgactattaaattctcatccaaatcaaagacaaggtctataaagagatataataaacaaaaatgggttaaggaaaagacagaatgagggaacaggtttcactggtgggaaaaagggaggggtcagtggtgctttccacttgagtccagtgagaaggtcttatttgatcccttgaagggtgacatgtgtctcctgcagttggagagaccagtgcattgatatctatcttagacctggcaaatctaactgagaagagacagtctacccaggtttggataggtaagctagaagacagtgccctgcatatcttagactcccagagttcatcatgacaaggaagactacgtatttctcatgaccagatgaagaccacaaggaagaaagacagggtaaggttgtcttagtctgtgctcaaagtaccacttagaagataaaggggcctgtgtagaataaaggacaagattactgtggactacaggttaataagcaaccagtcgaaaagaaaatgcatctgactgcactaaaacaaaaggtgagagatacctaatggtgagaaagatcaatgaagaagtcaggaatgtaccactgtcagtgataagtcagttttatgtatatgcaggaccagagacaatagactgctttgggtggttctagtccaagtgagtttctacccttcctgcagcctctacatgagggaggaggctaaccaagctaccttctctgattatagacttgctgcctttatcatgtcctagcttgatgaaaggaagagaagtatgttcttgaaaatgtctgttctttaaataaagattggaatgttgactaatatacaggattagactttctattttctgaattgaatttgtattttgcaatgtaaagtaactgtaggacattctattgcctgagaaagaccagaaaagccaagtgactaactcattttatatccacatggaacatgggggaattagctccatattatatgtttaaagggtcagtgaaagacaaaaataaaactgatttatgattgcttctcatgacttatggtttctcaatgtgctggtcatttcattgttcccatttatttcttaaaattacctcttcctttggtttccaagattctacttctcttatttgttttctaactctttttttggctactcctttttaatatgtcctttcaatttccacaactgtgtccctgatttcaaccactacatacatgttaatggctttcaaacacatgatcacccattcagatgcctgccacgcactctaggcctgtagccagctgtctctctgagttttacgcttgcaagtccctcgtgcatttcatttttaatatagtcagcacagaactaaccattacttcctcatctccacccaaataaaaataagtcttatgccatctcatgctatcatcatcttggtgaaaaagacgtaaaacttcaaataattattcaagtccaaacttcccaagtttgagtggggcttagattcttctcaggtttggcagaattggctctgttgttgagtagaatgagtctacaggctactgctggaaagtgctatggaaagcaagagctactgtatataatgcagcttctctaaaaagaatagaaagaataaagcttcccatggccatatgggacccaaggagatcagcaggatttgtctcttactaaatcagtcgtgtggaatgctggtaacttgacttgaccctcctatcccactgatgaattcagctgtctcttttcacttcaacattgataatcattacacaggaaatcctgtagcacagaagggcatggagaaggatattttaaaatgtgacaatgagaattgcttgagtttggacttttgttcaacattgaaaagagataaaagtgggttctttttaatgtttttccattcctcttttgaatgataccgttcttgaatctttttttgacttctggttgttattgtatatacaccaacattggctatattgaaaatgtgtaacaattgactaagatatatgggattccatcaagtataagaaatttttgttttttaaaggaaaaaattcacatgtaatgtaaatatatacagatatgcagtataggaaaacagctatgtcctaatgttaaaacaatgtttttgaaaacaaagtagattcaaaatcatttgaatctactttgaaatctaggcactgtggtaggttattacaaatagaaatgtttacatttataaaaattacattccaattataacaaatggaaattaaaacattaattttcaaaatatacagtagattataagtaacttattattatgaaaggggaagatacaagtatcatattatttcttcatcaacttggaaaataacctcacttccttatctgcctggttcacatattccttaccttcttcatgctctatttgttggatatagcaaggtttgctatattgttttctcttggtttatttgctacacagttttttgtattcccaagggcaaaataaataaaataaaatagacctcggccctaaactacacaaccaacaacaaaaatccaggcaacacaacaatgactttttgtgaccaagctggaaaatcatttgcctgtttccatctaagtggtttattcttcaaaagttactgaccagaaaaagggggcatgtattttaaaaagctgatcctagtgcaaacattactccatttacctctgacacataaagcaaacatgatttaatcagtatcgaaaacaatgaagcaaaaaaaatctgcccactgaaaaatcaataatgcaaaaaagtatatagtgtttgtctaacccaaaaacaatgagacaaaaatgggccatatttaattcatctcagttggtagtggagacccatatttgacaccctgcacttactggcactgtcctcaagttgacctgtgactatgactactctcccccatagcccccaggactgctccagttcatctggtaccccacagttttcttacataacaaccacacatcacaacccccaaaagtttcttccctaatgatataccctctctatattctatgttaccttgttttaagccttaaggagttagtggtatcactatttgtcccatttactagctgacacacactgaagttgtccatagagggtaggacaccaaggctggttagggagaataaaggctcagacttctggagcataaaatacagggaagttcttctatgcccagattatttttggttttactgcaaatgttctacatttcagcactaggttatagatttggtccagtaatcttttcacaggcctttatccgattgatctcaattggtcttttctctgagaaccaggtcaatgacttcagatgaaagcagataacttccttgtcaactgatttccttttatggtgtgataatggaaaaattagggagtgtgcctcatagattccctctcctcagtgactctttgtcagacagctggctgtcatctggggtgacagggtaaatgggccacaagcctgtcatcatctggcagccaaggcagggctttctcacaaggcagtggcagatttccaagaaagaaagcagaagcatgcaaagacacttgaggcccgaaccgtcaggatgttacttttaccttattctactggccaaagcaaggcacgaggcttaaccatgtttggaagtggtggggaataaacagactctccttttgatgagtagaactaattatacagttagctgcaaaggacatgcacagagggaaaggtgaagagttgtgatttttgcaatctcctatggctgccaaactatatattctctcttagtatagatgatatatgatctgataagaagtatcagtttttatatattagtagcatttattcaacgtgatgtaataggaataacatgcaactggacatcaggatatccaggtttcagttttgtcttttccactagaccagatacagtagcttcctattattggtggaataaattatctcaaactcagtggcttaaaacaacatgaatttttattatcttatagttctggaaatcagaggctctaaatgagtttcactaggctaaaatcaggcctgtgtttcttatggagattctaggaaaaaaaaaaacatttccttgattttcccagcttttagaggcaacctacaatcttttttttttttttttttctgagatggagttttgctcttgttgcccaggctggagtgcaatggtgcaatctcggctcaccacaacctccgcctcctgggttcaaatgattctcctgcctcagcctcccgagtagctgtgattacaagcatgcagcaccacccccagctaattttgtatttttaatagagacagggtttctccatgttggtcaggctggtttcaaactcccaacctcaggtgatctgcccgccttggcctcccaaagtgctgggattacaggcgtgagccaccgcacccatcgtacattctttagctcatggctccttccttcattttcaaagccagcagagcagtgtttccttggacctctgcttatgtccttacatgttttctctctgactcttaccctcctgccttcctttataaggaccgtagattacattgggcattcttggataatccaggataatctccccatctcaaaatccttaaccacatctgcaaaattccttttaccaagtaaggtaacattcacaagtttggaggattagaacttggatattgttggcgtgggcataatatgacctgctctaccagagttcagcaatctatagcctgggggtcagccacatgtttatgtaaatagagttttattagagcacaccaatgttaattctttacatattttctgtggttgctttcctgctacagcagcagagttgagttacaatagagctcatatggcctgcaaagcctaaaatatttactatctcatcctttatagataaagattgctgaccttgtaactagatttactgtcaccttggacaaattagtctcactaagcataatagaatcataactttatagactgggaaagaaccttaaaagtaattttggttaaactctaccctatacatttctctgcgtaaatcaccttttcagaaaaactggtgaatggccattcagcttctgctccaaaacatggaactaaaaggagctcactgtctcatgaagtagctcatgtttatttcaaacagctgtaattcttcaacaaatagaaatatattatttatattgaccaaaaagttgcagtcttttgactttcttgcctagtcttatttatgccttctgagaccatagagaataagtgaaatctctcttctatctgtgagcactttaaaaatttgattctgctatcatatctgaaagttatttagttatttgcataaatatgtggagtgtcaacaaaggagaaagagacagtgttctcagatcagaaccttgctgagcaagctgcctggacttagctgtcactattgcatggatgcaagggagtcactgcccctggtccagcttttatgagtttctctatttgtgcctgggaaattcaccaaagagggtggggttgcacactgttaacgtctccctttcagatgaggcactcgtatttccttgttcaataagccatgtaaatatggctttcagttcacacagcgtggatgcccaagcctcaaatccctctcctataattctgattccatctccaagagaattcagatgctgttagtagtctgtaactaaagcgaaactaagaagctcaatgaaaccacagctcctctgttaatcggggaaaaccaaactcctctagagggcactgtagcactcaccgaattctgtgaactgagaacactggtttaagagaatctgaacagataccagctcttaaagaaaactgtccattccctgggagtgaggttagccagggggacagagttaagccaataaaaaggggctcaaaagagctaacttgttactagagctacaaaccatgtttggattaatctccggtgtcctatcctaagtctaaagcttccctggtgctttattcactattaattcctgtatccgacaatatttactgaatccttactgtgtgctagcctttgtgttagggactgatggaaaaaactaagacaaaaacaaacaaaaaaactctgccgaatttctccaatttgccttgaagtctcattctcttttgtttattaataatccttatctaaaatcccttagcaattggagatctctttctccttcgttctttatgttgaatgatgtcttcatcatccccattagcaagttagaagaccgggagtaactttatacctatcctcccttctcttttcaattcggcctcccattctaccaattttacttaacatttctcaggtctatcctactcatttccattgctccttgccactgccccaaggtagcattatcttacttctgctcacctttccaggtttatctatcaccatttctcattatgaatttacatccaggagtactgaggtgcttgcaatttcataccctcttctgctttttcttttttttctctatttttgcccctccccgacttccctggcttatttctactcatcttttaacgttcagcccaagcatctcctccaagacttctacttaaaattacccttcccatcccttcttctgctaccagactagttaagttgccccttttctggacctttagagtctggatacatctttattaatgctgtttccgttttttcttgcatacgagattgtgagctccttgaggaccggggcaattctataagattcatctctacatccttgatgtttattccagtcctggaacatagctggccctcaatgaatgttatttatgtcaatcaatatttaaatcaatttgatagtacccatgagctgaggccccatagagaggaggggtgtacaaagagaaatgtcaataaattgacctatatatcttgggatatatctctgggcctcctacagcagttctccctcagatgatgaattttctgacaatgatgtgcattactgaaacatattcctttcattaatagttaggtttcaacagtaataattaggataaccatttctctcactgtttccacaactggaagaaattcctaagaaaggaaggtatatgaaatttgtgatgtaggagacagaggccaacttctttcccattgtaaccagcaaatactgagttatgtaagggtccaaagagaactatcatagcaaagtgctggcagagattagtgatgctttactcctgttttgtttaccataatgaactggtcaataaacatcacaaattgtttatctatataaatcttgacagattactctttatgaaatccatttagcaagcgaggttttcccataaggatgaaaaatgaagattttaaacagattgcgggagaagctctggctgtaccaagagagtcagtgtaataaaggtttctttatattaatattacaaaaaccatttatcctggcaaaatcaatattgcaattcatcttagtttggtgtttctctttctaagcttaaaatgtcttttcctttattatgtataattttgttttaataaatgtgaaatatatttcatttaggaggtactcttgaggagggataacttataaaatgacatcaaatttgtagcttatttgctaaagagtcttggaagtgtttaaaattatatttgagtggctgagaaatctaaaggaatcattttgcttaatccttaattacaaaattatccctgtgtcctttggggtaaaaacaaactacaattttcagaaaagtcttcgcttgtgaacttcatttaggaaaaattctctcttactgaagtcaagtgattataacaagtcagataagttgactataacaatggcttggataagagactataaaatcaagaatagacacatttaattgctcaaaacattgcgtgctttggctggaagaaaatagaactacatcaaggaacggaattatgttatacattggaagctattactctaaatgtactgtatgtaaaataagtgtgattgtctcatgagtgaatggtaataaaaactgaaatactcaagagacacttattcatgagtggtgcagttacacatacatatatacacacacacacacacacatacattgagagaagcttttctcttattgtttatgctcactaatattatattaaaagcctataaacaatagactctacataatagcctataaagaaattaagagcaaatcaagtatttttgcatctataattccattttaattataatacataattttcttcagctctaaaacttaacctaaacaaaacatctatttgaaatggaattctgatgtaatgtgtatagataaaagacctaatatagttgtttgaagggggaaaatgtccttttatcatgaccataaaaacggcaaactacagtacagtggttttcaagaaaaactgtactttatttattcccaaggggatattagtccataaaacaaatttgcagcttatttggcagtcttagcttttatcagcctttttaagggtgttgaatgattacccaagagatcacactgtaaaaatggcagtggggaaaagtaactccatccgttcagcatctttattagaatatataggtgaatccatttgatgttgttttaaacgtaccacaaggagagtaccttttaaatggtgagtggtcttcttacatgtgctgttttgcttctctaatacctcatggcaccaacgttgcttatcctaattagtgccattggcataggctacatgtttgaataattcactgtgaagaaacaagttttagtttctatcatggcaaaatgccactactggtatttttacaagcaactttgggtccaagaaatttaagttgcactaaagttatcttactatatttatgtcattagcatcttttcataaatcagaataatgctgtattctccaaccattatggataactaagtttagttcataaaacagaaaatgaaatataacccatattaaggcatcaaaaatatttgaacctgtctttctcaagcaattttcttagtgaaatttagtcttcatcgaactaactatagaattttaagatttttagggagagcaatgatttacccctgattttctatttcgcaattggagagtcacttgaaaagataattttatgggtacctaatctaaatgtttagctgacaggaacactgcttttgtaaaagcaaaatttacagcattcttaattgaacaactggattcaaactaatccataagatatattgtgggatgtaaaaaagcaatataatatctttttttgctattaattagtttataaagagaaagctttatacgggttttaccaggaacagtagttttataaagatcttttctattttcctttattttatgttgattctttgtttgtttagctcaagcattcttttcaatatattggctaaaacaagccgtcttactctacaatgctattggtaggtgtaacttatactatgaattattaatcaaaacactattctctttgatggtttatttgccttgttttcagatgtcagccttgtaattgtcatctctcaggagccttgaatgaaacctgtcacttggtcacaggccagtgtttctgtaaacaatttgtcactggctcaaagtgtgatgcttgtgttcccagtgcaagccacttggatgtcaacaatctattgggttgcagcaaaagtaagtgaactctggttcagtgctggtgtgtgaagcagcatcatacaggggactgcatctcattgttttctttctccatttagaacccatcagaaaggcttagtacaatgtgaagaacgtaggtaagagatggaaaaaaatacactgaatgaaatatgtctgcttttccttgattagacaattggaaatggtaatataattatgttcatggtgggaaatttacaatagttttttggagtgaaatcaacaatgaagtgattaaagtcctaggttttcccagaccaagggtcttcccaggacacaagacttttaatggtaaaatcaggactatattggttaaaccaaaacagttggtcaccgacacaaagacatttccaggtaagttatttttttttgacaaataaagggtgaattcttgtttattatatgtttgatattcttccatcccccaaattttgtgggcagtattataccattagttgtttatcgatattgtaataattagtatcattcgtcacgcatattattcatcccataattcatgtttctttctactttaagtttcactcatttaaatatctctcacatttatatttttaattccttaaagcctaagattacatgtaagtatcttttgacttttcaacatcgcttttcagtaccttgaattgacctcacaaggtcacctgcagttctacaatttcataacatattgaccgttttcctatatttacttcaagatcatacatccttaccctttccagaatccctaagaaatgcctgctgggaacatgtggtaggagccctctacaacatattgtgctatgcatattctccttggggtgtcctgagactgtcatgagtcacaatgataggaaacgccacaagtcatgacagatcatcacaaaccagcatgcctggaactctgctatctacatttaaggggggagggagaaagataagtaatgggatattggactccacaacaactgtactagattttgaggtaatggaaagcaggatatagctagtgattaagaagacgtattcatattttgtacctgtgtagtttctcttcagcatcccgcatttcatcagtccctctggatttcagtataagtaaaactgtaggtatttatgcttcttttgggaaagaactgtcataattcctttcatgtataaatacagtctaaacataaatctggacttcattggccacttaattactatgtgtcatttattgattagcaatacaattgattgctttgtatgcaacaaaaattctagcatattccttttggatatgagttatggatcgtcatttataatggaattacgatacctaatcttagtgatttctgattggttctgccactaattttgtgacaatattggcacctgctctactttttgctacctattccttcttgcatttgagacatagtctgggaattatctctcaggcaaaactggatagtcatgtcactggaaagctagcctacaactcttagtagtggtagacatttaattttatgttttattaactggacattctttccaagtgtttctgatttgttagaatttttaaaaactctcacattcctaatgattcttccctggacatattccttttggttttttatctctttaaaattatgatatatcatactgagcacagttcttcaactcttgtggttgttgctgcttctgttttaggtttttatttaacaaaatttttgaaacactgtgtaaagttggaagctcagcatcagcagaggcaatttattagaaacaaatgagacaactttcctgccttcagaggaggtcaaaacatagctagagtgatggacactgataataggaggggagcagaaaaatgtaaatggtgggatgaggatgaagggtcccagccttctctcctgttccagcttgattttcacatggtacttgtgtttgatcctagcagaagccagccagaacaattggcttcacaaagatatgatgaaattgaaaggaatgtagtgctatctattgctgacacagtgaactacctctgactagtatttgtctctgtatccaacagatgtcaagaaatattttcatttaaaattaaaatttctcatggtaccccaccccctacacagtttgggaactgcaggattataaccctcattatatcttctaggggccactagcaataatttagtaatatcatctgtgatttttatttttggtgggctgtcagggtgggaatcctaggatgtaatttccaaaatgcaagaggattgaatgaaaataaagtagttagaccttttcttatagtaaatttcccttttgggtgattcacttctttcctttaaatattggtatcatgctttcaaaatgatagtcattcttcttgataggaagcaaaacaagaattaacataaattaaatagtcctattttctgtatgctttcctagcgaatgatattctagttagttcaaccatctatgaacctaactaaaattatacacatacacacacacacgtatacaattagccacttattgtttgatagtgtttgtcttcttgacactattctcattgttatttattcatctttatatccacattttttctttatctctccttgccagagagcctcttctagctctccttttattaacagctttattaaagtataatttacatattatatatttaacaattttaagtatatggtttgatggattttagtaaatttagacttgtgcaatcattactataatccaattgtagaacacttctgtcatttcaaaaagttcctttgtgcccatttccagtcaatcatgactcccacctctagccccaaacaactagttatagggtctttgatgagataattttgcctttcccatgagttttatataaatgaaattatacaacatttagactttttgcaatgtataggcttttgtatctagcttcatcttaacaaaatgtttttgaggttcagtcatattgttgcatgtctcagtagattcttttaattgctgagtagtattttatggatacactatattttgtttatccattgatcagttgacatttagattgttttcagcattggtctactatgaataatgcatccatgaacatacagttacaagtctctgtgtggacatgcatctttatatctctttatatcctgagaataaaaaggctggtttgtataccaaatatatttttaatgttttaggaaactgccaaattattttccaacatggctgtattattttacatttacattagcaacttataagagatccagttactctatggtctcagcaacatttggcattgactctatttcattatagccattcagtgagtgtgtagtagtatcttgttgtgattttagtttgcatttttcctgctgactaatgttgaacaacttttcatgtgtattgtcattcatgtgatttttggcaaagtatctttgaaatattttgcccgtgttttagttgttagtcctcttactgagttaaagaattccttattaatttgggataaaacttgcaaatagtcctctcattctgtggatttgtttttcattttttttattggtatactttaaaaagcaaaagcttttacttttcatgaagtcaatttaccaagcttttcctttatgggtcatgtttttgtgtcctatctaagaaattttggattgactcaatgtgaaaaaaaaaaattctccatttttatcttacagttttatacttaaacatttacatttagatccatgaaataatttgaattagttttgtacatggtatgagttaagcatctaagttctttatttcatttttattttttgacacataggtatccaaatgttccattaacatttgttgaaattgccatcctttccccattgaattacccaagcatctatgcaaaaatgcagttgaccccatagctaacatcatattcaataatgaaagactgagatctaagatcagacataatacagaaatgcccacatattagccagagcaggtaatcaagaaaaagtaagtaaaagtctcccaaattagaaagttgattttctttacttgtagatgatatgattctatatgtggaaaatccaaacaaattcacaagaaagctactagagctagtaaacaaattcagcaatgttctatgttacaagatcaacacacaaaattagttgtgtttctataagccagcaatgaataatttgaaaaagaaattaataaagcaatttcacttataatgcatcaaaaatttaaccaaggagatgaagacttgtacattatctgttttctgtgtttccaggaaacctatagtataattgcgcaatgttatttctatgcactgttccttttatgcttagccatgtgctctccagtgtctcatgagtttcatgcaggatctgtgtgtgatcacttttctattaggatgctaagatagaagtaattttcccattagtatatattatctgtggtaataaatatattacttattgccaaataagccatttataattcttgggatgtaagaatcaaggatgccttccagcacactggagggtagaggaaataaaggtgatatttattgaacaattactttatacacatatacacacacacacacccctacatacatatgtgcatgcacacacacacacacacacacacaaacacacacacaccttatcttcaaaataaccctgacggggagacattatcattctcttaatataaatgagaaaaggttcagagagtccaatcaatatttgactataatcatacaactaccaaagttccaaagctggagattcaagctggtggttcccaaagagatggatctagtcacaatattatactctcatcccataaaagagagtctggcatatgcaaagaccattcttggcaattttgatgagtgaatatgtgaacattttttaggaattctacttcaagcacataaaggttcaagttctctcatgctcaagatttaataatattattctcaaaagtgttggtaagtcatctaaaccttctggcttatgaaaatttcaacttaaataccaaagaggtactatttatttatgctgtggagtcagacaagattgtggttgacatggtcatagcaagtaatcagcttaaatgtttggaaagagcctctgtgtgtgaagaacttttgttgccaaggatattttcatgtaatgcaaatcattttctacaccctttgacatgggagtgaaacatctatctctctttcattttcattcatccccaaagcattttgctgccttagaaaatcatctgaaggtcagttttgattgctctaactctgaaatctgttgtgttcctgatagcatgcagagttttagatgaaatcactaatattcactaaaaaatgttaaattaccatgaattgcaaggttctttgagagtgctgtaaatgaggcagttgatgatatttgtggctccaccaagaacaacaggatttaaaaccctaaattaaaatccactgaaagggtcaaatgcattttcagtgttcaaccgatcaaagtgaccatatcaaatatggaaaattcatgaattcaaaaatgtaaggtgttattcggaaataattcttttctcatgtgtcattatgagattgttgctactcttttcctatgtctaaataggcatatagactgttggaatgttaatagaacaatgcaaattccaaagaagaaaaagacaaaaggagggcaatgagcatgtatctagtttgaatattttaaaacatatgatgtaaatattatatgccttaggatcagactttgtctttaggaagcctattcatagtacatggaattttatatattttacattcagtgctgtgcagaataaaacaacattttccccctctgttctcacaccaccatcaacatagttgaacaagcaattctgcagcattaatatcctacaatccagttcaactcttgcgctatatacctggaagtagtggcagattccacgggtgaggggtcagtccccaaggctgcccccaacttctaacaccaatcacaagctccaggttattttgcctgtgcttgtaacccactggctataaattggggctcctatgactccctccttgggttcaattactttggcagctcagctcaaaataaggaagcacttatttttactgatttatgatacaggatattgcaaagatacagatgaagcaatgcataggacaagatacgtggaaaggggagctgagcttccatgtcctccctaggtgtcacaccctccaggaacttccacgtgttaaactacatggagctctccctgtacccccaccaccccccaccaccccaaacaccctttttgttgttgttgttttagacagagtctcgctctgtcgccaggctggaatgcagtggcgatcttggctcactgcaacttccgactcccgggttcaaacgattcttccgcctgagcctgccgagtagctgggattacaggtgtgtgccaccatgcccagctaatttttgtatttttagtagagacggggtttcaccatgttggccaggatggtcttgatctcctgacctcgtgatccgcccgcctcgaccctttatagcaacttcattggataggcatgactgaagcatggatgtggcagactaccacaattactacttgagaccatcactacaacagttactactgttactatttgagactgtcattacaagactgaatgaaggaggatgaacgcagaaatgaaaacttaaaacaaaaataactattttacaggaagggtaacatggggaagaagaagaggggtccctgcttcttgtgagcaagggcagctgcctgagcttcttcagcccttcatatttattgggtagaaagagcagggaggaggagggcatgattggtcagctgcttgattgatcacagggtcatattattactaacaggcttcagatttgcctaataacaagaaacacttgtgcctgggtcatgactgccctcagcattccttccgggtgcagacgcagtttgtcagcttgccaacatcctgctttcatgagaacagtttgctgtttactcatatagcctccagtggtatacttagttgatcacgaccctcattcttttggccttcaacacatggacaactatgtagaaatgtgatttaaaaaaaaaaaggagtatgatttcatactaatcgactgagtggggaaaccctgcaaggctgcctattcagagtcttcttggcctctctctgcagtattcattcctccagggcatggggcaggactccttctaaaatgagggtctcatgacccacagtcagacaaggtaggtcagagaatttccttatggccggctctaagacagaaaggtggaggaacattagagtatatttttagtttccctggcctgccttggggagaaaaaggaacaggtagaagcagaacagaacagagacagaccctattttctgaggcctacttctgaagcctaaatctccccaatattgtaacaaaagactgtccttcacctgtatcactcttaaattgttctgaagctgcttcaggacccttggataaaagaccaatacttcaacaaaagataggcttattgtgttagtcaccaaggaaatagcaaaggctatggaagttatgagccaggaaccatggacaaaaacgtgtgtgtgtgtgtatggtgtataaatatcaaagtgctcttgaaatcctgtcttaaaatgtaataatttgattatattatatcttttagacagagttcatatattatatctattaaaaagagttcatcactcatgggtcctggtgaattagcaatagctctggggtggaagtctttgcttagtttgcagaataacttcactttactgttccctacttttccactttgctctgtcctccaagattctatgtggtttgcatcagcagcctccattgccctctggccatcagttagttgatttcagctgctaagagggacccaccaaacatctggagggcaggtggaaaaggaagtcaggatatttaattccccgctccctgtgtccatgtagaagcagcctcaagctaactgcatccctccatgagtggtcatagctcctgtcaggtgatgctcttcatacagtcatttctgtccctgagttctgtccccatttaagctagagatagtgtgcagagaagagttaacatagcaagcctgactgcttatttttagaaagacctgcttacaaagttggcctttggctgacatctggatccccactatccccagaactgataagagaggaccactgcacttaaacatttgtacaaagtacggtttatgcttaacacctgctttccttgtgggggtcttaaatttgggtaaatgccagatagaggctgctcataggaacagcccccaataaaaaccctgtgcactgagtttctaaggagcttccctgattggcaacacatcacacatattttcataatgcattgctgggggaattaggcccattctatctctactggaagagaattcttggaagcttgtgcttggtttcccctggacttcattgatatgccttttccctttgttgatgaattctgtaacatttcactgtaataaattttagccatgagtaggactatatgatgagtcctgagtcttcctagtgaatcattagacccagggttcagggttggcttgagaaaccctgacataaatagcaaaagagctctgcagttctgtacctgagagtactggaccatctcttttgcccacccttttgaaagtggttcctttattgagctctccccaagttactttttttgagtgtgctttcttttactgaggcttctagtgactgtagatatttcatataaaaatattaattatttgatggattcttttctgtaccttacatttacatatttcttaacaaaaagatgaatggtttaaaagtaaggtaacacagcaacctgtacccttgacatcttatttaaggagaatgtttgattaggttgtgcttctttaaatggatgggggattgtgcatcttgtttaaactagaaaatagtacgtaaactggtggttgattgtccctaaaaatatttagctgttgtttttctcctttatctttgcgtattctggtgaaaaaaaagaaaattcactctcaaaagcagggagactaagaaaaatttacagtgacagaacacaatgttttcatggtatatatttatattatagaaaacatcacttaagtagtgagatgaatgttcttatttcttatgtgcctgataagcaattgtattacatcttaaaaacacctctaacaggtgatggtacattcatatagtatattcaaatcgtttcttgataatatttagattatttaacatccatagctatttatatcaccaaatattattctttcttttacactgtgctctctgaagcaagataaagcattgtgcttaatggaatggaaagcttcctctcaaaaacccaaagattatgctacttaaatttcaagtttcaatggaacttatgtcaacttttaaattaactatgtaaaaaataaatgttgtgcatccttggatggtttctcaaaaaaaaaaaaaaaaggcaaagaaagaaatgcttaatgtaaactatggtggttttttacccccaactatatttatgccagctgctttgacctaaaaagtttttttatgcttatagataaaaagctttgttttagagaactcatgaaccctttgtttattaatgtcttggtaaaccacatgtcttcttgataaagcaatcctgaatcagaaagacctctttgctggatatcttacttcagtttgcttttctgtttattgattgctttgctaataaatgctctcttcattgtaatttagctccattccagcaacctccgcccagaggacaagttcaaagttcttctgctatcaatctctcctggagtccacctgattctccaaatgcccactggcttacttacagtttactcagggatggttttgaaatctacacaacagaggatcaatacccatacagtgagtttaagggtttggtaatagaaataaatattctgagaattgacacattagttaagttctttgacattgaggataaatgctgttgtggtttcctctgtctggcacagagtgtttcaaacagagataaaattacaaatttcactagtaatcaaagaaatacaataaaaatgagatgcttattatctgataaatactaatgcttatcacattctcaaagatgaaaaaaaaatgaccccatcaagaattgatgggaatgtggggaagctggaacttttataaactgctgaggtgtctgtgtgagttcattagtacaacttttcatgtacaataatttgttaaaatctatgaaaaaatctttccttttaacataacatttgacttagcaaacttattttaggaagtttatctcaagtgaacagtcattaagtagacacacaagatgtccatacctattctatttgtaacatcaaaatattgaaaatgattcagatgttcaacaatgtttcaggaaattatagtatatggcataacagaatcctggtacattgttaaataaattataggctatgatagcatataaactgataccttagttcacatatcaataaatggaaaatgttcatgacatattgtttaaggcaggggtccccaatccccaggctgtggacaggtactggtctgtgacctgttaggaacaggaccacacagcaggaggtgagcagcaggccggcgacattactgcctgagccctgcctcctgtcagttctgtggcggcatgagattctcataggaacaggaatcctattgcgaactgtgcatgcgagggatctaggttgcacgctccttatgataatctaataataaatataatgcgcttgaatcatgccaaaaccatccctcctcaccttcccatcctgggtccatggaaaaactgttttccatgaaaccagtccctggggccaaaaaagttggggaccactggtttaaagtaaataaagttattaaaataatctgagaattataccattttaatttacaaatactggaagacataataaatagatctagttttctctaattgtaaatattatagaaaatgtatcaaatatttctattataatgaattcaagttttttaattctcaggttaaagaactattaaatctggcagtggagtactaacactcaagcaaatagtgtaatttaatacacacattgctgtttccgcagagatagaacacagcaacataaacttttgaaagagaaaggatataaacaagccatcaagcctatctttgcctttgtaacttttatgaagattttaaaggagcttatagaaatcaaattattagaattcattgactttaaaaaacatttactcagatgttttagatacagtttccctaaagacagaatgaaaaaaataggaatttttacattattccagctctatcttctctgatttttgcttctagccatgtttagctacacactagtttaagaaacctcggaacagcaattccaattcaagtttctattttgttctcttcatttaatacacagttttccaaattctactttaaccatgcttaattagttggagaactgtttaaagctctgtcgaaacactgaaattccataaccttccttaaaatggttaggaggatgccttgttttaacattttaattgactttaaaactcctgcatcgcatagagttttattttgtatgcattatactgggtttcattttgcacctaattcatataactggaatttagtttcttatgtccacccctttgtcttggctctacatgtctcttcagtattccaagtcttctttaaagttaatggaaactctgaacttcatgatgcagattgcaaagggaaatgaacatctgtctacatctgccatgttggcaaagtatcctgaaaacctgctactagaatgtttattttcttccaaatatcagcatgatccaggtgtcctgaaacttaaacttttgtgacagagaaagagaggagttataaaaatattgaaaatgattttgaagatgacagtaccactgattatttctgaagttgtgaattagggtcaccctactttccatacagcttaatgcaatagcaaaattaaacttaaaactatcaatgatattattcaagccagaggcatgatttccatagtaacatattgtgatctattttatagaacatcacatgttagtacaacattggctgtttttgacgattgcactaataaggaatccaaataacattttcttacataataaatgtgtattcattcactaatcagacatttatataatcctattaaacaaggtatcatttcctaaaaccatatttttcattaaaaaatgccacttctggcatttcttgacaatcactgtaattaatgatgtgaaaattatctgcatgatggcatttgaacagtaagaacaattggttaacactgtcagaactttgtatcattctaacaatagcctcatgtttattactctatttctagtgcgtggctagcatgtgtaacatgtaaaggaaacactacttatattcagctggatgaacacaaatctttgggttaaataaaggcattaggaattataggtggagaatcattgaacttttcaaagaaaattaatagtgttgtcttccaagcaagtttgatagtttgtttgagacctttatagaattcttttttagaatggaaactttttctagctggcctaatgtactatgggattctctaagacatattttccttcttaggatcatgatatactggtgtaccatctttaaagctttcaaattgttattataatagcatgcaaataatgaataattttaaagattgtgaataattaactttaaaaaacaaggtatatctttacgttttatttaaggtagaggtcaagctagcgcttcgagaatcatacataatcagccctaacagtatctctattgtagcccccttctgggttgctcataggtatcttacgtgtcataggaaggaagtgaacagttattggaggaaatagcactcttctgttagtgttgcaggtttagggagtggacagtaactcatactgttttttggtgttgttcctatttgagtttggaatcaaaggagcactagacatagtaggcagatcaaatttaaaaataaaaacgatcttcattactgatgaaagtcagattagagactatatcctttttcctgcaggaagacaaattagaagagagaaaaatcaatgggctgatctgcacataatttgctccctacaccctgactccccagattcacagtcagatgagttgttcctcatttgggatggcatgaatggggagatagcccttaaatgtcactttagagaaatccttccacaggaactagaggatgattatttttacatgtaacaatgacttctatcacctacagatattatcgtagtttaagcttagaattttagacaaccaaatattttaatgagccctgggatttcatttctacccttattcatttccatctttaaaattataatttataatctcatactacatcaagggatcaatgtaacaagtggtaagatgattcagttagctctgagaggaataaatgaagaaatataagatatagagacaggatgagaaaacagaagagaagatgacaggcaactgtttttataaggctcttaatattcttaatgcggtagtttccccttatccatggttttgttttctgcagtttgttactcatggtcaacaatgttccaaaaataggtgagtctacagtacaataagatgttttgagagagagagaaagaccatattcacataactattattggggtatattgttataattgttctattttattttcagttattgttgttaatctcttactctgcctaacataaattaaactttatcatagatatgtatgtataggaaaaagaacagtatatatacacacatatatatgtatgtatatatatgtgtatatgtgtatatatatacatatatgtatgtgtgtgtatatatatatagtttaatactatttgttgttttaggaatccactggagatcttggaatgtatctcctgtggataagaggggactactatattctttcctggaacaatagatcaaatatgtatagaaaaatcattcatgtgtttaataaaattttgttcagtgcttattccagaccagaaactgtatcagtcattagaaatacaaagatgaaaggaatagttctccttactgagtggggagacatataagtaaaccaaagtaacaatagaatatataaatgttgaagcagagtaaacttggggtgttaaggaagcacacggtggcttgggaggtgtaggaaatgtaaccatgcctgtggtggcaatgatgtgatggagaaccactgaaagtttcccagtaaagaaagaatataagctgaattagccagatactgtagttgaggaagcgtgatggtcatgaaataaattttgtattaaaagaaaataaggtatattcagcaatcatgggcagttccatgtagctttggtaagtggtacaatgggggagtgctacaaaccaggagggtatcagccaagatcacaaatcagtgctgagccaaggactgtaaatgtttctctgaaaatgcagaagtctgtagtaacagcaaattttcaaattcagtgttaaagatccgtaccccaaccaaggagagcaactaccttgagataagcactcttttaacctgagtattatttttttgttatggatcattaatggatatcctattcataccctttcaaatgcttttatatctttcacactataaattgccttatatgatattcctacacaaatgcatatttccatcccaattctatctgattctaatttcttattaagtagactgctcttgtataatacattctgatctattaggattatattccacttttcagatgctacaaacattcagcaagtactgtacttcttttaattgtcatcaggttataagtcttccaacttccagtttaagcttatgccagacaatcttttggaatattcagcactgaaatttatttttttcttttaggttttggcttttggcatgctaaattattttccatcgttgttctagccttcagtgatttttcaaattttgttaatgttttcaacaaccttattgtgggataagggtaactttaatctaatctagtaaatatttattgaaataacaatgagccacagctgcacgctctctagaaagtctgaatctcagccctaggggacttttccaaatatgatccttctttgggtgctctgccttagcactaaggatggtgactttcccctgtctcttctattcctatattctttagagttttctgtaccacttagaaagtaaaaccaggcgacctctggtacccatggtacaactgaaaacagccaccagagagagaactgtctcaccttcctcggctctatcagggtcatctctgataagacagtggccctcacctgagtcagtgcccaaggtgccccccacaacaccagcggaggcctcctccactgagcagtcggaccccagagtgctctgtaggagctgtagactgggaagaagggccgggtgtggtggctcatggctgtcatcccaacactttgggaagctgaggtgggcggattgcttgagcccaggggttcaagaccaacctaggcaaaatggtgcaaccctatctctacaaaaaatacaaaaattagccgggcgtggtggtgggcacctgtagtcccagctattctatttgggagactgaggcaggagaatcgcttgaacccgggaggcagaagttgcagtgagccgagattgtgccactgcactccagcctgggtgacaaagtcagaccctgtcttcaaaaaaaaaaaaaaaagaaaaaagactgggaatgcctaggtttacacgatgggttatcactccaaagatttgtgtcttttgtggccaatggcagatccaggaaagaaatgaaagttgccgatggggataggctgggggagagcaatacagatgtgtatgggaaaccccaacccatatatattgtaaatagatggactaggctaaacattgttgctgtttcagtcttctgcaaactcagcttttccacaataaagctctatctcctgtcggaaggaaggaaggaaggaaggaaggaaggaaggaaggaagtaagagagggagggagggagggagggagggaggaagggagggagtgagggagggatggggggaggggaaggggaaggggaagcacatgaatatgctgggaccttcatattgctatagggcacccctgcttaatggaaccctcctcgcatctccaatgcaaacagccccatggcggagcaggcagcagccactctggtatttgtgtgtttcgcagtcctacagtgtgtttcctgtccttagagaacaaggatttccagccatgtgcctaatcacctccactccctatcttattttttaaaaacctctttgtagctgcttctctttgccctcacaatccttcatgcatagaagtcctgcttatctaaaacttctgttgtgtaaattcctcattgctgataacaaatgtctccaaaatttagcagcttaaaacaataaacatttataatttctgtaggtcagaaaataagaaaattttccattcaagatgttggccaggtgacagatttaccccttggtggtagtttactgacccttagtctggtgtgtttagtgtttaacaagcaaaccagttacatagaggaaacatagttacttttctgttttggagaaccgcaaggactttctcttagaccttctaacaaaaggacactatgaaaagcaaaagaagaactaaaacaaacatctaaacattctttattatgaatgatactttcttatactcaataataaaagcaatcaaccggtatttacattatttcaattttaaaaatatgaaatgtatccttaatcaaaagagtagattggtatagtttatgtaattaaataatatgataggaaagcagttagcaatgattcttcaccaacttgtgaaatgtaactttgttttttttttttcttttcatttcaggtattcaatacttcttagacacagacctgttaccatataccaaatattcctattacattgagaccaccaatgtgcatggttcaacaaggagtgtagctgtcacttacaagacaaaaccaggggtcccagagggaaacttgactttaagttatatcattcctattggctcagactctgtgacacttacctggacaacactctcaaatcaatctggtcccatagagaaatatattttgtcctgtgcccctttggctggtggtcagccatgtgtttcctacgaaggtcatgaaacctcagctaccatctggaatctggttccatttgccaagtacgatttttctgtacaggcgtgtactagcgggggctgtttacacagcttgcccattacagtgaccacagcccaggcccctccccaaagactaagtccacctaagatgcagaaaatcagttctacagaacttcatgtagaatggtctccaccagcggaactaaatggtaagaatccaaggctgagattcccctttttggtcaagacatgaatgagaatctattgtaattgtgcaattaggaatttggcagttgtattcctttttataactgcacaatataataattgagaaacagtttctaaagatataagatagtatttgtcctggttagtggaacaagtgtatttcttctaatctaataacaaattccattcaattaaattgccccttaaaaggctaatattatctttgctcttaatgacatctgccataacacaaatgatgtttataatttgaaactcacttatgaaatgcattatatttgactgtgtcacaagttagggcacccacaagcagtacatttttctcttctaagcaagaaaaagatataaaatgatacaaaaaatatgtatataagctaactgactccattaagttaatttttgcattcatgcatttgaacccttggttatataggccagacacacattcacagatttttaatcatttatatcatgtacatattatagcaaaatctttctttagatttgtaaagttatttggtaaaactgggtagagattgactataacatttatgcaaacagggcttatgttaaacaagttaaattaaaacctccaaatttgaaaggatacagactggagctataatgatcaaattccccaaaagaactggccattcttaacagaaattgtgaatatcaattctgaaaaagattgaatttacctatgataaagtgtagttattttttgtctatgtgttatccattttggtttgttttcctcatgagtatgcctttaatagtattttatacattcatctatatagcagtttgttgtcttctatgtacctgtcatctagattactaaactactaaatcactacattttgaatgctaaagaaattgacagtaatctaattagaaagacaatgaatatccagcactctttaactgacctgtccctaccctacccctaaagtaacccctttgtctgatgagttacgtaggttcactatttaatttctctaggaataattataagatatgaactatacatgagaagactgagatctactaaagaaaccacatctgaggaaagtcgagtttttcagagcagtggttggctcagtcctcattcatttgtagaatcggccaatgaaaatgcattaaaacctcctcaaacaatgacaaccatcactggcttggagccatacaccaagtatgagttcagagtcttagctgtgaatatggctggaagtgtgtcttctgcctgggtctcagaaagaacgggagaatcaggtaaagatcaatgttttaaattctacttttaaaacctctgaatgcaaatgtttcctcaaattaaagtcaaagtactgtgaaagtacattttgaaaagcaagaattagaaacttccatagaccaaggaaaattttcatatatatggatttgttacataaacaactcaaggtcataaagtacttgcagcaagttctagggggcaaaagtaaatgctttagttattaattcatggggcgaaaatggcttaactatagttatagtcttctgggaatgtttgtcaaaaatagcatttggtttccactcctgaagtggattggacacatgtctcatcttgctccatatacagcctaatttatgttcaatgaaagagataactgtcaccaattccacaaatttgtctttgtttttatttatctttccaaaataaatagtttagatactagattgtacataatgacagaatcgtggacatcaaaatctataattcacaagtgtgcttgtaagcagttggcatgatgataaggaaggaggacaacatatctaaattttctggattatcttcattaaggcaaaaatttttaatcctccactttattttttatattaaaacacttcaaatttcatgagcctttaagaaaaaaaatacacttttgttatgtgtttaatctgtagatatcaaagaaacccaaaccctgatctaaacttgacctgttaggaatatggaggatgagggtagctttaggttgatgtccaagggaatcatttcatgaataaaatacgcattgtgcttgagcatctcttaatgactaccagccatcttggacaaataatagagccatgatagcacaagtgatgaggcatggcattctggaaggggaaaatcaaggtcagaaatgaaaagtaatgggtgaaactgcaatactggtccctcgtaatcttatgggtcactagctaatgaaagtgcaatgagttcctttgataatacacctttggttagcacatttaaaatccctgtaaagagctcaggagtggcaggggggaaagggaaatgcatgtgtatgtaacctgaacatttcaagaaaaatttaacaaaaactttgagacattcattggggttatttagaatgctttaggtttacctctttctgaagaataatattcagccagctgcattggattggctcaatgacatatttccctacatgggaaatccagtacatcaccatgcatttttctgaactttttgaactgagatgttctatttttgtgacgttttttagatactcgtaagacttataatttcctatctatccactttcctatctttatgaacatgagcaaattcctatgagatttttattttgcaagtagaaagtagctggtaatatgaagatggagaatatactttcagataacattttaaaaagtgaataccttttacatataccagcatattcttggactttttcaaagcagaatattttaaaaggtaaaggtatttcagaaactaaatgaatgtgtgaattcaatttaaaaatatatagggacgacattcattgttttgatgttattgttattgttctcattgatagcacctgtattcatgatccctccttcagtctttcccctctcttcgtactctctcaatatctcctgggagaagccagcagataatgttacaagaggaaaagttgtggggtatgacatcaatatgctttctgaacaatcacctcaacagtctattcccatggcgttttcacaggtattgttatttttaactaatgtcctttcagaattggcttagggcttcatttggacattttttgagtttgcagaattctgtgacagaattctccctctatattgattaaacagggcattttttcttaatataatattatgtgtacaagcctccctctttgtatgtcacttgtatttttccagtataatcatatattgaaactaagttggtataatttatttcataagacttgttttttttccatttatcatgtatccttaaatattttacatgaagttgactttcattaactgtgtactatcatgttatttggacacacaataattatttaaccagtccacactcagttgatattgtattgtattaattcttttggaaatataaataacattgataaaacttcttatatgtacatttcatatacatttctacttcaaaaatctgaagaattgaatttatcacagcttataacaaaatgaattatgaatatgttcaaagttttgaatatacagtcatatattgccttctagtaattcatcccccagctagcagtagtgagaataattatcatagctaaaagttactgaggctttactgtgtacgtgaactaattcatctgatacatacagcaatcctagaggataggaggctcttgttctctccagtttacagttgtggctgatatacctctctgcccattttaccagcatccaggtggccaatagcagaagctgatggaaggatgtcaaccgaacaagttcttctgtgtatttggctgttcagtgcctcctctgagagagatgctcttctctgggcattagcataagataaaaagatctttacactttatacctactcccatagatctagccacatttttctttccatgaattcctagttcctgatccttccatctttttttttcatgcccttggccaatatttccaagccactgccatattgtccaggtacattttaccttgagacacgtctctttccacacaacatgggtgaccaggtgaactgcctgaagttctgcccactaagaggatttcttcgctctgctgtttcacagggtcatctctgacaagggttttagagcaacagctaccatttagacttgcagccacataccaagacatcctatctgtaaactaaattctgctttttttccacattctttcagctcttaagggacctcccatgggtcataggtatgagctgaggttgagccaccagtataagaatggtggatgtcatgggggcctgaaccacctgcttgcacaatgtattacggcttttggctctgcttatacccaatctcagacatccacttccattttatgatgaatttctgttgggcccttctaacctcaagacttggctgagacaattccaagattataaaaaagtagctctagctgcatggctatttggtgttccatgaccagatgttctgtttttactgaagcctgaaagcatgctagggccatttagcaaatggtatatagtttccattacatgttatgcctttgttccaagctcttggggtctatctgccctgtgattctctttctatgtgtgccttgcaacattttttcccacaatgcttacctctagtgctgtaaaaattactacatgttatgtcccaagtggctcatctgcctgtaccacaggctggacctggtgcagagccctttccgcctctgggatgcactcaaaactggcagcattccatattactcagtaaatttctcagaacagtattctcaaatgtggaatatgctcccttcagaatgtgaagaggtcaactagacattttgtttccttcttagtggtggtagaagcaaggtgcaataatttgtcctttattttggaggggatatcctagcatgtctcaggccacttgaactcctaaaaacttcactgatatggtagattccttaatcttcataatattgctgtctcactttctagaacacatatgtcttacctctgcatacctaccatttcttgtttgtctgattcatttaatatgatgctatcgatataaagaatactgtcaaggtggcatttatagtttgtcttaaattggtgattaatcaccctcagatttcctttgtctttcttcagtgcattgatggcgaccagcaagatccatgcattgtccttataattactagtttccccagagtagtccttgtaattactaattccaccaaaccagtgaattaccttctactggtaactcatcgcagttcaccactaatggaagtttaagcattgcaccactagggcatgctgtggactgttagtactctacctgctgtctatgatgagatcattgtaaaccagcaagtggatgatggagctccaaaatatcattttagagtctccttcctagggccagtcctgttacgactatcttagggcaaattcccccggaagcagactcttggtagaggactgagtacaggaggtttattgggggaactctttcagaaacaacaaatgtgaagtgataaagtatgtaggattgagcagcaaagaagctgaactgtgatgcaatagtggaagcagcctcagcggattccgtgggtagttctggagctgaaatgaccctcttagcttatctcaaattaagctaggaagtcagacctttgtaccctagagtatttgtgtcctcgggctggtgtaacaaattaacataaactgagtgtcttaaaacaacggaaatttaggtgttagtacagccaggtcccccacaggctctaggagacaattcttctcttctacctacctgtggctcctggtgttccttggcttgtggcaacataactctaatatctgctgcctctgtcttcacaagtcctactctgtgtctctgtctcctctgggtctgtgtgtccgtctcatttctcccataaaaataccagtcattggattttaagctaacctgaaatccaggatgacaactaattaattacatctgcaaagaccttatttccaaacaaggtcttattctgaatttttgggagacactatacaatccactactaataggtttgccatttttttctaagcctttttaggagaccagaacccatgtacaacacacaattttattttctatactgatgaaaaagaagagccaataaataatttatgattacttatttttcattaatctgtctacgtgttcactcatttgcaattatctcatgatgaatacacaactggcataatatatatattttgacttaaacaggttagtctaccgatctggtataccatgggatttaaggtaaagttagttgtaactttcatgtggtctttgccatgttgtatctcatttatactcaatgttttattttgttgtttttactattctctggctttataaactattctttctttgtaaaacacagttttgatttatctattacttatattatagtagttgttgttctaagaaaaaaataaggtgagaaatattatttataaaatacagccttagaagtcaacctgtttgttcatattccacatctcccaattattagctgtatcacacgtctctctgcttctggttttattcatctgtgaaatgggaaaaccatttttgctcacctacctgcttaaagagcctgataaatattgacacattattattagtgattattattaatggtgtggaactacattatactttataaactagctatcatttaatggggcaggaaaataaatatttttattattgttgttgttatttaaaaggctgttccttatggctgaactggaataaggacatagatatatcaccttattctcttttttatttttatttctttgagacagagtctcgctctgtcacccaggcttgagtgcagtggcgcaatctcagttcactgcaatcttctcttcctgggttcaagcaattcttgtgcttcagccttccaagtagctgggactacaggtgtgtgccactacacctgactaattttttttttaatttttatttttagtagagacagggttttgccatctttgccaggttggtcttgaacccctagcctcaagtgatccacccgcctcggtctcccaaaatactgggattacaggcatgagccactgcactgggcctaccttattctcttttgaactctctctcctgtgcaaatattctctgttcaaggaaatgaaatcaaaagtagcagaacaaagtccaattttttaccttctcaatgattaaatttgtatctgaactgacctgagtatgtcttgttataatctttgtaaataaatagccaaaattcccagggaaaatctactataaaaataactagtaagaaacctttgcctaagaatgagacaggggggatacgtaaaagtggtgatgatgtaggattcattgtgggggatcaagctgctgtagaatttttcctacccctttgaagacttatttcatgaaaaactttcaattagatagattttataagacttataaattgactctatgtacatgataaagacaaagtctatccaagtgataattttatgctgcaagttctggggccaataatgtatttttaaaataatgtaatttataataatcatctgtaaagaaggaaaagccttttcaaaataaatattagtgtagatttcttctttcttattttatttcatcgtgggttcttgctacaaagaatattttgcttaaaaaatagttgtacttcctaaattaaataagaaatagcttcatgtactttatcctaaaaacaataccattttctaaaaatttacattgaaatctaccaggattattctaaaagggatgaatattacagcaatattcataagtttaactcagttcaaggtttattttacttagaaaattttaaatcacatttcacagaaaagtttgtatcttcattatatcaataatgattttaaaattagaaaaataaagaattacttggtatttgatgtttttcttatttcaaaatgtaattgcaaggaaatggttttaaagttttaaatttaaattattcctagagttttagaatctttaaaaacacctttatttctgaatgttattgaaacactgtattctacattccaatctcactgctttttagaacaactcatgtaacttacgaaattttaaagtcaacacctaggcaaatattccaaatgaattttattttacccctaaagagaaagtctctagaaaactactccaaatgttactgaactttacatttatctgtatttatatttatggaagattattttatatgactatgtatcagtagccctaagaaaattagttttgtactcatagttactgtcatactctctgttttaatgacttttattttctgaatataatttctagtggcctttgtacctacaacctaaacaaatttacatggttgcttttgatcacttcaaattataatgacagaaccaactctcaatgttaattgtttaataatttatttatggactgtgagtttcctgtcagtcttctttgctcaaatctgctattttcatttgaaattatatgataaagataatatttcaaataacgtaactgtttgatctaatctttatatgtttgtttatataagaaagatgattgagaattgacttaacgtggatgctcagtaatatgcttaatgtttaattttttcccctttttcttctgtgactttttttcataaagaaaatgatagtatcgatttaacatagcaacggcatttctttctgtcctagcaccatcaaatagcttgggtattactgctctgggttacttttggccaagccccatggctttgtttggactttatcatgataacaatgacaatgtcaccgtctttatctctaccattggtgacaataaccataccaccatgctgctttatgaggcaataacttggttttctcatttatccactcaggaactggattattacctcataaaacagtgtgattgtacaataatcaattaaatcctggcttgtcgagactcttcagaaaaaaaaaaaaaaacccttttcctaatggtggttggcaataattccctctgtctgaattcatggaactttgactgccaaggttatattttcacactgattacctattatctttctttctttctttctttcttttttgccttgaagctgttgcacactgctaaatcccaagaactatcttacactgtagaaggactgaaaccttataggatatatgagtttactattactctctgcaattcagttggttgtgtgaccagtgcttcgggagcaggacaaactttagcagcaggtaagcaagttttaatggatatgaaaaatctgttgcctatcaagaaaaaaaacttataatattcaacaccttctctacttgagactttatatttgtcttctcctccctcactaactctgattgcttcttacctcaacagttttaaacaacaacaaccaaaacgtaacttaaagaggtacctaggagctacgagttacagctgtgtcataataagaaatataattagtggtagagtgactccactctacaactagaaatatatagaatatacaactagaaacatatacaaatatatagaactagaaatacatagaaatgtaattagttgtagcgtgactccagggcttaactaccaacctgtgtcctagcagtgtcctgacaattgtgagaaacaatcaggaagcttcttatgaggacgttaggatacctcttccctcagtccagacattttttgtaggcttggctctactcactcctgatccatgggaacatctagaaattactgtgtggcctggtgttatatttggctttcatgaaataggtaaatgtttatctattgttttattaagaagaagctcttaagttaataaaatttaaataaaagaattgttattaagtataatctgagtagaaatggtttgtataatttgtgcttgcttcattcaggactaactggattcatacaaacctgattacatgtattagtaagacttataaaacccaattatttagcattaatatattttcaaatcagtgtttttctgattctagataaaagcttagtttcctggttatctttaaagaaatgtccatgtgtaaggaggttaagacactctagatgaattacagatattacgaaaattcatgtttacctgtaaaaacatttcctagacctcctccccaaatcccttcatcctattattaataggtccaattatgtagggttttttttctggttctggaaaaaattgcttagctcaaatgatctcatccaagtaatttatttttttcaaaattttcattaatgcaaacaactctgaaattctaagaaattatggtttactaaatttataactgaacactttgtatttttatgtattttatagatgtgcatttcagatgcatgaatacattgatggagtacctagcttgtacaaaacactcttctcctataaaactatctgtttttgtatactgtattattaaaggtttactgaatgctgaatatggacagcagaggaggactctatctcctttaaatgatacaatttcagactagaagacaaaaattaaaataagaatcagtcttacaagttggagaaagtaaaaatggagacaacggagggtgaagactgggtgtgttatagtaggggacatagggatcccaagcacgtggccatgcaaaactggaatcacatcctctcagggttgcaaaacatgtaaaaataatctagtgttactatatagccagtatcaatatattctttgtaatattcccccaagtgttcatctaacccatgtctgataccttcagtgttacggaaactactacgtctcagacaaagctataccatctttagatacctcttttagaatgtgatttcttagattggtcaaaaatatctcctagtaacttctactcaacattcttattctacttccttgggggctgtcgttaacctaatttatcatccttccaataacattttcaataacattatatccacccaagtcttttctcctttaggctgcatatcatggtggttcccatctgaacctcatatgcaatagtgtctagagctgttattagtataattcttgtagatgagatctagtctgccttttcatagatataagcaaactaaagaacctgaagagagacatgcccgtccctagaaactagctggatcatggagatgggaatagaagagcaggaaacatgtctacagaatagaatctgcctgccctatgcattagtggtaacatctgtgctaatagtatcctcgttggttgcagtggcaaaatcctgttgcgtaaaagatgatgtacctgggtgctctgtgcagctctcattttagttactggtgaggcgattaaaacgactcctgtccactggcaggattgtgaagtaaaactaactagtcagagccctctgaatcctctctctattttttttatccttgaaaaatagaactggaaacttatattcgctaaaagtcatgtgacgtgaaagttagttgacttacaaaaataagagtttattcatatatgtgaggggaaaaaaatggttagccaaaatgccagggtttcaatccgggctctgccattgactagctgtgtgaccttatataaattatctaacctctgtgccttagttttccaatttataaataagcataacttatttgtagggttctgatgaggattagaattagttaatacatgtaaaatatttaaagcagtgcccatcacagttcattctcaataaaaatttattgtcatgatttttatcataatattatagaagacttttgttagtcacagtataaatgttatggaatttctaatgttatcaaaatcaaggagagtttattttacaactttgattttctaacattattataaaatataaaatggagagttctaaaactaaggattgtattgtgaaaataaaacttagaaaggcttaaaatctgaaagcattatttattatttctgtaagaagtatgtcattcagaattattatgcacatttcaaaactttgctcaaaaacagcaaatttcacatttgttggttgcaatatagagttaataatgtgccataaatgtattattactacattttattgtgaatgctcaattcagaaccatctcttgagggcttactatttaaagcactgtggaggattctaagataattatactcagcatttgggttaaggagttgagatccaacaggtaggattaacaccatggcgacatgtgctaagggctgtgagaaaggtgaaaaaaatgctatgggaaggtagaaaatgagataaatgattttgatttgggagactgagtagatacctcattaaatgctatttcagataaactataaaagaatggtaaagactttcgcagatatttactgagcacatacaatgtgctagtttctgttttaggggctggcactgttccaagtactgatgtaatgaaagcagagatttatgaagacttccctggtggtagagtacacaatagattagaagagggagtgtaataagtgtctggtagacttttttaaaaaggcaataagagagtaaatcagacgagtagaagtgaagattgaaagaagggaatggagtgacttcaaggaagacagacctggaagttaagcagtgggaaggatggacaatgatagcaaatattgcagcccatggtggtgccattaaataaaaggggaaagatgaacaaagaacagatgggagaaataaactcgtgagtttatttgatcatttgatagaaacacatccatgccaattataaccatccaggagcagaaattgcaaatctggggcttaaaaatgatgcagattttgtattcatctgcatatagatgggagctaatgctataggttataatcaattagtgaaagcagagaaaatgcaaaatggaagcccaaagaaaacaccttagtgaatattctatctgggaagaaagaagaaaggaagagtgaagtgaacagaggtatggtcagaattaggaaaagaactgagaggaagcagtatcagaaaagtcaagggaagagagaattctagaaggagaatattgtctgcagtgtcatatggtatagggaaagcaagagaaatgtgacctaaaatggatgcgaggtcactggtgactctctggggattaccctaattagcatggttgaagcagaagctggaacatgaaggattgagcagcggcaggaggagatatagtggtaaatttcaaatgtgtttttttttttttattctttgctaaaatttttcttctacccaattttcattcttcaaaaaattgtattaccttttgtttccatataaaatcctttcttttctaaagaaaaatttattttagtgtttgtttttttctggaaaaaatgtttattttctaattccttaatatattttgttagaactatctgattcttcacctgcccagcagaaaaagaaagtctcttatatgacaaaagtatggaaaaataatttttacttacagttgggtttattataaaatacatcatttttagggttgttcagatcagtgaaaataaacttatttgcttttatttgaataccaggaaaaaattataaatccatcattctttttgcctccttccttattcagtagatgaatgtgtatttctaaatgtttttccaaaacaaaacatctgaatagaaagtatagacattaaatcatagaaatacactgcagacctataataaagccagttctttagaatggtcaacaattttgctataggagagtaataaaagttgacttgcaactttactgttcatcctgctctgttttttctactattaacattgcaatttggagagtatatattattccaatgaactccaatggatttgtgggaaatttaactcttatgtctaatagctcatatgagctcattatcagacatcaatggaaacgagtgaccattcaaaaattttgaaaaagagcaccacaaattagaagtagtaattagccttttggaagcatttgaatcatgaaaagatatgttgcccccttaaatctcggtctcaaaaatcagaaagatacttgtgaagatttatcttgctgtttcattaaaaagcttgagaattataattggctctctcttgttttaaacattttttcaattaaatatatgattagaatgggtacatttcatccagagtattgcactgctgcttctttagtttcaatgcctgtgacaaagtctgagaactgatttgagagaggtgttctctcaggagcagctgcatctctctccattgcaaaatcttcaagcagtgttattaatggctttggagttgcttctgggtgtatgaaggtaatgagttgatgaactgggccctcttaaaatccttgttacacttttctttaagattctccttttaatctgagaaatttgtgcatttccacccattgcaaattgagtttagtttaaacccttcttatgagaaattacttttggagatccattcctgaagggacaatgtgatatttcccttgcctgtcataaattgacctccatactacaagcttagaagtgcccatctcgcataaaacaagtaattggtgtgcattaaattttctttctgaatgcaaagtaaaatgtataggctgtttgctgctgggttgaaaacacacattgttttgcattcgggtacataagtcttttccttgtgaataggagccagagtgattaaacaagcactcttaatatgttaatttataattttaattacaacaatcttgtatatatagtcattagtgaatactaatataaatatttttctacctttttattcataatgcataaaccaatcacccagttacttctctgaggttgcctgtttttgtttcataatacaatctttgttcttagttatgaatgcattttgttcattcctgtcttcaataatccctcattaagctagtcactttctgctccatgctaaaaaggaaaaattatcatgcaaatgtggcatgccatattaaaaagcacattaccaaacacttttgttgctgtccttcaattagtttcccttctttgaatttaattccatttgttgttaaactactgacttgatgtatggactcatgaatctgaggctgctgccaagaaagtggggaaaaaaaatcaaagcctcttcgaagagctgcagaggcgagctgaaatgaatttgcttcacctttgacaagaacacttgaacagcattggaatcctctgatgattcaacttggctaattatccaattatttatttcaagaataaaggcaccattttacaattaaggaagtgtaaagtagtctgagaaatttggtaatgacagatgacttaagtaacttctaagataaacagtatctgtgcaaaacttgtcccaccaattgttttcaggcagcagttggtgtgtcttagcatcagtgaaatcctgagtacactgaaggttttttgtttgtttgttttgctctttcaacagaaattattttacacttgtaaccaacatgtcaaatttccatggctcttaagcaatgtttaagttatatttctcttgattaaaagctttcggttcaaagcaatactttttaattgcctaatgatataagtcagttcttaggaaagaaccgcacatttaggagttcatttgcaatataactgaaaaattcattgcatggcagtaaaacaatttactgttaattacaaggagaagaatttgctgtagcatgctcgcagattgccatgaatcatgcagcactcctagagatttataacagatgtgtaaatgggatgaattagcagggtttaataacagagacacaaatcatgcagacttcaaggagctttaattgatatactagaatgtgacgggcatgaatcactcagccattcaacagcactgtaacatatggtcagctcaatatgccgcatcttaaatcggttggtgagtcgtaggttgtcccatatggtggaagcaatacatttttcatgattaaaaaaaagaatccattttttaaagaaatatgattgcaaagcatgttattgaacagtcttctgaatgccaaactgctttttttaaatgcttttttttttctttaacatggcagcttctcaaaataaataggggctactccttgtaataccagatcgctggaggcattatgagaaccaaatcggtgcttgttggcacactcgatccacagcaagcctatagaaaagcgcagctgatgattgctgtgattgtcagggaaatccttcaggctggggcaaaacaaacaaatgaaaggatgatgtcactttcagagaagttcaggaatgcccagctttgtaaattgaagaaaatgagttggatgagagatccctgcttagcagggtaagaaagtggctgtgataaataataccatgacccctaaggtaacaattggatgtaacattttatactaacttcttaattaaatgctcagtcctacaggggcatgtgaaaagaagcactggctggtcatcacatagatggtagcaccaattccaagtcattcttgaagaattatttcagtatctgcaaacaggtaccctggttgaagactggtaactggtagtgtgcaaacatgtttttattggaactgggatctggcagcttttggaaaagcttttgctgcattagtaaatctgacagacttgaaaaaggaatattgcagccttagaactgtggctgccagaatttaatgtcaacaattaaaatttattttgatccttacctagtgtttattactgtttgtatacacaacagaccttactaatacagagatgcactattagatggaattaccatctgttcagagtgaaatgctggcatctgtcttagatgctaaaactaaaatgatattatttctaacaaaacaaaattaactgctttttactcaccaactttaatttgtagtgtgtagttgtatccaaggaaaaggcttgattttgaactatgtgatgacctctgtggccaggtctatatttagatatgcgactttatcaggggctctactggcctttttggcatatgaaaatggcatgtagaaatcacactttcaatacacaattatagcttcataatatactatgtatcctataagtcattaaaacaacacaaccaagctatgtaaaaattgactgaatcagagagactctactatgcaaaatattttgacagatacgccctaaaaaactgcaaggaaagaaattaaataggcaaaaaatcatctgaacaaagttgctataggtcccacagtgacatctttaggaaaatacaaactgtatctttcttctctgttagactattttaaattttctcccacatggacatatataaaaaatttacattcagtgccccctccttttaatttaaagcctaagtatcctattaaaataggtctttagcttttggaagttagagaatttggaggatcaaggacaatggtagtttccatactgatgttagatcagtgacgctactttctgagaagccagacttctattctatatatcacaaaataataaattgtgtcacaccagcatttaatgcatgtacacagtgcattaactgtaactgtagtacatttatttgtgctgcaggagacttgaaaatgatgaagaaatcgatactttgctgtcagagaagcaagtgttacgatgcatttaagtagttaattgcataagccccataaaagcttcaagtttgggtagcaaggatgccataattacagtctgagcaactaccttttattagtggtggactttagggaatggtggttgctgtcatcattgctgctatatgtgcagtttagaaataatggatcctcttctctcttcatgtgtaggatggtagttttgtgcaaattattgtgatcgccagaacaataactggttaaggtagtgtttgttcaccatgttcactgaacttctctaaaagcagggttttctttatgtcacagaacacatagacaaatcatatttgtatgccatgctaaggtaaaggaacaaggtggctgagagctgaaggggataaaccagaggggctcctgctggcttcccaggagcaaaggggatcaggatgtctggtacccattcgtggcttatgaacttagaagtactgttttaaattattcaaccaaagaattttgaaactggaagaggtcctagacataatcaagcctgtcactctaacaattgaagtaaccgaagaatagagagacctaataatggattaaccaatgttccataatcagggtcttaaagagccaatctagagcctacattttctcctttccagatcttctagtaatatcctctcctgaaggtgacttgtcaacaaagaagaaagtggcaaaatatattttattctttcttccctggtcagataatagacagtcaacaagatgatgctgagtcacccctgagagtttcgggggaaaacttttcctctttaagacactgattggtgagcagctgattctgcagcagtctctctgcaacagagaaatcagggctcatgacctggacttcttgtttgcgtcctggtccagtgcccttttgcaagtgttctggcctagcagtgtttggcaaattgtatttcctggcatagttttgcatttctgcgaaaaagtcaaaatcatattctattgacagggtgcttattaagaatgtcttatgtagtctgctccccacccacccctgaaacatagaaaaattgtttattcttaaattcttgtcatcatcatagaaagctgatgatgctttaagatattgacacagccatacagtcttcataggcaaaaaatgaacagattccttaaaaacaaatgaacagattccattttaaagaccagtacctcagaagagctttgttcagcttttagttcttatcctatggtgctcaaaatgctacactacataaattttgcaagtctaaatgtattcatttggatatactactaattatgttataaagtaataaatgctgcataaagaatgcatattataacattttataaaaatatctatacatcgaatagatagacaagaaattagattacccctattaaaaaatacaagtgctattttaaaagtacaagaattttgtacttttattcaaatagacattttattcttagaaatgatggataatgaacattcattttaaactttgtatattatccttagaaataatgaatattgaagattcgttttaaactttacatttacaagaattttctgggtaaatacagatagattttgaatatagatgaattgtattccttaatcatacataatttgaaagatttgttcttgtaatgatagcaccttatatttgtatagaaacttgttttctaaaacataaagcaaatatgtatattgttgtagaagcaattgttgtcaatgtatgtcactgaaaatgtatcctcatgttgcagatgggaaagtgggagcagatataaagggatttttctaagatcacacagatttagacattaaaaagtgaaatataatttttaaaagtctaccaaatccctttcattattcagtgttgtctcttaacgaactgttttgtaaattaacaaatctttaaaagtcatatctacttttacctatagttccttttccttgaaaatctgacgaataattcatcattaccccaatctcttggtgattctatgtgcatgtatgtgtgtgtgtttaatggttcagaagtatctatttttcttcttattctacttgtgtgtatgtgagaccagtctagtttaattgattgacaatttcacttaattcccccttccagccttagaagaactctgaaaagaataactcagtaggatgttcaccctttcaaacaggcttagttgactcctccatgtgaaactgtaaaacacacctactggaatgttttttgttttgtttttcttttaagcaagagaataaaaaatgtactctagttctattcattctcaggaattgacttctaaaggacagtcccattgctagatggaataattcctctgggaatcaagaagtgctctactacttaaagtttaaatggtaaacattaactttaatggactctcaagaatttccctattgattagaatcactttgccaaattaaaaaaaaagtgtgctctaattttcaataattattacacaaaaacgacagagttgccagaattccttttgtttagttttgtttcctattactcttaatctatattcctgtttaagacgtaatttttggattatgctactgatgggggaaggaatttgatttctgtggtggtgctgagcttcaacattatctccattgagttgagtggttggagtaaagtagagatgtatcaactttcaaacaaatgggacctggagaaaggctgctttcaaacagcaatgaaattcttcagcttttaagaagcataggaggcatattcatacttcttctcaacatttagttaaaatggaaatcctatcctcaacacaccaaatatgtataatttgtgatgctctgtctacatctttggtgtccagtatggtagtcatgaatcatatgtggctatttaaattcaaaatacagttaattaaaattaagaaatttgacattcagtttctcattctcactagctacatttcaagtgctcaatagtcttattataaggctagtggttaccgtattaaacattacagtcctagaacatttccttcattggagaaagttctattggacagtactggtaaagtagtttttggctattggatattactaggctagtagtttatgaaactaaaaagttcaggtttctgtgtcccaaaaccctagggaatctagcaaatttcaatttaaacattatgtaattggttctccattgcttccctgagcccaggactaaaaaatctttggcagctttcctttcctagttgagattatagccaagaatggcctgctaaaatcttaatacaaatatgtaactctaaactctgaagagagactctgggtgaagaaatttctgaatggcttagccttttattttgttttggattattttgaagtgagatcataacttgtagaatgaaatctttgagaacctaccatttaactgatttttagcagaaaaaaatgctaagagaaattatgcatataattcacagattcatacatatataaaaataaaatatcacatgggctgcagtggcagaaaataaccagaattgttaattatccttctaacttgatgaactttttgctcagtgccttttcttttttactaaaagttaaaatagaaccaaaatgaattgtttctttttgaaaagctggccgaaggtctaaaaagtaacaaatactaattgttctaagctgctttacggtgaatttcctttcatggtttaagggcttcaattcttatatccacatcattttgatttatatttattgaaacaggcaatgactttgcgtctgtgtatggctgtgttaacacaggtgtaaattgaaagtccacagatgtagtttgggcccttaataaataggctcggtgattatgacatttgttcctttctccacattcacctctcaaatccagcagacatacttaaagggggaataaatctcagctcacaaactcaactgtttaagggaaaaaaaaatcaaaccaaaacaaaccttcattttcaataaatcagctgttaatctgaatgagcaagttgtagggaaaaccttaatctccgtgactcctagggtttcccaggaaccttcaaagaattgccagtgtcccaccacctgaaaggatggcaaggtcccagtgtatgcaagggcatgaggtcactactgctccaaggctaagcccactgctggtggtggggtcacttcagggccagggtgctctctaggaccaagaggctgaccaaagttagttgcctggaccgttgtgtgtaaactgctgaactcacaggcttgttattttgtgctgatgctctgtttaacattcagagtgctattgcttgtttgctttcatttagatcagtttttaagctttaaaaatagaaaatagcgtataaaaggagcttttttgaccaaagaagatatacagatggcaaatacacatatgaaaaatgttctatatcatatgtcataaagggaaatgcaaattaaaataagataccactacacacccattagaatggccaaaatctggaacactgacaacaccaaatgctgatgaggctgtacagtagaaggaatgctcattcattgccagtgggaatgcaaaatggtacagccactttggaagacagtttggcagtgtcttgaaaaccaaacatgctcttaccatatgatacagcaattgcacttcttggtatttactcaacggagttaaaaacacaaaaccctgatatataattagatgtacacatatatatgcacatcatagcagctttattcacaattgccaaaacttggaaacaaccaggatatttcatcagtagatgaatgaataaataaactgtgataaactatgctacatccagacaagggaatattatttagcattaaatgagctagcaaatgatgaaaagacatgaaggaaacttaaatgcatattactcagtgaaaggtcagtctacaaaggctacatgctttatgattccaactatatgactttctggaaaaggcaaaactacggagatgagtagttacctggggttggggggaaggagagatgaataggcagggcacagaggatgttttgggtagggaaaattttctgtgtaatagcataatgatggatgcatgccatcatacatttgtccaaacccagagaaggtaaacaccacgtgtgagccccaatggaaactatgtactttgaatgaaaatgatgtgtcaatgcagatttatctactgtagcaaatgaaccatttgggtgccggatgttgatattggaagagactgtgcatgggtggggagatatggtagaactctgtaccttcttctcaatttttctatgaacataaaacttctcttaaaaattaagtctactgggtgtagtggcacctgtctgtagtcccagctacttgggaggctgagacaggaagattgcttgagcccaggagttccaggctgtagtgagctatcattatgcctgtgcatagccactgcactccagcctgggcaacaatgtgagactccatctctaaaaaaaaaaataaataaaggttacccctggcacattgcctatggtgtagccgtgctccacaggagcaatcaaaaacaaaaataatgaaagtctttttaaaaatgactttctgatgtatttttacacaagcacaaagttttggcaaactcgtgttaatattccttcattacccattggttggcacggattatgctttgcctgtgtaaattacagcacggagttgatgcctctttaaggcaaggggctctgccctatgggtttagtgctagtcattggctgtaggtttcactgcgggatcctgtggctcctgggtgaggcagctcttactcagccaagggaagttctacgcagaagggggcagccatgagccatcagaaaccaacgggcacagaaactgggccattggggtacctgcttggtagagggactgtggttggggcaccacccagagtacagcagctactataatatataagatctattatttagctaaaaagaatagagaagttattttcaagaaaaaatttaatttgaaagttttgtgtgtagtatattggccatttaaattttgtttcactgcatttaagataaactctatattgtgttttcagttcctagagccatacagatacttgaaaccacaactgatttgatttgaagtgtgatatatacaaatacatatatacgtatatgtgaatatgtgtgtctagagacagaaaccaaattcttgaatataacaggtgttttctaatatttagcaccagcacaactgaggccacctctggttaaaggaatcaacagcacaacaatccatcttaagtggtttccacctgaagaactgaatggaccctctcctatatatcagctggaaaggagagagtcatctctaccagctctgatgaccacgatgatgaaaggaatccgtttcataggaaatgggtattgtaaatttcccagctccactcacccagtcaatacagacttcactggtaagtgtgtttgacattgctttatttaggagacacgaagctccaaaatgttttctatattttcatatccctttacaatgaatttttattatacctacttagagaaatactaattcagccctttgatagcttttgcctgattgtttcagcatgtccatctttttagaattctggggaaaaaagtcaggtaagtgaaggaaaggaaaaataaaagatgaagatgaagaagcagccttattggatcaaagtatgtgctttgtatttgtctttttgtgaagtatgtgccaggacatgtttcttgaaatattattcactgtgttctctgagcaaatgagtttgcaaaatgccctcatgctattggagattctcagtatgcaccccgttactgaaactccaaaaagcattgtaagaaagctattcaactttgcttagctaatcatgcctaacagatatttgatgtaatgttttctttttctttctcttgctgtttccttcttctttttttcactgtgacaacttaatatctcatgttctatgaagaacattgtggggaaaactaatcccagggaaaagataacttctctaagccaggactatggtaaagcaagtgaggctcttgtttcggtcacaaaatttaaaggcactaaaaaactcagtgttaatgtaaattttaatgcaatatttttaaaaatgaaaatcaatgtgaaagcactataaaaatattatcaaaagcttaaataaagacagattgaactctgtaccagcacaatcctgcctcactggccttaccctcctcctggccttactagtaccgcaatattttggaagtcccatgacctctgtgacttacagcttctaatagcatgatttcaatatagctgtaaaaaaactctacttatggtacaccatttttccaatttttaaaaaaatttacaaagtataagatatatattattatgtaaactcataaagatgttcatttaatcatccatgagaaagtcattttggagcaaatagctagtctttaaaatattgcatatgtgaagacaatgaaatggaattcgagctataaaaatttgtattgttttatttttacttaaaatagtaaatagtttgcttttcattgagactggctgctgatgcaccttggtaatgaatcatgattatattctaactgagatatattgagattaatgcatgattaactactctctcagtacatcaaaatcattgcagagtattagaaattgaaccattgagctaaaaatgctcaacttctgctttatattcttaaaatggcaaaaaagaaaagaaaaaaaaggtaaggaaaaggaatacatgaataatagtaaaactcttttctcaaatgaaaatggaaactacctccctgatccaatatttggcttgagatgtgtttcttccaagaaatagcatccgtttccattcagctgggcatagctgctgcaaggatgtcagcttggatttgcaggctagccagcagacagatttttgatgggatcacctactgttgttgcagtgaaagatagaatggcccgtccaccgttaataaatttggtcatcctcgctatctcccttgctggccttatactctgaggtgcaagggctaggggcagatgcagtgtctgggaagttttccaaattcctctttaaaaaagttaggctgtaaacactggcctcactaagcaggatccttctgtctataacaaagcctccagctgcacagaaaatatgcttggagtacacaccatttgaaggacaaggcagggagatcacaattttggcttgaactactccctggagctttggtgattcctggagaatgagaagttcttctgtgttcaggcatgttctgggacattgctgatgccctttttagtggtagcttggctttacttttaagacccctttaacttttaatataaccatgtatatactaagttattggtttgatcctttggctgacttgccaggtttggctgaatgattttattgagttgtaccgaagcctaactaaatgtacccaattaatgagctaggacaggttttcaaaaccaactcaataactttctgtaaacttgcatctttcctaaatagagaggtaagcatataattagcatcttacattattcttactgatatattatcctatttaatccctctgcaaccctataaagtagctctttttaccctcgtagtacaggaggaaaagaggctccagtgagtgacttgcccattgtgccacagctattgaatttcagggtggaaacgtgaattggagccttccaaatttaaaggcaaggtctctgctacagggtggaaaggaacttttgtagactgttctttggaagtgatagaataggaagtatacaaaagtaagaaagagggataggaggtgaaataattatcacccaaatattccttatccgacactgctaaactttttggatttgtctttcagttagtttcagctcacaaacagcaagtagtgttggcattatttattcatttatttgtatccccaaagacatgtaggcatcaggtttttttttaatagcaattaaacccagagtgttactagaagctagatgtttaaaatataaataacattatgtgaaatgggctgaagtgttatgcgttaaaacagtgctttcaactcacattcctttatatttcattcagtttttatattctgaggcaaatttaatgagcaaatccttgaaacctctaatatgatgaattacattttaaaagttaataactttaagataaactaagatgtcctttgttttgaattattcaattcaaaatctcaaacttcaactaaaatgacttctgaatagaaatatcaattagtactcaaatacaaatataaggttgatgtacataattatacatattttatatatgaaaagataagttagattgtacccatcaatgacaggaattataaacgcattcataacacatttcatggccatgaacattatgttgcaagtctcagtaagaaatatctcattattgtagtacaagaaagggatctcttacacaacttatgcctctttcatatttgctttaaatatttttatcttacacaatagaaagagaataattcaagcatatgaatatatgtcctaaaatgttgtttaatattgtaaattaccaagcttaatactgtaaataaaccctgtcaatatctacctttgggcagaataaagaaccagataaagctattttgggacctatttttgcttccttttcttttctgatacaagtgttcttttaaaaaatctaatcttca

SEQ ID NO: 13640 - DNA, 26136 bp, Human
aatctcaacacatgtaaaaatacttttacacttgtaggatattgttttataatacaaattcttgtgtacaaactccattaacattttatttatgtacagatcattattaccagtttttgtttcccagttgagagtggggagggcagatgggctcagaatctttgcatgtgccagcatcctgcagtctcaaacttttccattcaaagcaaatacctgtgccaatatctgtgtcacttccaacaagaatgaatgctgcctaagtgctctccacacatttgcaaaatgacatcaggccccccaggtcttccaagaaccaaaggaaaagttccacaaaagtgaatcctgccatacaaacagtcccagcactttccagctcctttttcgttccagattcaaaggtctggcaccaggatgagctgaagtgtaaggcatccaccactctccccctgctcctactcccatcccacccaaagccttgtctagagaaagctcctcccagcctcaggcccaggaatgggaatctctgtgggtcacacatcagtagggaggtctttcccgatccttttctatgctactccaggagtcaaagcgtctcctgggacttttcagggcgcttcagaagagccctgggcctaaaccagctcaaccaagctgcagggacccagcctcctgagaaaagtgaatgtgagcccggtgcattcagaggagaatgaagccttcacccagaacacactctgggaagatgtcccaggcccagggggagggtttgtactaccagacctaagtcacctaaactgacaccaagtctcatccatcccaaccattccattccgggtcagaggggtcatcgatttaaccagcaaggctgcccatccaacggttgctccctctgctccctggaagggcctcctcgtgggcgttctgtacctacaggtcttgttccgttctgggaactgccagtggtggcaagaggtggagcaacgggtgccagggcagggagaggtgagtctgggagggaagcagaggcaagatccatggggctttagagactttgccaaagcagtgcgactgctcccaggttgttgtcagccgtcaagagtgagtgcacctccctgggcagacttctgctgccccagtgcccaggaataggcaggggtttgccgcaaaatgaatgacacctggcagacaataagctgaagctttcattagcagcttaagctgaggactatctatgcaaccgatactccctgtgtgctccccgggactgcttaatgtgagcccttgtggagcgattggcaccaagaaagcaaggactaagtcagaagttcaagtcccagccttgccacagcctcagggtgccctcgagcacagcaagcctcagttttcccatctgtacaatgagagaggtacacaaggtagactcgaaggctctttgttgccagggccctgtgttcctttgagtgtatgtgcttctcaggcccacagaggtcctttgtgtttcgtatgtgaactgctctctaggaaacccatgtaactgtctgtgtcctggggcacatacatgaggactcatgtgggccgtattgtgtgtttgtgccggggggaggggagaccccagaacaatgtcccccaccccacccccctcctcaataggcggaagccactggcttcctccctttcctgcctcctgcctcctttgtgccagcaagactgagtactggagagagacaggggatgggaaaaatcagtccagctgtccccaggtctgcccttaccataaccttccccccacctcaagtgactcctcccaggccacacccatccccagccttgtgggggccagattggggggcctagaggctcaaaggcagaatgagtcctcccaccccctaccctgccacccctcccacccaagccacctcatttcctcttcctccccagcaccgacccacactgaccaacacaggctgagcagtcaggcccacagcatctgaccccaggcccagctcgtcctggctggcctgggtcggcctctggagtatggtctggcgggtgccccctttcttgctccccatcctcttcttggcttctcatgtgggtaagtctcccctgagtccctcaccccatttctaggccccgaggccctgatttctacccaagaaaccctattttatcatagagacagaaagtaggatgatggttgccatgggctgcagggaggaagaaatggggagttttgtttaaaaggtacagcgtttttacaagatttttacttggttttacaagattaaaagagttataaacatggggccgggtgcggtggttcatacctgtaatcccagcactttggatggctgagatgggaggatcaattgaggccaggagttcaagaccagactggtcaacatagtgagaccccgtctccattgtgtttaaactttcgtctttttcaaaaaaaaaaaaaaaggatggatggtggtgatggtgggacaacactaggaatgtatttaatcacattgggttatatgctgcttacaaatggttaagatggcaaaatttgccgggcgtggtggctcacgcctgtaatcccggcactttgggaggccgagcgggtggatcacagggtcaggagatcgagaccagcctggcaaacatggtgaaaccccatctctactaaaaatacaaaaattagccgggcgtggtggcaggagcctgtaatcccagctacttgggaggctgaggcaagagaatcgcttgaatctgggaggcagaggttgcagtgagctgagatcgcgccactgcactccagcctgggcgacagagcaagactcatctaaaaagaaaaaaagatggtaaaatttattttatatgcatttcaccacaacaaaaaattttggaaaacaagccctatcatcactgccatcactttgatccactagaaagtgagatcaaggccaggaaaacacaggcaagtgctagaaatcactgcaacctgggatcaggggaggagtgaggagtagccgctgactgtgttggatctgaggatctgtggagggccattttcagggggtgttcatagggtaattgtgttggattcactcagttgttcactggacaaacatttattgagcaccaacaatattccaggagttgtgctaagtgctgggccattagttgagaggctggcaacacctagtgtgtacaatgagattaaatgatgccagcctcctatggttgttatggggtttaaatgagaaaatgatgcagagcagttggcacagtgcactgtgcttggtaaggatttctgagtaggtggcagctgattccttcagtctgctggtcagccgattagaacacagaggctgcctttgagtggttcatggtctagtgcagaacacaggacaggggaagagggctaaacagggacagacacaggagctctagaggagcactgaggaggagttcagcttacactgcctcaggtaggagacaaaaagggaatcaaggaagatttcactaagaggggtggtcttcattccaggcagccagaacataaaaaatgcaagtctcagaggcatggaggtgcatgggagagaaggtgcctgttaggaacacaacaggagggatagcgtgggagcatcacggggcttaggagcacgaacattatcctgagggcaatagggagccatgggaggtcacaggcaagaaagtcacaaggtcaggtttggtcttagatcaccgtggaggatgagttgcagaaggaggggctgtggctgttgggatggtctaggtgagtaaggatgagggctgaacaaaggcaggctgggggggtggggatgaagtcaagaagcgttcaggaaacaatgtgcagaattctatgactgatgaggcaggcagcacagtgctcagagatgtggactttagaatcagacaacctggccctgccactcactaattgtatgaccttgggcaagttacttaacttctctgagcctccctttcctggctataaaacagggataataacatccacctcccaggatagctgggatggtaaaatgaaacaatatcagtaaagtgcctggtgcataactggcagccaataaacattcattattatgacaatgggagtagagatgactccatagtttgtgtctcaagtggcgggtgctgtccagtgagtcagggagcactggagaggagcagatttgggaaaagctgatggaaatgcaggtccaagctgaaagaccgttcccgagttactgactcagaggtgatggttaaaactgggggagtgggcgagcttgctcaaagaagccagtagaataattaccatgatcctcctctgtaactggaaagaatatccacttcactggttgtgaggatccagtggaaaatgggggttggtatgtggtgggcggtcagtaaatgccagcttcgtttgctcatggtagcctttcaaacactgataagctaggtggcatttaaactaatgaactgcttgacagtcagctacaagagacagagaaggaagggcttggctggtggaggggttctgggtcctggagctaaggcaggctcgcaggctctccaccgtccagactggactctgactccacctgatctctcctgcctcagcctcacattttgtactccagtcacacaaacctggagagccccctccacctgccacaatattgccactgcaggcctctgtccaggctgttccctctgtctaggatgccctctccctgcccctgatttctctccctccccattgtcctcacgccaatgtgccctgctccaactgtacctcccaggaagcatctcttcatctccctgagctcccccaggctggagcaggggtcccttctctgtgctcaaaagcacagcgccctacatttggcagctgtgttcatgcctgttcctccaactagggcgtgagctctttggaaggcaaacaaagaccaagacctacctcgtgtctgtgtctgtctgggctccaggccttgccctggggctgccctccctggctctgggcccagccccaagcttagctccatttctttttgtttttctttttctggagaatggggtcttgctatgttgccctggctgatctcaaactcctgtgctcaaaggatcctcccacctctgcctccttaagtgctgggattccaggcgtgagccaccgcacccagccctagctccatttctgcgccacaaccttctggctgcaaaactcagcctctcccacctcaaatcccagcccaccagacatttctagatctccatagtgacagagagggggacccatgggacacttctgttctggctggctctcctggcctgcactctcgtggtggaggcagggagaagtggctcacagcaacctttgcagggcagttttagagacgagtggggaaacaggactgatagaaataaagtgaggaaacggagacagggagcatagatcattctttccgaaagctggggcgaaagggaagccatctggcaggagaagggaggggacacggccagagaaggattcgtggttttgtttttgttcttttagaatgaagagacttgagggaaagaggccagtgcgcatggaaggggaaaggagggggatgggaatgcctgataaagtgaggcctgtggggtctgaagaaccgggcaggggaaggaagaggggtgaaggttggagaccctcttctgagtggacggtggatcagtaagaccagagggctggggctgggggctctggggcactagggttggctgggactacaatagagtcactggtgtcctggccccaggcgcggcggtggacctgacgctgctggccaacctgcggctcacggacccccagcgcttcttcctgacttgcgtgtctggggaggccggggcggggaggggctcggacgcctggggcccgcccctgctgctggagaaggacgaccgtatcgtgcgcaccccgcccgggccacccctgcgcctggcgcgcaacggttcgcaccaggtcacgcttcgcggcttctccaagccctcggacctcgtgggcgtcttctcctgcgtgggcggtgctggggcgcggcgcacgcgcgtcatctacgtgcacaacagccctggaggtgagttaggcaggcggggggatggcgcggggaaaaccaggccgctgacccaccttccaccccgcagcccacctgcttccagacaaggtcacacacactgtgaacaaaggtgacaccgctgtactttctgcacgtgtgcacaaggagaagcagacagacgtgatctggaagagcaacggtaaagaggggcatttgaactggtggggagggtagacccatcgttctgaggccccaacactttcatgacccatgggaccctcagctttggcccctgacacacccgacctccagggcctctcctctgtagtggaccaggtcccatgggatgtgcctgcacccatcttatctgtagttctgagctgccttccttctgtacacagagggccaggagcctgtggtcagctgccccttccctcttagccccaaatgagcacgatgttaaaccctcatctctcccctgggagttagcaggtgctgtcacatagcccacctggcagaccgcatcagtccccctgaggaggaagagaactggtaacatcatgcccaacacaggcagggcagagtctagcctctcccaaagatctgtccagcccagatccttgatgcccaagacagcctcatgctgaggcctgggtagacccgtgggatctcagtcccaggcctgtcctccaccctgaccctttggccaccccatagaaggaagctgttttcctatgtggccccaagattcctgcctcagtcctcagattcacaaccccttggctgactcttgcatacctgggctcctgagggaggaagacccttccctttggccaagggggctacctcctgagctctggaccccgtgaattgacaggaaatgtgaagaggcacaggcagacctgggtctctaggctctctgttcagccctgagcaaagaggcaagaagcgggtggggcagcgactggagcactcttctaagagggagaggctcaggggagagaccctagagtagatggcacttgaattgtgctcagaggagaagtgggaagacaaagaaggcagaaaaggaaggaagggccttccaggaggagggactgagaagagcagtagggtctgaaacacaagggtgtttctagaagagaaacaatccattcaggaattcaggaatgttaggagtcaagaagggtgtgaagacgaatggggctggatggcttggccacggccaagttggtgaaaatgatgtctaaggagctggatttttgtcctgaggtcactggagaaccaggagagtttcagcagaggagttagagaggagtctgttgtaaaaaatcaccctggctgctgggtggaggagggacaagaaagggtgacgctggaggcagaggagccttgtgaggcccctggaggctaggaccagggcagtggcagtgggtgtggggagaagcggactgggttaggggatgaggaggagatggactgagcaggacttggtgatttactgggtggctggtggagcatgaagaagagggcacttctgagctttctggcgtgggcataggctctcgtggtgccggccctaggtctcatcactgtgcatggggctcattgatgtgagctgagcagaggtggacagagagaggtgacacagccctcatgtagtgctgaggcccctgacacattcatgtcccccaggatcctacttctacaccctggactggcatgaagcccaggatgggcggttcctgctgcagctcccaaatgtgcagccaccatcgagcggcatctacagtgccacttacctggaagccagccccctgggcagcgccttctttcggctcatcgtgcggggtcagaggcagagggcagaggttgtgggtagggtgggaggctgggagccctatgggtacttcctgtgggtcccctggagcccctggatctccagtcctcagtggtcaggtgggtgagggtcagctgctgaagacaccttcctccaggttgtggggctgggcgctgggggccaggctgtaccaaggagtgcccaggttgcctacatggaggtgtctgccacgaccatgacggcgaatgtgtatgcccccctggcttcactggcacccgctgtgaacagggtaaggaggaggggagctaggacccaggcaggagaggatccctgactgggagaagaccctagaaccatgtgggtggagcttggagggtgagggcgacaggcaggtcctgggcccaggggcccacagaggcccatacaccccacacactctctttctagcctgcagagagggccgttttgggcagagctgccaggagcagtgcccaggcatatcaggctgccggggcctcaccttctgcctcccagacccctatggctgctcttgtggatctggctggagaggaagccagtgccaagaaggtatgcctaacctaccctcatggtccctgaccaagacagctggccaggagcttgacccggaccctccactctgcctctgacttacgcagcaagccctcctgctcacttgaccagtccttctatcctcagcctgttgtataacctgtgccccatctgcgccctcatctgtgccctcattgccccctgtcccatgcccctctaatcatacctcctctattcccagcttgtgcccctggtcattttggggctgattgccgactccagtgccagtgtcagaatggtggcacttgtgaccggttcagtggttgtgtctgcccctctgggtggcatggagtgcactgtgagaagtcaggtataagcactatgacctctgagagccccccaagataagtcggcctttaccaaacacatctccccggtggaagagagtagtccctcctttccctacgagggtccaagtcctgccctcagggagcttagagtctgatggacagggagctctggcagggagtcagtctggtagggagtcagtccagcagggagccagtccagcaaggagctcactgccagccagccatagtggaaagggcagcagcccagagaatgtgggagcccagaggatgcccctgggcagactgagcaggtcagagaagggtctggaagcaggtgtgatctgagattagatatgaaggacaaaagagagataactgaggaaagaacaagagcaaagacccagggattggggactcaggtttgggtgccaggacagtggagtaggggacccagggattggggactcaggtttgggtgccaggacagtggagtaggggacccagggattggggactcaggtttgggtgccaggacagtggggtaggggacccagggattggggactcaggtttgggtaccaggacagtggagtgggggattggggactcaggtttgggtaccaggacagtggagtgggggactggggaaatggtcagaagaggtcaaatcgtggggcctttgaatgaaggccaaagagtttgcacttcatatgatggggcaagagggaattgttaaaaaggaacaaggtagtcagatctgtgttggagaaaggacccctagctgctggccggggagcgggagcaggagaccctcgaggactctgtacctagggaccagaaatgatgaggcctgagctagtgtgctggctgggaggatggtgaggggtctgctggcaggtattaaacggtatcgggaagtggggaggtggttaggaagtagactttgcagctgatgggatgtggggctgggacgctggaggagtcatgcgggcctttgctggttttcaggctggagggactgggtagatacctccactgagaaacagaacacggatgaggggcgctttggtggtcacgtgtctgcccctgtgggagctccaggatgagtgtcctttctccccagaccggatcccccagatcctcaacatggcctcagaactggagttcaacttagagacgatgccccggatcaactgtgcagctgcagggaaccccttccccgtgcggggcagcatagagctacgcaagccagacggcactgtgctcctggtcagcccccaatcaccccaacccaccagcccctcaggccgcctgcttcacagctgatccctaagaccccctagtccctcagaactttctgcagggcccacccattggcctgaccattgctcacatgaggtcaggctgattggtgagggggctgccactgggcctctgtcctgccatcagtccagacggacacctgggtgcctgccacagaggtgcccgttccctgtgacctgtccccttcccccatctcttttagtccaccaaggccattgtggagccagagaagaccacagctgagttcgaggtgccccgcttggttcttgcggacagtgggttctgggagtgccgtgtgtccacatctggcggccaagacagccggcgcttcaaggtcaatgtgaaaggtcagtgatgtcctaggtccacagggaatggacggtgagcagagtaggctctagatgatgctgctcaggctggagatactagcaggaaggacaaggacatctaaggtcatagcctagcaccagacaaaaagcggggttgtggtcaaccagaggtccgggctgggcagtgtcaaggctggagtacagcttagacccatctggaaaggacatcccgtgccccagaaactggggacactctccagccccgcccttcctcctgcccagccatgctgtgccccaccaaccgtcacacacagacaagtatacctttaactctgctctgggatgctgcctcccatctctgagtcaccccacagacactcagtgctagcccaggggagcatatggggctatggagctcagagggtgaccagcttggcttcctagaagtggtgcatgcctagaaatcttccaggtaaataaggagggacctcccagtgcccaagattactcagaccagagcacccccacctgctctaaggcctccttcgccttctccagcttctccagcaccctaagtcttaaccattcacacccctgccaccccctgaccctgctgtccctctgctcctgccaccccatgtaagccccctctctcaccttctgctttctcgttgccacactctgcctcccaggtcctcgccatctccctatcccgtgactatgcatgactctctgccatcaagcctcaccttccgcctttctcttctcactgtgcccaggcttaggagccagacaacctgggcttgaatcctctctccacaaattccttgccccatcaccttaaggaaactacttaacctctcttactttgtttctctctttgtgaaatggggatagctagcacttgatggggttgttacaaagattaaatttgatgatgtatttaagcatttagcacagtgcccgatacagggtgtgtgctcaatgtatgtcgataattattgttattatttaaaatgtcacctagtccctagattttgatagttctctggcagctctcacatatgatctgcagccaggacccctcttctgactccagatcatttggtggggactccatgaagtggggcatctactctggaagtctggttttgaagttggtgtggaaagtagctgctgtatgattcggaggcccattttatatccagccacttcctggacatctaatcccctgcgtgagccaaaggcaccaagggcttctctgcacccaaaatggaccttcatctccccgcaaatcagcactgccctcctgacatgctcattgctgcctgacactccctcagcttacagcgcggcatccttttcctccctcgctccctccctctttccttccttcctttcctctcaaaaagccaatctggtaaacatttgtaagagtcaagggaacctgttaaaagcactaatgcaataatctggagagaaaaagttgaggccagaataggagcagcgatcatggggtgaggaagtggggcaggaacaagaaggctgttttggagtagaatggatagatctgaggcggcctgcgcagacagacctagttcaacacatggctgtatctccttctagttgtgtgtccttaggcaagttattcggtgtctctgagtctcagtgttttcataatgcagggtaatgtgccctgacagaaaggtggctgtgagaattagaggtcatgctatgaagcgtgtggcggggagcaggtgcttcagtgccagtgccattttttttttttaataagagagtggtgaatgagggcaggggcagagagcaggatgatgcccaggtagtctccctgacctgggtttcggccccttctgtctacccccacactgcatgggaagagtgcacccccaaaccatgtctggccatgtcacttcctcatctaccatcttttgggacaccctcatgcctttattgcttaatccttgtgccccaagctacccaggggcctgaactctgtcctccctgggccctggccactatggtcatctgttgaacttggtgtccctcaagcccagagggtccccagcttgaaacaaagatgcagaagtggactggataggctgtgtgcccatgccttaccctgagtctcctggcagtgccccccgtgcccctggctgcacctcggctcctgaccaagcagagccgccagcttgtggtctccccgctggtctcgttctctggggatggacccatctccactgtccgcctgcactaccggccccaggacagtaccatggactggtcgaccattgtgggtgagtagggagagagctggggcaggacagaggtgttgggtaatagtgaagggatacagtgagcaggagagggagggcaaatggtgcgagggggctgaagggagcatggcagcttctagaagaggtgggggctgaataatgtgtgctttacaccccacgcccagtggaccccagtgagaacgtgacgttaatgaacctgaggccaaagacaggatacagtgttcgtgtgcagctgagccggccaggggaaggaggagagggggcctgggggcctcccaccctcatgaccacagactgtcctggtgagaggccaagagtcatcccttcctgtccccccaagggttactttcctgtcgaccccagggacccctgcctttcccactggaggttgttcttccttgttcactggggatcattgtcctgtccagccccaagtacctactggacagttctgacccctgacctctggccccagagcctttgttgcagccgtggttggagggctggcatgtggaaggcactgaccggctgcgagtgagctggtccttgcccttggtgcccgggccactggtgggcgacggtttcctgctgcgcctgtgggacgggacacgggggcaggagcggcgggagaacgtctcatccccccaggcccgcactgccctcctgacgggactcacgcctggcacccactaccagctggatgtgcagctctaccactgcaccctcctgggcccggcctcgccccctgcacacgtgcttctgccccccagtggtatgtgcaaggcgcaaggatagctgggggttgggggaggacgtgggacacagggacacatgagacctaggagacacgggaggctgtaggagattaatggacatggagaggacacaggacacacatagggtattaggcagacgtgaccccagcggggacatgggacttggggaagatccagggtaccaggaggacacagatcaccaggagcatgtggggagagcatggggaggtcagggttcatggcgagaaccagggtcatgggagggcatgagacttgcggaacacagggcatgggcggatgtggagaggacttgggatacaagaagtacaaggagaagcagaagcttgagggtgaaagtggcctgggggaatggagaggaattcagtctggtggggaggaggaagttggcagggtggcccctgtgcttggacccacagaggagggagcacagctagagcagatgtgtccagccccacagctacatagcccggtcctatctgagccttgccttcccccaccatctccccagggcctccagccccccgacacctccacgcccaggccctctcagactccgagatccagctgacatggaagcacccggaggctctgcctgggccaatatccaagtacgttgtggaggtgcaggtggctgggggtgcaggagacccactgtggatagacgtggacaggcctgaggagacaagcaccatcatccgtggcctcaacgccagcacgcgctacctcttccgcatgcgggccagcattcaggggctcggggactggagcaacacagtagaagagtccaccctgggcaacggtgagagggcagggcccacaggaccccccgggctctgagcggggagagctcagcacgctctccttccacatcaccccctactgtggagctagggcatcccaggcccctcctgacaaagagtcagccccagtcctggggactcagccttccattctcatgatccactgtcccagggctgggaaaatcatgtcgcccctctgacacccctcatcccttccttcatgtggcccaagtgatttcctgacagtcctggcactgggatctttcacctctccctctgtgtaaccccatggtggcctctgggttccctgacccaggtgtccccacaatctgcccctctcactgtgtccagggctgcaggctgagggcccagtccaagagagccgggcagctgaagagggcctggatcagcagctgatcctggcggtggtgggctccgtgtctgccacctgcctcaccatcctggctgcccttttaaccctggtgtgcatccgcagaagctgcctgcatcggagacgcaccttcacctaccagtcaggctcggtcagtgacccgccccgcccctgggtgcatgcttgcagcccgtgtttatgtttctacctgtgtacacacaataccttgtacaccttgtgtgtgtgtgtgtgtgtgtgtttatgttgcaggtataagattacactcaacaatgttcaagggtacaaaatataattttctttatttctctaaaactgaattcagctcatgagcccatttatattagtggtgaaatatttaagattcccatttcaaaagaattccgtgatgaccatatttcacaatggacattccagttttgggctccgtcaattggagattttcctctcccctcttttatttctccctagcggttatctaggcctagatagcaaggtgatcaaatggaagggcacttggggttcatgctggcttttgtccttgcaggccttcctgggctcgggagccagcctctgtctgcacacatctttggctgatgttcttagccctgctgtggccacctgccagtaggccagtcatgctgtgagctcctcatcctaaccttcattcttgcaaatcccagggcctccttttggagacttaagaaaggggctgggcacagtgacttgcacctgtaatcctagcattttgggaggctgaggcgggtggatcgcctgaggtcaggagtttgagaccagcctggccaacatggtgaaaccttgtctctactaaaaatacaaaaattagccaggcgtggtggtgcatgcctgtaatcccagctactcgggaggctgaggcaggagaattgcttaaacccgggaggcggaggttgcagtgagccgagatgttgccactgcactccagcctgggcaatagagcaagaccctgtctcaaaaaattaaaaaagaaaaagaaacagaactaaagaactgtaggggcttccttataccttatggaaggaggcatattctgtggccctcagaccgctgccacaaccccttcccacttagacaactgtttctaccactccagaattgtgctggcctgcaacctcacccatttctccttgaaagaggaagcacaaacctccactcctcctggcttccctgtaatcctgcccgagttgtctgtcctcctgtagcccacacccttctgtccctcaggcccctgcttagaggtggggtgtgggagggcacccactgtcactttatcctgtcacattctagccgcccatccgcaggtcctgtctcctctgagggcttcttcattgtcgtcacttaggatctgaactctgtccttggccttccaggcctggactcttgatatttagagctaagctttggcatttcaaataaaaaataaaaaaagaaagaaaaccctcttctctctcaagggctgatccttgtgatagaaagcctagtgtctctgctatgcctttgaaaaatccattcagaggccgggcgtggtggctcatgcctgtaatcccagcactttgggaggctgaggcgggtggatcatgaggtcaggagttcaagaccagcctgcccagttggtgaaaccccatctctactaaagctacaaaaattagccaggcacagtggcaggagcctgtaatcccagctactagggaggctgaggcaggagaactgcttgaacccggatggcagaggttgcagtgagccaatatcacgccactgcactccagcctggatgacagagtgagtgagactccatctcaaaaaaaaaaatccattcagagattcaattggcttctttgttccaagctgtgttggctcttcctctgaggtcagtgcacacagaaagccctcactgctgtggtgggggagggtaatgggtacagatgtcgagggcaggaggtgggaaagcagtccttaacatacatggtgtcatactctatatcaagatatatccccctagcctgggcaacatggcaaaaccccatctctacaataaaagaaaatatgaaaattagatgggcgtggaggtgtgcacctgtggtcccaactactcgggaggctgaggtgggaggattgcctgtgcccaaaagctcgaggtaacaatgagctgagatcgtgccattgcccttccgcctgggcaacagagcgagaccttgtctcaaaacaaacaaaaagatatatccctggtacatgtgcctgcatatggataggaaacgtgtgtgcacaaatgtgtgtgctccatgtatgagtgcacacgtgcatcccctgtgagtgccacatgtttaaatgcgtgtgtcccagatgcacgtgtccctatgcctgtgcaccttcaggcctgcatgtgtgtatggacctatacatgatgcacctacatatggtgctgcccaagaacatcacgtgcatttgctatgtgccgtcagcaccagtgcttcttgcaaatccctgggccccaggtcctcagcccttgcccatcaagctggacttcagtgcacttaggaagccccaccagaaggtctgtcttaaccctgcttccagttctcatattggcagtttctttggtcctgttcacttatttccttttcccaccatcagccccacccagatggcctcctcctactgagttaggaaattggacattcctctttgttatagtcttgctattttcaggtcctggcctgattttagagctatggagaaaagccaagtgtgtggacagggtaatctctgcttctgctactgtggagaaaacccctccactggctcccagcagctcagggctgagcatgtagtaggtgctcaataaatgtcccctggcctactccctaaggctggaatcttctccagagcttccctggtgacccccaacaacaacaacaacaaaaagcctggttgtaggattagcacagtcataggaagctcattccgatccttttctgttttaaatgttagaaatatcctccttccattgactcacattgtggcttctagcaactttacccacaagccctggttctgccttccagagtcccgtacactagatcccctggctgcagcctctgcatttctctccttggacatctgtccacccagcagcctacctgtggctctgttacctatgattctgtctcagttatgtcctctgtctgcctgtctgtccctggctgaccaccagggtgccctccatctgggtctctgcccacttgtctgacactgaaacctcctcgtgtgcctgtctgtgcctccttccgccccctttgactcttgcgtggaccgtctaccctcttgtctcatcctgtgaagggcgaggagaccatcctgcagttcagctcagggaccttgacacttacccggcggccaaaactgcagcccgagcccctgagctacccagtgctagagtgggaggacatcacctttgaggacctcatcggggaggggaacttcggccaggtcatccgggccatgatcaagaaggacgggctgaagatgaacgcagccatcaaaatgctgaaaggtccactggggcgacccctggcccagccctgatgctctcctttgtcccacaaatcccaggccccacctggcttcctccagcaattgaccccagcccttgccagccctttctccagagttatttctggcaaaataatattggattctttacacagagtatgcctctgaaaatgaccatcgtgactttgcgggagaactggaagttctgtgcaaattggggcatcaccccaacatcatcaacctcctgggggcctgtaagaaccgaggtgagcccccagctcatcacctaccccttcttccaaacccccatcctcagccatcacctccaccacatgagtagcttgccaggggctgctggtgacctgtgcaccacccttgatcctccttcatccctgtctgttaccatcgggtgcctgctcccaccctaggttgcctgtgtctaaatcaccactgtctgtctctttgcctctcaggttacttgtatatcgctattgaatatgccccctacgggaacctgctagattttctgcggaaaagccgggtcctagagactgacccagcttttgctcgagagcatgggacagcctctacccttagctcccggcagctgctgcgtttcgccagtgatgcggccaatggcatgcagtacctgagtgagaagcaggtgtgtgtgagtgggggcgggtggaggccagagggggaagccactgggctggtgtcagtggaagaagtcagccggccctgattgtatctggggattgaggttcctggcccaagtgtgtgggtgggtgcaagcacagcgaggaggcagggccaaggggcaggtctggaggaggtggggacttccagtatggagggtgcgggtgttgagtgagcaggtctagatgctagcctggaactcaggagagaggcccaggctggagacagcatctgtgtgtgagctgtcaccccacagatggtgcctaatggcaatgggcctggtgcgatctgccggagagggggaagggcagagatccaagcccaagtcaactcaggcctgaatgagaggacagggggatgactgtccaggggagtgtgagtctgagggaaggcattttatctttttttttttttgagactgagtctcacttttttgcccaggctggagtgcagtggtgcgatttcagctcactacaacctctgcctcctgggttcaagcaattctcctgcctcagcctcctgagtagctgggattacaggcatgtaccaccacacccagctaatttttgtatttttagtagagacgaggtttcaccatgctggccaggctggtctcgaactcctgtcctcgagtgatccacccgcctcagcctcccaaagtgctgggattacaggcatgagccactgcacctggccagcattttaaagatagtaaagttttgagtatgtttgaaagcagaggggcaggggaaggggccagtgcagagggaggggctggtggagagaggtctctggggaagctggagggctaagggagagaaactggaacccaggggatgggaagagggagggggagaagcatggaaagaggagaaggtgcagtatggccaccactgtctcaggaaaagggatccagcctgaacttggtcagggcccaggaacgagcgggtgagagccaacactgatctttctcagatatgagtcagctgacgagattgcagccaggagggtaggagtatggggtattgaaggtaacaagggtacccacgaagactgactccttactggcctgactgtcctgggctccctcatccccagtctctcctgacttctgaccctgcctacagttcatccacagggacctggctgcccggaatgtgctggtcggagagaacctggcctccaagattgcagacttcggcctttctcggggagaggaggtttatgtgaagaagacgatggtgagtctcattcaaccctcacccttagggcttgtgcctggccctgccccacaggagcctcaaacaggcccttcctccacactcagcccctcaaacccattctctcctaggggcgtctccctgtgcgctggatggccattgagtccctgaactacagtgtctataccaccaagagtgatgtgtgagtgtgagatgagagggcacaggagggcttggcccccaagaatcacccaggcctgacctagacatatctcagaaatgtcataggtggtctaaggcatgacctgggctgtgttccaggtgtgacacaggtgtgtcttgggtataaagtacctagccaaggtggggcttgctggaaggagtcttggaaggtgtttcaggaataggactggggtaaaggtagtttcggattatgtttgtgtaagtgacgggggatgccttggagaggtttgggaatgctggcggatgcttcctgaggtagatggagaggccactcaggaattgctctcatcttcctccctgaagggcaaggtcatgcccacctgaggatcttaccagagcatgacccccaagactccctctctgtgccccctcccctgcagacagccctcttggcacactcctcctgtctctccagggatgtccatcttgatctgaacctaccccttgccccaagccctttggccttgcctgcatggctcactgcttaccacactgatcactcctctgaccactacatgcctacttcctgcttctgccccaacactcccttgattccctccaccccctttgaactctctcccctggtctcagggctgatgcacactacacagaggctgttaaagtgtgagatgcagtcaagagtaagagctttggagcctgagttggaacgcttgctctgccactaactagctgtatggccttgggcaatctagctaacctctcagtgcctcagtgtcttcatctgtaaaatggcaagactaatagaacctgtatcatagggttggtgtgagggttaaatgaattaacatgtctgttaaatgaccagggcctggaccacggtaagtgctcaataaaaatgttagctcggctggctgtggtggcccacatgtgtaatcccagcactttgggaggccaggcaggcaaatcactggagaccaggagtttgagaccagcctgggcaagatggcaagaccctgtctctactaaaaatacaaaacatggccgggcgtggtggctcacgcctgtaatcccagcactttgggaggccaaggcgggcagatcacaaggtcaggagatcgagaccatcctggctaacacagtgaaaccccatctctactaaaaatacaaaaagaaattagccgggcatggtggcgggcacctgtagtcccagctacttgggaggctgaggcaggagaatggcgtgaacccaggaggcagagcttgcagtgagccgagatctcgccactgcactccagcctgggcgacagagcgagactctgtctcaaaaaataaataaataaataaataaataaataaataaaaatacaaaacattagctgagcatggtggcacacaccagctacaagggagactgaggtgggaggaccacctgatcctgggaggttgaggctgcagtaagccactgcactccagcctgggtgacagagtgagaccctgtctcaaaaaaaaaaaaaaaaacaaaacaaaacaaaagagctctaattgtgctgagcccagggatgggggcagtatgaaggagcttcattggcgcagagacaacagctggccaaggccagatacttacagagtagacacatacagcggggctgggaggcactgcacatcttgggcaggtagaagctaaactgctagggaccagggcctagaaggtaactaagtgcatccttcttatttcagctggtcctttggagtccttctttgggagatagtgagccttggtgagttcctgatccccgtcccccagagtgccccaccttaccccacgtggagccctggaccgagagcactttgtcccctcctgcaggaggtacaccctactgtggcatgacctgtgccgagctctatgaaaagctgccccagggctaccgcatggagcagcctcgaaactgtgacgatgaagtgtgagtcaccccatccttgagctccatgatcctatctctgtgatgagtgacctcagctttgatccctgtgaccccatcaccccagctggcctgactcctcatctcagcaatgccccctcgcaggtacgagctgatgcgtcagtgctggcgggaccgtccctatgagcgacccccctttgcccagattgcgctacagctaggccgcatgctggaagccaggaaggtgaggagactggggctgaggtggcgggctgggctcacagagtgctccagagtgccctctcagaggtgccatgacccctgtcccaaccacactgcctgcccaacctccctcagtgggggctgtcaccacggctaggctgggccccaggatgcagcctgcctttccagccctcactggtttagacaccaggcccttccaaaactcttccaaggccactgcttagccccaacagcaaatccctaccttaagccccaagtcccagactgcttgcctgtcctctgctgaggccatcagcctgtcctcatctgggacacctctccccacctgccagagccagagcagagtgcatgaatagtcactaaccagatggatggatgggtgaatgagtgatacagtaaccgtatgaatgaatgaatggaattagtggatagatgatacaataatcatatgaacatgtaattcaataactcaatctactaaccatgtgaataagtgaattatcaaataaatataatgaaaaatatatcaaaattagtaaatatgaagagttcttcaagtaaattaatgattaaataaccatcttaagaatgaaggaatgatcaaataaccatataaatggatgagtcgtctaaaatggcttttgaacagataagttactgaatgaatgaacgcataagccaagaattcattgaaagagtgcatgtaaaaaccctcctctaacaatggcattgagagcctctcacctgaggccccaactgtggcctgatgccttcactgccctgggccggtaaaggccactcttggccatggggccatcttaggtctccagaacaaatcagtgtcagttcaaatgcccccaccacatggaagtccaggagcttgaggccagatgcacccccattcctggcccccactaaagcttgctctgcccccaggcctatgtgaacatgtcgctgtttgagaacttcacttacgcgggcattgatgccacagctgaggaggcctgagctgccatccagccagaacgtggctctgctggccggagcaaactctgctgtctaacctgtgaccagtctgacccttacagcctctgacttaagctgcctcaaggaatttttttaacttaagggagaaaaaaagggatctggggatggggtgggcttaggggaactgggttcccatgctttgtaggtgtctcatagctatcctgggcatccttctttctagttcagctgccccacaggtgtgtttcccatcccactgctcccccaacacaaacccccactccagctccttcgcttaagccagcactcacaccactaacatgccctgttcagctactcccactcccggcctgtcattcagaaaaaaataaatgttctaataagctccattcaatgtctaccttttactgctggtcaatcttggggtgaggggcgtagttaaacccaagagacagaaactggccgggcgtggtggctcactcctgtaatcccagcactttgggaggccgaggcgggtggatcacgaggtcaggagcttgagaccatcctggcgaacatggtgaaaccccgtctctactaaaaatgcaaaaaattagctggaagtggtggcgggcacctgtagtcccagctactcgggaggctgaggcaggagaatggcctgaacctgggaggcggagcttgcagtgagccaagatcgcaccactgcactccagcctgggcgacagagcgagactccgtctcaaaaaaaaagagacagaaactgggctttctaggaaaagaaacactgtctgaggcctcagccctctgttgaggttgcctgtccaggataggaggtgctctggaagactcattttacacaaacaccaccagcccctacctctgtcctgattagaaggccagttttcccctgttcccttccctgctctccagcttccatcactaacgtgtctccctgtgtatctctaggtagcagccagcctaggattctttgttctgtccaaatagtccatgccaggatcatctatagccagcctcaactctgcctggcatctcagcgccagacggatcctggcctgtctagagtttccttaggtgccttcttctttaccttatgcctccaggcagccttccctggcttggtagccacttcactgcccaatgtatgagcccaaaaggaggagggcagaggccactcccaacttcagccagccaaggtaggattcctttgccatcttcagggcctcatagtgctgtgagaggtgcttctctcctggtcctgaaagtgagtcccacactactccatgctgtgcagcctctggacttgcctactgtttggattgctcatggctggccttagatttctctcctattggtccttaagaaacaagattgattgtgttttacacattttttcagtgaatcagaagacatcaaagaaggcataacatggtgtggcactgtgatgaagagcacaggttctaggatcacaccaacctgtgttcaagtccctgctatgtcacttatcatctgtgtggccttggtcaagtctctgagcttcagttttctcatctaattaatggagttagtaacagctacctcgttgtttgtgttaaatgagaccacacaggcccatctttcacagcactgggcctgggccatagtaagtacacagtgtcagctgatatcattatatacaaatgcaggaagctgcagggaggtaatgattaggatctgtattctgaaaatacttggatggttggaggaggatgaatttaaatgggaggctacgtaggatgagggagatgggaactgctagaataaaacttcatttcagatccacattcactgcagggattttgccaggtccaggctgtggagattaaaccattgtctttgatggagaccaatatgtaaacaaggatgcctctgtgaagtgacagctatgttaacaagcaacaaaatacagcggtgtatgctctaagagagcgggggaagctggggaaggcttaaacaggaactggagtcagaacagtttcccagagaaagtgatgttttaatctggaccatgaagaggaagcagggtttcaccaaaggaagagaccctggcacaggaaacaacacctgtgatatgtggcatgttcaggagctgcaaatagttctctgtggctggagcaaagggaaaacagggtaatgaacccagagaggtgacggatgccaggctatgctgagccttataggatatgaatctttatcctaagagcagaggagccacagaagagctataagcaggggtgagtcataatgagatttgcatttttttaaagtcactctggctaccctgtggagaacagattatataggaaaaacagtaaaggtgaggagcatggctataaa

SEQ ID NO: 13641 - DNA, 8247 bp, Human
ggcctcccaaagtgctgggattacaggagtgaaccatgacaacctgcccaaatcctttatttttaaatgtacaaattccctgaggctataccctttatccttctctatagctaccaccagaagttgcaaattattgccatatcccccccctcagatgttttatttggtccttccctacacagaaaccccacaggtaccacaatgcctagcagatgaagtccaaagtctttagcttaacatttaagaccctgaccaacttgacatgagacaaccttttctatgttttctgggaattccccacctctaacctaagcatatccaattccttattttccaaggtaattggaaatagagaatgcaaaggcttcaagtcaaagataataacattatctgtaagcatcggagtggactttaagctaatgactgaaaatgatttttccagcctctttctgggacagtatagcgtattgtttagattgcagggattagtcagatagtttgaatcctgggctcccctacttattattggctgcatgcctttgggcaagtttctaatctttctgacccagtttcttttttctgtaaagggaagatggggtatctatctgccttatgggattaaggattgaactcgataatgtatgtaaactttttttttttttttcagacagagtatcgctctgttgcccaggctggagtgcagtggctcgatctcggctcactgcaagctccgcctcccgggttcacgccattctcctgcctcagcctctcgagtagctggaactacaggcgcccgccaccaagcccggctaattttttgtatttttagtaaagacggggtttcaccgtgttagccaggatggtctcgatcttctgacttcgtgatctgcccgcctcggcctcccaaagtgctgggattacaagcgtgagccaccgcgcatggcctgtaaattgttttaacacagtagttagatggtccataaatggtaccattattacttttatgattgctgctccacctctgagcacattcatacaattcactcaagtcattattagagcactagattgagtgcgagtcagacctggattcccacaaacttctttgtatgacctcgggcacatcccttccctgggcctccgtttctccatctgtaaaatatggatttgttgtcggggtggggaggctgcaccacgcacaggttagactaatggatctctaaggtcctcacatctttaaagccccaaggggataagccacagtgcctcctgtagggcagtctaagcttatcttccagataggcaggtttgaataccgatcctttttcttgaccttaaggaattcattcacccttttcaacctcattttccctgtttgtaaaacaacagcaaacgagacaaacacacgttacttcctttctagcagggttcctacccggcgccaagcaaaagtggaatgtaccctaagtagctctggccttcttcctgctcccaagcttcccaattccgtcccctgccccgctgccgcccgcggctctccttccccttctaggaacggctcaagcgccttgggcactccatcgggttctgcaccgagttctgcatcataaatacgactctcgtgtaggatttaagtgtgaacttctgcaggttctcggaccctgaagcacccggggccagacattccgagctcgcggcggtggaaggcacgcaaaagggcgaaccgagacgactccaggacgctgaggcagcgcaggccccacccggccccgccctgccccgccctgtcccggccggctttccagtactagtcctctggcgccggctcccagcccctctcgtacccttcaaatcgcgctccgccgctagactctcgtgatagctgagactttccccggaaggcccgcccccttcgccggagaggccaatgggctagggcaacggttgcgacggttggattttgaaggagccaataggcgctcggagcggagagtttaagaggcgtaagccaggcgtgttaaagccggtcggaactgctccggagggcacggtgagaggtggtggggctgagccgaggtggggccgtggccagggggagggggtgctaggccggaaggggctgcagccgagggtggccctgattttgtggccggccaggagcgaaggggtccctttctgtcccctgagcaccgtcgcctcctttcctccagggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggtcagtgaggtgccaaaggaactgagtgagagcagccttcatactttctccctggggagcctggtcagactgtcttctctttctccgccccaggcaaatccagttccaaggttcagaccactcctagcaaacctggcggtgaccgctatatcccccatcgcagtgctgcccagatggaggtggccagcttcctcctgagcaaggagaaccagcctgaaaacagccagacgcccaccaagaaggtatgtgtcccagaggggcttaaggcacgggacctgactgttctttggataataccatcttgctccttcactaccctttatgccaggaacatcagaaagcctgggctttgaacctgaacggttttgatgtagaggaagccaagatccttcggctcagtggaaaaccacaaaatgcgccagagggtaagacccgaagttcctggttcctggagggaggtgtcagttcatctccagggctgagcacagatatctgtctcctcttcctatctaagattgagggcaagggaggtgttgattttcccagcgtctagactcactccgttgccacaggttaccagaacagactgaaagtactctacagccaaaaggccactcctggctccagccggaagacctgccgttacattccttccctgccagaccgtatcctggatgcgcctgaaatccgaaatgactattgtaagtgcatccttatcctcgcctcatgcatggagaaagagggcctgggaccacacaaacaaggaagctcatgctcttctctccacctctgacagacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcaggtgagacgtgtccagtgctgtcattctcaccagtcccaatgggcttgcacagctggaggatattaatgccaagtcccaatctctgatcctagtgggcttctctctctagctatgggatgtgcagcagcagaaacggcttcgaaatatgaccagtcactctgcccgagtgggctccctaagctggaacagctatatcctgtccaggtcagtggtttttgttggtctatggtagtctgatatttgcccaccctacccttgactgtacacccctgaactgaaccagctctggcttgcttgcatttggtgctgccacagaacctgattcccttctttcctcctccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggtgagtagggttgggctgaagcctctgcagaccctcacctataatctggggactgttaaggggagaagggatggtaggattggactgggttaatctgtgacccctagagctccttgtctggctctagtacctgctgaccccacctttattccatctaggccgtagcatggtgtccctggcagtccaatgtcctggcaacaggagggggcaccagtgatcgacacattcgcatctggaatgtgtgctctggggcctgtctgagtgccgtggatgcccattcccaggtaatcttttgcctgttcctgcctctcccacatgcattcttaccgggcaactacattcactccaatggcttcaccaactctatgccctggtgattcccaaacttctaactcagctctcactcatgagcttcatttccaacagtctgtggctatctccaatcctatgtcctataggcaccaccaccttgatctgtcccaaattaaccttgtcacttccccttgcctccctgaaatgtgttccttcctgtctcacattgctttggaatggcagaacctgctcagaaatctgagaaacctcctagaatttttcatcctcctcaccaggatctatcagttttacctcaaaatatcattgacatctgtcccctcccctcagcctcatccttccaagtggaggcccactacaatggcttcctcactggtgtcaagcattctttgttatctcctgcaatgcatcctccatgctgtggtctgttatactgtactgtccttaaacctgtgatggcttcccatcacttatggcatataatccaaatccattagaaagatacttgaggctctctccttccactccccccacattcagccttcactgtagatatggactctagagccagatggcccaagttaaaattctggctctgtcatctactaaacttgaatgtgacctttggcaacctattgaacttccttctgattgattcctcatctatccaatggataatacagatgctccctgatttaagtcccagtaaacccactgtaaaggtaaaaaatggttacatcagcgagtgtctataatttgcctctcaaggaacttttgtatggactatgatcattcaactctgagtctggagcatgtggcagggtgcctaacactagaatgggctcagttctgatttaagtagccttggctatatgtcatgcccacaccagctcctctccacaggtgtgctccatcctctggtctccccattacaaggagctcatctcaggccatggctttgcacagaaccagctagttatttggaagtacccaaccatggccaaggtggctgaactcaaaggtaagtggctaggtgaaaagccggacataaaaggccacataatgtatgactgaaatgtccagaataagcaaatccagagaaaaaacacattaatggttgccaggggctgagagagggtaatgggaaatgttgaaaatgtcttagaattagttttaacagttgtacaattttgtgaatatactaaaaatcactaaactgtacactttaaaaggatgcattttatggtgtgtgaattatatctcagtaacaccattgaaaaaaaagggaggaggccaggcacggtggctcacgcctgtaatcccagcactttgggaggctgaggcgggcagatcatgaggtcaggagatagagacaatcctggctaacatggtgaagccctgtctctactaaaaaacacaaaaaattagccaggcgtggtggcaagcacctgtagtcccagctactcgggaggctgaggcaggaaaatggcatgaacccaggaggcggagcttgcagtgagccaagattgcgccactgcactccagcctgggtgacagagcaagtctcaaaaaaaacaaaaaggtaggtgggtggcccagtgcctcctttatggctatggctgcatcagcattcgtatgtactgttctcatttgctccaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgttttttttttaaatctgtttcagctaatgcctttcttctttcatgacctatgtcccagcagccttcctaggggctctactctactgggatcagagagctagatatgtcctgtgggagcctggaccatccatccctcttgtttgtggacagggctaagcgtgttgtgttcccccacctcctctgttcacatacgtatacacacagcctccgtggtttcctctgtcacttttaattaagacacaagttgagtaagcagcctccacaggctgtattcccaggcccccgcccaccctgacctttggcccagaagctactgcttcagtgtgtggggtggaggagtgagactgggtccacagtgacattattgctgacctcttctgtgtgaggaaaaaggccacgagaccctttgtggggccagccctgagtgctcctctcccaagttttaaggcagggagggggaaataactgtacagcccttttagcccccagctctggagtggcagacagcaatgaggccacatccctggagctgcccgggggaagtgggtgaggaaccaaagccgtggtccctgtagagcagctgtggggaggggagggccagtcccctgctcagtcctgaccacataagccttggtcacaggtgtaggtggagagggcactgacggacactgccctaaggtgcagtcctgaggcacttaggtgggcgcctatctaggccatgcttctcagttggccttgaccttggcaatacctggagctccattttgctgaagtgcacggggcagccgcttgcccttggtataagagtgataccagaagttggagaacagcatgaagaagatggtgccatacatccagatgaggtgaataatgactgggtactggtagttacagctggacataaagtagtactgggagatgtgcagtgagaccaggacaaactggatctaggatagagaaagaccagggtcagagggaatagtgagaggactagaggggaagagggggtagagaaagagacaaacgttgagtagggagagatggggtcaaaggtgagacagactggataaaggcaggatccaggctaggaatgtggggggatggttataggtaagtcaggccaagcccctcaccagctgaatggctgtcatgtgctttttccaccaaaggtagggttgtgccacagggccaaaggcagataatccgtagtacaggtacattatgacatgcacggaagagtttatcatggcatggaaagagcccattcctcctgtgagtggacaataagacagggtcagcagagtccagcctctggtgcccaccctttcccatagtggccttcaccactcacccggggcaatctttaccccccaccaccagctccagggaagcacagagtgatggaagacatgtaggaaggtcacctgcccgtctttctttcggagaataaagatcacctgagagaagagtgagggaaggggattcagaacctgggcttctccacctcattctcccctcaagttctcacatctcatataactactcactgtgtccatcagctcaatgaacttggagaagaggaagagccaggccacccgaaccatctgcaagaagttgggatagccttaggacctcatacactattctaagagcctccctaaactgggccttgagcacaggccccaaactggtcatatctaccaggttgcttatgacctagccccagcccctacttaccctaagtgcctcagggctgttggaatagtccacagggtcacagcgccaggtataggtgctcagccagcccgacatcaggaactgggaagggatgtggattagaccaccagagttctcccttcccagccatccctccccttcgctagctgaggacatggatctgaacctctctggaaaggagaaatgccatgctctggctctatggcctgctccttatcctgctgacagaaattaaagcccggcatcccaggggcccacctcatagacaatgtagag

SEQ ID NO: 13642 - DNA, 9110 bp, Human
tactttcatccttttgcattgcaacagaacagatagtgctaggagccataagaaaggtacaaataaactattacaacagtgttgaaggggtgatgatttccagctaaggggaagagacagcatttgaattcggccttagaaggtgactggtggtgtcatgagctaaattatgttcccccaaaattcatgtgttgaagccctaatccccaggacctcagaatgtgactttaggccgggcacggtagcgcactccagtaatcccagcactttgggaggccgaggcgggcggattacttgaggtcaggagttcgagaccggcttagccaacatggcgaaactccgtctctactaaaaatacaaaaattagctgggtgtggtagtgcgtgcctgtagtcccagctactcgggaggctgaggcatgagaatcacttgaacccgggaggcggaggttgcagtgagccaagattgtgccattgcactctagcctgggcaataaagggagactcagtcttgaaaaaaaaaaaaaggaaatatgtgctatagtaatacatgggcttcttaacatagttctatttgtgaacttataactaatgtaatttaaagggagtgtgtaaataatatatggagacatctgcatcaactgtaatgtaacatgaagccatctatggtttctattagtgaccaagtcacgagtactgctaatgccactgtggtctgttgcctacattcctaaataaagaaagcattacatttcattaaatttggtgaaaataaagttgtattttcccattcaagttcatgggatcctctgaattctatacatggactcttgtggactccaggttaaaaacccttgctgtaatccgttggtgtaaaaatgcttgaggtgactgcaaatatacatggaggtttttgcgtttatttatttactttttcttttttgagatggagttttgctcttgttgcccaggctggagtgcagtggcgcaatctcggctcgctgcaacctccgccttcagggttcaagagattctcttgtctcagcccccgcagtagctgagattacaggcgcccgccaccacgcctggttagtttttttgtatttttagtagggacggggtttccccatgttggccaggctggtctcgaactcctggcttcaagtaatccgcccgcctaggcctcccaaagtgctgggattacaagcgtgagccaccatgcccagcttatttttatgtttattttatttactcatcaaaaaggaaaggtttttgcttttaaatggggaaaaggatgaaaatggggaacactagcatcccaaacgcatgttattaattattgtacatcttgccaaaggcgggctacaatgtcaggctggacttctagcagccaaggaagaggttctgtccctaactttctgagttgaaaactttgattggcaaccttccgcctagtcgaaaacccctaggcttacataagcgtccacgtggtccaaccccctccaacttctccggcttcctccgacacgactgtcccttcccacacctcccagccaggccgaaatgactcgtaaccctctgggaaaatggcacttactctccgcctgccgagctccgacccggcgttccgagtccccggcgcccggaggtgacggtcgcttcccctgccctcccttagggttagtcccgcccaatcggctccttaatttttcggaggggcttctactttggcatttatcacgggctgtctgcctcacttacgaagcagggtgcccctagcacactgccgggcccctgggggaacgcacttagggaagcgaagcaaagctaactgcatttggcagaaaccagcgcgctttcccacggcgccacaggagcgcaccgctagacagagaaggcactagaagaggcggtcggtgcatagcgtcacctcctaaactccgcccatcggaagcgccttctaagctcgttcttccgccagcttccctcctcttcctttctccgccatcgtggtgtgttcttgactccgctgctcgccatggtaagtccatcggcccccatcggccccggggtggcttcccaaaacccgaggccgttgccaggaaatgcctgggccgcgcagagcgttgaggggcgggagccttttaaaggctttttcaagaaaatatccagttcggccactgttgtctttcgtggcctggagggaagctagtgagccagcgagcaacctggagagggacgggctgcgctgcggccgcggattcaagggggctctttctttgcccggccgctgccgagtcgggcagggattccggtttcccttcgcttgtagcgaactcgttctggaggcggggggtgggaggtggcagccacccccgaaatcgtggcctgactgtgggctgcccgtggcatgcgcaacgtggagggtaatcaggagggtattgtgggctactggttttcgaaaagggtttagcttggcgtggagaagcgaaccgcatttttagatcccaggacttttgtttagaggacgtttattcagagacttgagcgtcaccccgtggaagcgcctagaacaaggggtgttttgcgaacctgtgtgtcattctggccttcttagtaaatggcagcagcgaaccagtcactctttactgggaaatgtaaaatgttgatttctagatatggaggcgataagtactggtattttattacttgtcaagtaatttattacttgacaaaatttacaactgctactgtggatgggggacggggtgtaatctttgccttctttgtattggctcccattattatgcaagggtatgttcgtccaggttggccaggcattaaacctgcatccgtgccaattttgcaagattattctgtagatttgggggagtattggggttggccttagatgaaagccaaaagatgcaactagaaattgagacagtcatccttggaaaagtgacatttcatttatttttaaatttaaaagtttatttttttagccagtgaaatttagcagtagagatagagttaggattaataccgaaatggtgagtaggttagatcttctgaatgtcagggactttccctaagtcttaattaccctcccaataacacttgaaaagtacgtacccctgttttacaaagtagagcactgagattcgttgacttgcaaatggtaggtaggtggttctgtttgactcaaagctgtgttcttcccaggaagccagattccctagccattcccagtgtggtcgtctgagtccttgggggaccacagggtaaattgaaaggtagcctctggctgtggagcagaaaggacctgggtttgaatcctggttctgcacattgatgctctgattttgtgcatgtttcttaaccggattccacttattttatctgaacgatggaaactgtggtatctgcccccagagaagttgtgagggtcagagacttgcttggcttgatggcttagcattgagaagattttggggctggggtatgtgttaagcactcaaatgttggtttgaaggagttcttgactttgaatcattcgggcaggctctaatattgtctaaattgattgcattttcttcccagtcttctcacaagactttcaggattaagcgattcctggccaagaaacaaaagcaaaatcgtcccattccccagtggattcggatgaaaactggaaataaaatcaggtaagacctccatcatactgcttgtattttgctaaatgtaagagccactgtgtctggccagggttactttttgagtataaatacatgattaaaattgcatgcaatccaatccaccctttgacagcattctcaaattcgtttttaaaaacgtacttcctttgtttctgcactgcatccagcccacatctgggcttatgggcagataattctccaatacttattaatttcctggtcatcttcagtctgagctaggtcataaggtggaaggctgtcttatacacatcctggtggggaagacccagtcagtatttttaggctttttgtttttgtttttgtttttgtttttgttttgagacggagtctcgctctgttacccgggctggagtgcagtggcacaatctcggctcactgcaacctctgcctcccaggttcaagtgattcttttgcctccgccttcagagtagctgggactacaggcgtgcgtcaccacgcccagctaagttttatatttttagtagagatggtatttcactatattggccaggctggtctcaaactcctgagctcaagtgatctgcccctctcggcttcccaaagtgctgggattacaggcataagccattgtgcccggcctttgtttttgttttttgagacaggatcttgttctgttttacatgctgcgttgacactatctccctgcaacctctccctacctaccagactcaagtgaccctcccacctcatctctctgagtagctgggactacaggcacacgccaccacacctggctaatttttaaattttttgtagagatggggtctctctgtgttgcccaagctggtcttgaactcctgagctcaagcaatcctcctgtctcaccctaccaaagtgcagagattacaggcgtgagccatcacacctagcccagtcttttagatgtttctcttttctaaaaagagactagaaaagattggaaaactgtcctctactgcagaagtagttgatctcaaaggaaaaacattactagaattgctatgaaggacctccaaggtcatctagactaactccagggaaagctaggcctgaaacagtctcctgcatggctttttcagcccatcgctctttggtcctgatgggccttgagacaggttttgaagggagcatcaagaatcagcaagagttgcccaaggttcagcagtcgctctctcacccaggctgagtgcagtggtgtaaccctcccacctcagcctcctcctgagtagctgggactacaggcgttcaccaccatgcctggctaatttgtgtacctgttgtagagatggggtttcgccatgttgcccaggctagtcaaagcactttctctttttttttttttttgagatggagttttgctctcattgcccaggctggagtgcaatggtgtgatcttggcttaccgcaacctctgcctcccaagttcaagcgattctcttgctcagcctcccaagtagctgggattacaggtgcctgccaccacacccggctaatttttgtatttttagtagagacggggtttcaccatcttggccaggctggtcttgaactcctgacctcgtgattcacgcgcctctgcctcccaacatgctgggattacaggcatgagccaccgcgcccagccagaacttgattcgacttgtatggcaaagctagtgggattggtttgctaagaagacttaaaggggtggcttcttagggctaaagttgagggcctatttccttggttcatttagctagttagatgtgaaaattgccacccattgtaatgttatgggctagttaattgcttaccatttgtttactggatactagacactgtcctttattatttgatacatctacttgaacgtgggtttctctgtgtcctgcctgatggtgggacctgcttgtgaagagtgaaagaagtatatataaaccaggcacagtgcttcatacttataatcccagcactttgggagaggccaacgcaggaggattgcttgaggccaggaatttgagaccagcctgggcaacatagggagaccacccccgtccatctctaccaaaaatataaattagctggacttggtggcacgtgcttgtagtcctaactatttagcaggctgaagtgggaggatcacttgagcccaggaattcacaggctgcagtgagctgtgatccggccgctgcattgtagcctgggcaacagtgtgaccctgtctcaaaaaaagaaaaatgtatgtaaaactcaacgcctagttcaataaataacctgctattaaactctgtggtctcctagaattgggaaggtattttgtacgtaagattatatacccttgacccagataattgacccaatggaatgattttcattgttttagctatcttccagcgttaaaaatgtttttgaaagcaggttgcaattacagtgcttcattttgtggaagtactgccattatcctgctgaaagaaaagccgtgttaatcatttttgattttgcctttatgagggtaaaatcatgacagattgacatggacaattctgggattgctgtttccctgcactagacgtgaatggaggagttgatcgattgtaaagatcatgcgaggccaggtgcagtggctcatgcctgtaatctcaactctttgggaggacgaggcgggtggatctcgaagtccagccagttcgagaccagcctggccaacatggtgaaaccctgcctctactaaaaatacaaaaatacaaaaattagctgggtggtgttgggggggcgggcgactctgtctcaaaaaaaatatcatgcgggagcttttatatgtttgtgacccattatgagggggttcagagtatgtctgtgtacctccaggtccattgaatcaaaagtgggtacaagtacacttggagagagtgggcttcgccactactctgatcctagttaagagcctagccttcaaattattttgagaggataaaacttgacttggctagtttttaaacacatagggaattattttttttactctccagaaagaactccaaacttgttagaggagagaaaagcagtaccctttgtattttgtggtacctaaaaggttatgtgaatgggaacagctacattgctgtcagactgcctttgtaacttgacatttttttctgtgtaggtacaactccaaaaggagacattggagaagaaccaagctgggtctataaggaattgcacatgagatggcacacatatttatgctgtctgaaggtcacgatcatgttaccatatcaagctgaaaatgtcaccactatctggagatttcgacgtgttttcctctctgaatctgttatgaacacgttggttggctggattcagtaataaatatgtaaggcctttctttttaattgctgttgtattgtggtttgtcaattactgaattctcccttccctgccaaacctaataacaacactatccagtagaactttctgcaatgatagaaatgttctctggctaccatgtgcttgaagtgtgtttagtgtaaaggactgattctgtaaattttattttatttttttttaatgtatttatttattttgagacagagtctggctctgttgcccaggctggagtgcagtggtgcgatcttagctcactgcaacctccacctcccgggttcaagcaattctcttgcctcagcctcctgagtagctgggattacaggcgccccccaccacatccagctaatttttgtatttttagtagagatggggtttcacaatgttggtcaggctggtctcgaactcctgaccttgagatccacccacctcggcctccccaaagtgttgggattacaggcatgagccaccacgcccggcctcacatgagttttacaattaatcaactcccccattcacgtctagtgcagggaaatagcaatcgcagaattttatttttagtagagatggggtttcaccatgttggccaggctggtctggacctcctgacctcaggtggtccaccacctctgcctcccaaagtgctgggattacaggcctgagccaccgcgtccagccatctgctgcctgtttttgtacagtctgtgaactatatggttcctacatttttaaatagttgaaagaatattttatgccatctgaaaattgaaatacaaatttctgtccatataaaatgttcttgtttcacagccatatgcataacttacgtattatgtatataaatgcacccttgtgcacagagataatgtggcctgcaaagcctaaaatatttactactttgctctttatgcaaaaagattgcccacccctgttcctggattcaagcgagttcacttgtttaaaaaaaatctaggttaattgttgacattgtaacaggtaatgctattgcctgacttactgaagagctacagctgagtgaatgtacacggtggaaatcttgtggatttgagcttttactgggttagtgcagcttcttcggtaccccttgcagtttccctggctgacgaatcatcagggaattatgtttaacatctcaaagaaccagtagcaacttcatatttagagagatgcattaacaaattattggccacctttgtgtcagacactgttctaggtacttggaattcattggttgatagacaaattatgtggcatgttaagtggtaacaacgaataggccaatatacaaaccttagcagatcttttctgtagaaaacgtgagagggaacaaagctcccccaaataccagtggaattaggattgaaactgcagcaacaagggaaagaacagggtttggctgtaactccctgcccagtcgatagggggcctgtgctgcctggacatagctgagaaggcaggtggcagaagatgtgggctgctgcataaagtgtgcaagtggtaatggtgggattgcacagcaaaggggtccctgccttacaaccacactaggaggttcagatgaaagcaattccggctgggcacagtggctcacacctgtgatcccagcactttgggaggccgaggcagatggatcacctgaggtcaggagttcaagaccagcctcgcccacgtggtgaagcctcgtctctactaaaagtacaaaaattagccgggcgtggtggcgcgcacctgcagtcccagctactcaggaggctgaggcaggagaattgctcagacccgggaggcagaggttgcagtgagctgagatcaccccactgcactctagcctgggcaacggcaagacttgtctcaaaaaaaaaaaaaaaaagcaattcctaagagcatggcgctcaccagaaatgtgaagagtgagctccagaataccaaggaaattaggagctttaaagggatctttggaacctatctcctgaacccctagactgcaat

SEQ ID NO: 13643 - DNA, 13829 bp, Human
aaaacaagattcaaagagtgagagggatgtggtgggagagaaattctctgttgatgactttgaagatggagtaggccacttggcaaggaatgcaggcggcctctaggagctgagagtagttcccaggtggcagctagtaaggaaatagggaccaaagtcctacaactgcaatgaactgggcttggccaacaacttgtaatttgttaagcagtgatgaaaacgaatatacttgcttttgtagatcttgcttttgttgatttcatatgtgtgtatgtgtgtgttagtagactgcaagttcttagatgagaggaaaaaaagttttttttttttaatttttgtacccccttcctactacagccataatgtgatgctattagggagacttgccttaactgatatgttggagttaatgggagatagaaatccttgaccatgaaagtacctgttgttaagcagcagctagaatcactaccattgtcaagtgcctcctgcttctcatgttagaaacaaattcctgcacatctgatatcttctggacatcttcacggggatgtctcaccagtcccatgaactcagtaagtcccacccaaaatttccttttccaaacttgtccctctctctctattctgtaattctgttaatggcaccttcaaaaccccagttatctcggggcttagagtttcagccactgttgactccttcctctctcttgccccatattcagcctgttgccaagtcctccccattcattcatatcctcgcctttattgtcactgcctgcttcagtatctcgcacctagatactgcaagagtctcctgcctgctctcttgagaccaatctctgataaggacagctctaatgatgtcacttccctgctcaatggacttccaaggaatccattagcttggcattcaaaactcttgatgacttaacccaaatctacctttctcctattttcaataatttttaaatgtgtattatgcctatcttctaagttattttgggttgacctttaaaaattatcctttaaaactgttattgcttttgcaggtccacggactgtgactcttcctgcaacctgcagcttttccacgttccttttacttcagacccactgtccttgcaactccctgcagtcggatagtctcatatcttggactcttctgaacataaatagccgcttggcttgttgaactaccaaggggaaatgtggttccagagccaaattgtgagtgcccaaaacaaaacagaacaaaacaaaaccctactctgcctgccttaagctcccattccctcccacaggacatacaacactatttcattctgccctggggtgatcattggcctaaacgttgagcgcccaatcctgcattcaatcccacagccccgccccgcccccccgtcatagtcaaggccgatttattcttttgattttccgtgattttaaccaatcactcctctccccacccctccgaccccagtctccggtgtccgaaggggttgtgcaccctagagttgccgctttttgagaaccggttttacctccgcccactccttcgtcctctagtttgggacttccaaacttctcccctctcctccccgggcatagtgcgcgctttcatgaatgatctggtcacaaaacaaacaaaaacgaatagaaaaagaaaaaaagagaaaaagaaaaaaagccgaaaacttcccagggtttgccttagaattagcaggtggggatggaccccgttccaccacgagctcctccagcgcccggggctccggcgtaccctacgcctctgcgctcgcggccccgccccgggcctcccgtggggctttaatgacataagcaactttcctcgcgcaccccccgccccgtcttggtacggcctgtccggcgctcgacgttccacccccctctctctgctctcaggttggttcagcccccgtctacactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcggtcacatagcatttatacacacacacacacacacacacacattcagtttgaaggtgggaacaaaaacatttctgcaaactacttaatacatacttatgttgctgagccggattgctttttgatgctaccagtccacaaaatgttgtgaggtaagtcaatttcaactaagtctgtaattcatctcaagtacttagatttccccaggaaactgtggacagtcacctgaatatttttagcttcctctttacctttaccccctgggtaaatatcattactcttcagggctgcaaagaaaagaaatgacagcaggaaacagtgattgtaagggcatactactttggcgcagttaatcatttgaactgatttgtagcaaaaaactatagctagacttaattttcttctaccagattggcactagtttttttgtttgtttgttttttgtttttgtttttttgagacggagttgcgccctgtcacccaggctggagtgcgatggtgtgatctcggctcactgcaacctccgcctcccaggttcaagcgattctcctgcctcagcctcctgagtagctgggattacaggtgtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggctttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccagtgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaagagtgttttaaatataaataaatcctatgatgaagagttttggatattacttgaaaaatcgattttcagtcatcaaaaataattttgaagttatatgtattttgctttcttctcaggggtcacaaactggtggccaaatggcagaaaacacctgcaggtgtgttttctttggccaacacagtattttccaaaacttgactttgtgagtgtctttaggcagaacatataccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatatttctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatatcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataaccttaaaatttcatagtcaaggtatcttttttttttttttttttagctcagtataaactttttgtattggtttcttattgggatctcatatgtactcatttcccccctcaaacattaaggtaaaagcaaaaatactcattctgggaggggaaaagacaagacagatacttctggagagaactttttttttctttccagtcataagtggtaatgctttttaaatatattaacagaatatgttgccgggcacagtggttcacgcctgtaatcccagcactttgggaggccagggcgggcagatcacgaggtcagaagatcaaccatcctggctaacacagtgaaaccctgtctctgctaaaaatacaaaaagaaattagccaggcgtggtggcatgcccctgtagtcccagctgcttgggaggctgaggtaggagaatcgcttgaaccaaggaggcggaggttgcagtgagccaagatcgcgctactgcactccagcctggtgacagagtgagacttcttcctctcaaaaaaaaaaaaaaaatttaacagaatgtaaaattattaaataaagttacctcagtatacattataatcaatcaagggaatgaggttatggggggcgtgcggggggcagggataaaccaacctaggtatttatcagcaccctcagagaccaagatctaacttgttgatcctgacataccacctctttaaaagccctagctcaaaaacaaacagtaccaaactttttttttttttttttttttttttttgagacggagtctagctctgtcgcccagactggagtgcagtggtgcaattttggctcactgccacctctgcctcctgggttcaaacgattctcctgcctcagcctcctgggtagctgggattacaggcgctcgccaccatgcccagctaatttttgtatttttagtagagatggggtttcactgtgttggctaggctggtcttaaactcctcctgacctcatgatccacctgcctcggcctcccaaagtgctgggattacaagcctgagccaccgtgcccggcctagatggtattttaaatcctatgcaaagtttgggagtacagatatcctcaatcactttgattaaacaaaactactttcttctgaggagcaacccatctcatttgaaagaggcaaggacaatgactttgtaaaaactaccacctcttggtacttgtttggttgggtggatggggctaaatgaagttaagtccttatgacacatgtatctcactcatcttttaagacatggtacttgaagcctcagtatggagtacaatctgtactaattaccacattacttggattgtttcacctaggagcaatgtccttcaatttgcttaatagtttccctcaagtccatttctgcttcaaagtagaaccacattaaatttttctatttggtggattagttttacattaactttttcatcctgctatgtggctgagtgctttaaattgacactgttaatcatacctgaaacaatgtaaggcgagactcagaatggtcaggtttaataacttttttcttctgtacacctgagaaacactatacccaatctctttcacaggataatccatttaaaaccttacaacagagccaacaagctgacctcccaaaacaacatatgcatggtcaaaggcaccacaaaccattcatttgaacatttcatgctaattgcctctttctccctttaaaatttttaacaccacaggctacatgtattgataacaaagttaatgaaaacaaatttgcaatgtccctttttcaaatggcagtcaggtttgaacttttcaattctgcacgtgctgatgtggggaaggaggtatgatgaagaaccaaagctgcaattagaatcctttatttaggacccatctccagcttcaggggttactcatagcaaagagaatgcattgtatactactaaaaaagaatcccaacaaagtgcatgatattgccattcattttgcaatca

SEQ ID NO: 13644 - DNA, 22973 bp, Human
agtagagttgtcagcaaagacagaaaagccaaaagaatgaatgagattaataaaggagtgagtgtacatagaaaagaggtctaaggactgagccctgggacactttattctggcaactgacaaacagctggtggtttaaagctagtgaggacaccaaaacagaggcatacactaccaacatgcaagtgcagagctaagcagtaggtcagaggcagatgcataaacaaggctcataagaacggccaggtactgaaagcaagagtaacagatgtcaaatacagggaaaccgttttagccacaggaataggaatccaagaataggctggacaattggagtgagaaaatttaagtgcagagtcaggggaatatattctagaggtcggcaaaaatgggagttggcccttaggcagctttctgccttgggctcctattgcatctttaatttggtttctgtcctctatgggtgtctgtgtctctctctctttttgagatggagtctcactctgtcacccaggttggagtgcggtggcacaacctcggctcactgcaacctccgcctcccaggttcaagtgactctcctgcctcagcctcccaaatagctgggactacaggcgcctgccaccatgcccagataatttttgtattttagtagagacagggtttcaccaagttggccaggctggtgtcgaactcctgatctcaggtgatccgcctgcctcggcctctcaaagtgctgggattacaggaatgtgccaccacgccctgctaattttttttgtttttagtagagacagggtttcgccaagttagccaggctggtctcgaactcctgacctcaggtgatccacccaccttggcctcctaaagtgctgggattacaggcgtgagccaccacgcctggccgactgatctgctttctatcactgtggttttatttttctaaaatttcatataaatggaattgtacaacatgtactctgtgtctagattctgtcactcaacataatcactgttagattcacatttggattgtttccagtttggagttattataaataatgtaaaattggccctttttaagtgaagatggtgatcgcaactaaatcaagttgggttttatttttattcccctccctgtgggacatcagtacctggggagaaggatccttttgctaaaataaggtgatgaaaacaaatcttgtatattttagtcatattactcctttaaatatcagtatcttgtgtttatttattattatccttcttttttatatacagggtctcgctctgtcgcccaagctggagtgcagcggcgcgatcatggctcactgcagcctcgaattcctgggctcaagatcctctcttctcaaccttcccgagcagctgggactacaggcgtgcgccactgaactcggctaatattgtagtatttactaagtatctgtaaatcctaatcaatataaggaaaataaagttttttaaatgttaggctttttcttttagttgtaggaaaataaatgctaaagcctctgaattcaatgataaaaaatacaagtcgctcccctagtgaggcaaaatttggacggcattgagtttatctgatggaaactaagcgtgaagaacctatctttcgacctggaaaactctgaagatgaaaggattcgatttactcacaaacagggaccctgagatagctctggcccctgaacgcccaacaaaagcgggtagctgctttgtatgccgggatttgtagtccccgacagagtcacttcaagatggcggaattgctaatgacgcgcgaaggggcgggccccgagggagtctgggccgcgaggggattgggtggcgcaggaacttggcgggcgggaagtaaaaaccaggtgttaaaacctttgcactgggaaaggcccaagtctcgcgagagcttggcaggacccaatggaacgtggggcccgacttatcacaaggggcatttgttgggggcggagctttgacgggagcttcccgggagccgtttgtgcccggggtaaccccgttccggccaagccgcttcagcgggggacgtagccatgaaggaagagaaggagcacaggcctaaggagaagcgagtaaccctgttaacccccgccggggccacaggcagcggtggtgggacctcgggggacagctccaagggggaagataagcaggatcgcaacaaggagaagaaagaagcgctgagcaaggtgcccggtcggccgctggcccgggagagggcgggacgagtccgcagcgcggggaggatggctgggaatggggctgccccctttctttctcaggttctccttctatctcttcgcctgaatggaagtcgcatcatcctggttcatccattcacccgaaatggggagagcccctcccggccaaatcctgggtgggggtgaggaaaagaggggactccccaaacgggaagggtttaggtcagagctgtgagatgataatgggagggaagagcgacggtataaagaatgaggaactaaaggtgtaattggggagaaatattaaatagtgaaggagacatgagggatgggaatattattcatggaggcgagttgggggagagtgcagggtgattaatggtacaggagggtagatcgagagcatcctattttgagagcaatgggtagattttttgtattcgttagagttttgaattcttaagttcaatgggcaaggattttgttttaagatgtgttggacgtgggagaaacttgttgctaaatcaagatttcgtggcacccacaaagaccagcgttggcttactaagttattgccactagatctgttaaaaaatgggtgatcgaaaatgatgcacaaacctggtaaactgcagggctgctgtaaagagcaaaacctgcgatttttccttgctccaggtggttctcatttccaagggtttttttaaaccgcgttactattatgtttgactaattctgagcattgggctgcagaagaatattttctcctgggtttttacaagtgatctcatattttaaagcccagccttcttcaggaactgtgattctttcaggtatgacagaaaactgatttgtactaattttattttccttatgcatttcttaaggtggtaattcgaagattacctcccactttgaccaaggagcagcttcaggaacatcttcaacctatgcctgagcatgattattttgagtttttttctaatgatacgaggtaaaaaaaaaaaaaaaaggaaaggggtaaatgaaaaaggtttctttcattctttttatcctactgtttttcatttgatttttgagcttgtctttaatatatgcatacttgtaattgggccagacacctgcgagtacatttacataattgctttcctctctgcagtttgtatcctcatatgtatgccagagcatacatcaactttaaaaaccaagaggacattattttgttcagggatcgctttgatggttatgtattccttgacaataaaggtgagtcctggtaactgaagtaaaaagggaatttctttgtcatttgtatgtttaagacaactcgtgcattgcgttgcttcctagagttttacacatttaataagcttattgcagtcttataaatagacgtgacttttcacagtccttggttatttttattaacctactatttttttagtttgatcaactgagtgaaattgcaactgttttctcctcgtgtgacacattttttgccctggcttaaacctgctgttttgactgtagaatttcagccgcagtactgataagtgactcttaaacttgtttgataagttttaaatatttacttcttattttgcttcgaggacaaacatttatttaattcaaatccattaagccaacagttcccaattgggatactgtttaacattctcacaaagttgtatataattaaaacatgaaacttgatacatctcggcctggtgtggtggctcacgcctgttatcccagcactttgggatgccgaggcaggtggatcacgaggtcaggagatcgagaccagcctggccaacgtggtgaaaccccatctctactaaaaatgctaaaaaaattagccaggcgtggcggtccacgcctgtaatcccagctacttgggaggctgaggcagaagaatcgcttgaacctgggaggcagaggttgcagtgagctgagatcacgccactgcactccagcctggcgacagagcgagactctgtctcaaaatcgaaaaaaagaaacttgatacatctcttactttatatccagaaaggtccagtctatagggaagacacatttctactttaacactctattatctgctacctacatttagccagagaatatctaagctgccatttgccacttttctttttggtttgcaattataggtaaatagtgtgtcttcttgttttgttttgtttttttcaatattacttcaaagttggtaaaaattaaatttttgtcagggactatgccagtaaaaattgaaggattgccactgtttgtccaacttttattaatctccccaagccagctatttttccactccaactattttattccagtagatatttaactagattctagttacttagcctggaaatctgagttgtgtttaattttttccttttttaaaaatctcttacatgtaagttatgaatcttgtcaatttattgtttatcttttgagatagggtctccacccaggctggagtgctgtggcgcaatcagagctcactgcagcctggaattcctggactcaagcaatcctcccacctcagcctcctgagtagctgggactacagatgtatgtcaccatgcctggctaattttctttaaattttttatagagatggggtctcactacgttgcccaggctggtcttgaactcctgggctcaagtgatttccccccccccacctcagcctcccaaagtgctgggattacaggtgcgagccaccatacccagctcaacaccacttattaaagagactatcctttcctcattgtgttttttgtttgtttgtttgttttgttttgtttttaaatcttagagacaaggtctgcttatgttgcccaggctggattttattgtttttttttaatatcttgttcacctagccttaaacagtcacactttatgtcctcatcacttaatgcctagacaaccactgtctctaaacttacaggattttccatttttttcattcttgtataattcagtctattatattgccatgaaattaatctttttgaaaataatgatttaaattaacagttgggggaaaaagtccaaactccttagcctggtagtcagggtcctccatattctggcctcacttctgtttcttcagcctgtcttccacaatttccctctgtttcagtctggtttatctattccttctcaaatatatcacagttttgttttttggtttttatttttgttttttttctttttcttctctctctctctctttttttttttgagacagagtcttaactctgtcgcccaggctggagtacagtggcacaatcttggctcattacaacctccgcctcctgggttcaagcaattctcgttcctcagcctgccgacttagctgggattacaggtgtgtgccgccacgcccagctaatttttgtaattttaggagatggggtttcaccatgttggccaggctggtctcaaactcctggcctcaagcaatccacccgcctcagcctcccaaagtgctgggattacaggcgtgagccaccatgcctggcctaatatatcacagttttgaagctaatctgattctctactcactgggattcccaacataatttttcctccatgactgctttgcagtgccttctggtcaattctgtttatttttatttttctgcttatgtctacatgccaatgatttaaggataggataccttgtttttgacattctgtgacagggtgcttgtgaatttttttcccattagtcacttggggtttttgtattgaaatataactcacctataataaaattcatcctcttaaagcgtacaattcagtggtttctggtatattcacaaggtagtacaaccatcagtactaattccagaatgttttcatccctccaaaaagaaacccatatctattagtagttacctcccattctctccctccagcccctggcaaccactaatctactttatgtatctatgatttccctccatttcatataaatgtaatcatacaatatgtggtcttttctgactggcttcttttacctagcacaatgttttcaaggtccatccatgttgtaacatataacatatatcattacctcattccttttgcatttttaaaaattgtaaaaatacacgtaacataaaatttaccatcttaaccattttaagtgtacagttcagtagcattaaggtatattcacactgttgtgcaacaatcttgggaactttttcatcttgaaaaactgaaactctttacccattaaacaactccttatttcccttcctccagcccctggcaaccaccattataccttgtgtctgtatgagtttcactactgtaggtaccacatataggtggaaacatacagtgtctgtctggcttatttcatttagcataatatcttcaaggtgtatccatgtcgtagcatgtgtcagaattttcatctttttttttttttttttttttttttgagatggagtctcactttgttgcccaggctggaatgcagtggcgcgatctcagctcactgcaacctccgcttcctgggttcaagcaattctccagcctcagcctcccaagtagctgggattacaggtacccaccaccacagctggctaatttttttgtacttttggtaaagatggggtttcactgtgttggccaggctagtttcaaactcctgacctgaagtgacatgcctgcctcagcctcccaaaatgctaggaattacaggcatgagccactgcccccagcctcatttttaagactaatattccagtatatgtatataccacattttgtgtatccattcatctgtcaaggggtattcgagttgcttccactcttggctattgtgaacaatattgttatgaacacagatgtgcacatattcgagtccttgttctcactgcttttggatatataccgagaaatggaatttctggagtcatttggtaattctatttttattttattatttatttattttgagacagagtctctgtcacacaggctggagtgcagtggcatgatcttggctcactgcaacctccacctcccaggtgcaagcaattctcctgcctcagcctcccaagtatctgggattacagacacctgccaccacaccctgctaattttttatgtttgtggtagagacggagtttcaccatgttggccaggctggtctcaaactcctgacctcaagtgatgcgcccacctcggcctctcaaagtgctgaggttacaggtgtgagccactgtgccccgccggtagttcttttttgttttgttttgtttttttgagatggaatttcgccctcattgcccaggctggagtaagtacaatggcgcgatcttccctcattgcaacctccacctcctgggttcaagcaattctcctgcctcagcctcctgagtagctgggattacaggtgcccaccaccacacccagctaatttttgtatttttagtagagatggggttttaccatgttagtcaggctggcccaataattctatttttaatgttttatggaactgccatactgttttccatgcagctgcatcattttacattcccaccaatacatgagtgttccagtttctccacatctttgccaacacttgttattttctgctttttgatagtagtcctcctaataggcgtgagatgatacctcattgtggttttgatttgcatttccctaatgactagtaatgtggaacatatttccatatgcttgttagccatttgtatattatctttgaagaaatgtctattcaagtcttttgaccattttttaaattgggttatttggttttttgttgttgagttataggagttctttatatattctcgatattaccccttatcagataatataatttgcaaatatttctcccattccatgggttgccttttcactctgttgattgtgtcttttgatgcatagaagtttctaattttgacgtagtccaatttatctattttttactttttttaaataagagatatactttatatttttgttttattgtggtaagaacacttaacatgagatctaccctctgtatttttacttttgttgcctgtgcttttggtgtcctggtgtatttttttttaagtgttaacagatttttccccagctttattgagctataattgacaaataaaataatatatatttaaattttactatgtaataattgttttttcttttttctttttcttttttttttttttttttaccaggctcgagtgcagtggcacaatctcagcttactgcaacctccgcctcccaggttcaagtgattctcctgcctcagtctcccaagtagctgggattacaggcgtgcactatcacgcctggctaatttttgtatttttatttatttttatttttatgtatttatttttttgagacggagtcttactctgtcgcccaggctggagtgcagtggcatgatctcggctcactgcaatctctgcctcctgggttcaagtgattctcatgcctcagcctccagagtagctgggattgcaggcacgtgccaccacgcccagctaatttttgtatttttagtagagacagtgtttcaccatgttggccaggcaggtctcaaacttctgacctcaggtgatcctctcatctcggcctcccaaaatgctgggattataggcataagccacggtgcccagcccaacgtgataattttatatatgtatacattatgaaatgtatacattatgaaatgtatacatattgtatacatatatacattatgaaatgtatacataatgtatacatatatacattatgaaatatatacaatcaagttaacacattcatcacctcacataacacatcacctcaaatagttacacttttaaaaaataacagctttattgagatataattcacatgcctgaaatagtcacccttttaaagtatacagttcagtgaattttagtatattcataggcttatgagcctatcaccacaatctaaatttagaacatgttcatcacccctaagagaaaccccacccattagttgtcactcctcattcttctcaccacttctaccccaaactccaggcagctactactctacgttctgtctctatagatttgcctattttggagatttctaacattttaaaatgaaaaatagtttgtagggtctttttcacattaaaatatcacattttataagttgaatttatatgaatattttactttcatgccgtgttgtttcactatgttatcagtgtgaatttgtggctccttttgtagtatgttgattatggttgtgccagtgtgctttatgcctttgggagaccctcttcagatgactgccatcaaaagagtcatagaaagcaatgggttgattcccttatatccacttttgacattttctttgttatagcaagtgtggtattttttttctaaacaggtcaggaatatcccgctatagtagaatttgcaccttttcaaaaagctgcaaaaaagaagactaagaaaagagataccaaagtcgggactatcgatgatggtacagtatagctctaattatataatgctattgctgtggggtttttaaaaataatatctttgtgagagttaattcgaccccaaaattttaaattagaaaatatacaaaataaagtaagtgagaaatgttatttgccgatggaagctttgcttaattgttagactagagagagtttcttgcacagaatctctgctctctttggctagggcatttcattcttcaaccattgaacaatataatgttgactattgagtaacaaatcaccataggtttattgattagaagatagtggaaaggccaggcgtggtggctcacgcctataatcccagtactttgggaggccaaggcgggcggatcatctgaggtcaggagtttgataccagcctgaccaacatggagaaaccctgtctctactaaaaatataaaattagccgggtatggtggtgcatgcctgtaatcccagctattcgggaggctgaggcaggagaatctcttgaacccaggaggcggaggttgcagtgagctgagatcacaccattgcactccagcctgggcaacaagagcgaaactccatctcaaaaaaaaaagaaaaagaaaatagtggaaaaaaatcaggtttcaaagtttaacaggtgcttcttgaggcctcaccatttttatgattatttatttgacttttggtttccattatatttataaagaagaaggtttgaactgtcatgggaaaatttccatacccaggtaactttgtataaagtagctgaagttgtcactcctattttctggtctttggatatacaattagctacacacatagtattaggttgaacaggaatagaagaactgaggccaggcgcggtggctcactcctataatcccagcactttgggaggccaaggcgggcagagttgctgaggtcaggagttcgagaccagcctggccaacatggtgacaccccatctctactaaaaacacaaaaattagctaggcatggtggcgggcacctgtaatcccagctgcttgggaagctgaggcagaagaatcacttgaacccgggaggcggaggttgcagtgagctgagaccgcaccattgcactccagcctggacaacaaaagcaaaactccgtctcaaaaaaaaagaaagaaagaaagaaatacaagaactgaaaaaccaaaataattgccatttaaggtacactggctccagattttgagacctctgtaatgttatgttagatagctgttacacaactctttatgttggataaggactaggaccatattttatatcagattgttactttagaatcatctagtttaatttccatcatttgttactattacaggtattttataaagaaaacacggtaaggactcaataacacatagctgtgatactggttttattacagatttagatctggaagacttgatcaagtgacacatagaaacaagcaatataatggcttagatgtgtcaccctttctgatgttagaggtctaggagagaactccaggaattcccatcacctcaagtgccacatctaggacttctctctaatttatctttttggaacacctaacttagtttagtaggacagtgacttttaaaagcaaactatgtaatacccctagtggttctgttataatgcatggcgtctcatttttcctgaccccatgttataccagattcctatagtgagtatcagtgataggagtcctgagagcaagtgaccaattaagctctaaatagtctaccttgtgggtatggtttggttttttttaatcttccacgaagtaaaaaattatcttctttgataaatcagtattgtagataatgtcttctttttttgtttaaagtctattatattttctgtttcctcaaatgattatttagatccagaatatagaaagtttttggaaagttatgccacagataatgagaaaatgacatctactccagagacactgctagaggaaatagaagcaaaaaatagagaattaataggtaagtgggcaaaaagaatcagggcaacagtcttttcatcacagtacctaagtctcctacctccatcagttgctagctgtgtgacttcagggaagttactagtttctctgagactgttactgtaaattgcagatggtaatacctgcctcacagcattatgagaatccattaaagtgggaaaaattctttgacctatttagtttcacacaaatgtaatataaatacaaaaagttcgatgactgataaggaatgtttagacagtggtaagcctttgaaggtcaattggtattttctagtaataagttcatattcctaaaaaaattttgacttgaaaatacgaaaaaatgaaattagttactgcaaaattgaaaactacttgaggaattctagcttggatcttggttctcagtaataggctgtcactactgtatcagtagctctaaacatgagcataatctttgacccaggatttctactcaggaatttatcctaaggaatatgtggggtttttttgtttgtttgtttgttttttttgcttgcttgctcgctcgctctctctctgtgtgtgtgtgtgtgtgtgtgtgtatgtgtgtgtgtgtgtgtgtgtgtgagagatggagtcttgctctgtcgcccaggctggagtgcagtgtcgcaatctcggctcactgcaacttccgcctcctgggttcaggcgattctgccgcagtctcccgagtagctggaagtacaggtgtccgccaccacgcccggccaattttgtatttttagtagagccggggtttcaccatgttggccaggctgatctcgaactcctgacctcaagtgatccgcctgccttggcctctgaaagtgctgggattacaggcatgagccactgtgcccggccaggaatatgtgttttaagatggctgtaaggccaatagcttattcagaatgttgaaaatgaaaaatattcttccaaaacttgacttttattaatagatggatagtacaagcctatttctggtaactttcttagaataaattcccagaagtggaattatggggtcaaaaggattagatatttttagccccttccccccaacttcttccagttgaacaagtttacactcctatcagtaaaacaagagaatgtcctaagtacttaattctcatcagttgggaatgactcttttaataaattattttgttgttttaatttgaatttctttactttttaaaaggtattttaatcccgtattgttgaaatcgaatgctgtaaaacttctttctgatattacaattgtgatctttctgcataaggggtgtacatgttttcccaccttgggtggttggcagggaatgtcagaaaatggaatcgtttctaggggttgataagtatgattaataatctgtttacatttatgtagctaaaaagacaaccccacttttgagcttcctgaaaaacaagcaggtaaatcttttgtctttatagttctctcaatactttaatttctttgctttgcattctataaacattttaagagcattgggtttctagaggagaaatagctgctttttccaccattactctttaaggatttgccttcttggtctcactctctagcctgctccttcactctggttgttggaccaggagttcactctacaaacgtggaatgttcttaggttgtcccagagacactcatttgatattctgaaagcctctggagagatagtaaggcagcagtggaagaataatattagcaggttctggtcttcattgtctttcgttttctgggtggagtggggataacggtggtagaatgccactttgtagaaagtaggaaggaaagattattcagttggggcctaccatgacttcaggatttattagggttttggtgatgattattttatttgaaggcttgtgttgatgtttctttctagagaatgagagaagaaaagagagaagaaaggaggaggagagaaatagaaagaaaaagacaaagagaagaagagaggaggaaatggaaagaagaagagaaacgaaaaaggaaagatatagaaaagctaaagaagatagacagaattccagaaagggacaaattaaaggatgaaccaaagattaaggtataagaatgttgaaactgactgcatgttgctaaaaattgcacgtatctacttctttaaatatgcatgcgtcttgtgttggtgtaaatgaattttttgttttgtttttgttctcttttggggggaagtgatccaataaaaatctttcctgtaatagtattagtttttaaatttaagatcatttaaaaggataaagtagtatgttatttcttcagtgcagatctgtgctgtttttgtcattgaaaatgttggatttttagactattgtcctctaaattcatagtaaatgagggcttagggctggctggcatgatttatggttttttttcagctttttcttcataattgatacatgaagttacctcatctgtttgttttccactgtcttcaggtacacaggtttctgttacaagctgtgaatcagaaaaatgtaaggaccaagtacatgatacagagcatctagtatcatgtcacacacacaggtcttagctaataagtccttttggtggtggtggtggtagtgttacttgttgaaaaccccttcaggttgacttgagtcttcttaaaagctgagctattttattataaatttctactttaaaaggaagcccaggtgacttcctgatgctctgctgtgtgcccagaagcttcattgacctacagccagaggacaaccatgcctatatagttctttctcatcttcttatatgcttctcataactggctgccttgtgggaggactagggataaataccctgcaatatgtgcctttccctctcacatgactcccgtagtatcttcctgcatatatctgggaatctgtgagcagcagattcggattcatgcattgcatttgggaagaagaaaacctgcagaaagatcccaaccttgccacttcccttctaagggcatggcttgggcagcccttgtttcaacatatttcctggggaagtactagtacctagcacttcagataaagtcaaagaaaatctcacagagagggtggcagggtctccttattttatttcctgaaaactcagcagtttatgtagcaagggttccctaagtctctacggggctcattactggtgatgaggggcttgggggaggatggagtttctcatcttaattctttccagcaatctctctgtctgctatgccacaagtgacttgacttgctattcctaacaatcagcaaggcagaaggtagagccagccatgctagagacattcattaatgttcttattagagtaatgaacaccttggtttctaataaggatgttcattggagaaataagagcacttccaatgaaacctgcacatggtatcctcattttacactggtgccttctcagtgtccattttggactcaccatttgcagtggctgtctgtgtgccaaaatgctttgtgcttatgtcttgtggtgctttgccttttgcttagtaatttacatgatgccttcaccctgagatgaaccttgtgtgataccttcactctgagacttgaaattcttctattttgcctaagaatctctctgattatccgacacttggaggtattctcgagagattcatagcagcaatgtaaaaaacaatggcatttttgaacatgcgtaaatatggcattaaatacagagttcctactcagtagagatggaacttcactatttggttgtataaggcctttagatttttaaatcaaatgccaaataattcttgttattaatctctaatggcaagataattgtaccatcataagtatgttattctcaggctcaaggcaaaattattcctgcaatggatctctcctttggtgaccaaggtatttgtcattccaagtactacataaaaacagtcccaacagaaacgatctgcctatcacttaaaatttgtgggctgtttcccattaagttatatcaacatgctggtttgctacagaagcatactttgaagtatgcattggttcacttaaaggttgacccatttaaagccaaaggaagccgggcacagtggctcacacctgtaatctcagcactgtgggaggccgaggcagaaggatggtgtgagcccagaagtttgagaacagcctgggtgacatgatgagaccttgtctctacaaaaaaattaaaaaattagccatatgtggtggtgtgcatctgttgtcctagctactcaagaggctgaggcaggaggaccacttaagcccaggaggtcaaggttgcggtgagccatgttcatgccactgcactccagcacgggcaacagagtagtgagaccctgcctcagaataaaagccaaaggagtcttgatcctattgccacaaagtgattaaaccacttcgttcaagtggataacactttaacattaatagcatccttttagtaaattactactcttatgcactagttgttcacctgaaagattaagtgtacctgcagagatagggggctttgtctagtctaaattttaaatatttggtatactgggtttttaatagaagatagtgtcccagccttcaaaataaaaataaacattttatctttaaagctgctcaagaagccagaaaaaggagatgaaaaagaattggacaaaagagaaaaagccaagaaattggacaaagagaatctcagtgatgaaagagccagtgggcaaagttgtacattgcccaagcgttctgatagcgaacttaaagatgaaaaaccaaagaggtcagtagtcaaggactctttgttatgtttgatttatacatgctagttttgctgctatgtcctggacatgtacctgaattaagataagctgttttatgcagggcagggggatgaggaggaacagtttcagaatattcttgtatcttaatctgggtgaatggttttggggttttgttccttcttaaaacactagtatttttcactctgctctaaaagtgcaacctcattgcaggggccaaatcagaatcacagtgttcctgcatttgtgattacaagatctttcagggttctgtctcagatttgtttttcatgcagacctgaagatgagagcggcagagactatagggagagggaacgggaatatgaacgagatcaggagcgcatacttcgagaaagagagaggctgaagcggcaagaagaagagcgccgtaggcagaaggagcgctatgagaaagagaagacttttaagagaaaagaagaagaaatgaaaaaagagaaagacacacttcgggataaaggaaagaaggctgaaagtacagaatcaataggcagctcagaaaaaactgaaaagaaagaagaagtggtcaagagagatcgaataagaaacaaggtgctgcttgtcattaaacttgtttatgagggtttttttcccttttcctgcaagtgtaaagaaagtgtaaagggcactgttattatagaatttttaaaggggaactttaatcatctgcaactttttttttttttttttttgagacagagtctgactatgttgcccaggctggagtgcagtggcacaatctcggctcactgcaagctccgcctcctgggttcacgccattcttctgcttcagcctcccaagtagctgggactacaggcgcccaccaccacgcctgacttatttttttgtatttttagtagagacagggtttcaccgtgttagccaggatggtcttgatctcctgacctcgtgatccacctgcctcagcctcccaaagtgctgggattacaggcgtgagccaccacgcctgaccaacttttatttcagtcttggctgggcttttattaacttactatagaaattgtaaacatacacaaaagtagaatagagaatagtatgatgggccaggtgcagtggctcacacctgtaatcctagcactttgggaggctgaggtgggtggattgctagagcctaggagttctagaccagcctggccaacatggtgaaaccccgtctctactaaaaatacaaaaaatcggctggatgtggtggcgcacacctgtaatctcagctactcgggaggctgaggcagaagaatcacttgaacctgggaggtggaggttgaggtgagccgagatcacgccattgtattctagcctgggcaacagagcgagactcagtctcaaaaaaaaaactggccgggcgcggtggctcacgcctgtaatcccagcactttgggaggccaagacgggtggatcacgaggtcaggagatcaagaccatcctggctaacatggtgaaaccccatctctactaaaaatacaaaaaattagccaggcgtggtggcgggcgcctgtagtcccagctactcgggaggctgaggcaggaaaatggcgtgaacctgggaggcggagcttgcagtgagccgagatcgcgtcactgcactccagcacgggcaacagagcgagactctgtctcaaaaaaaaaaaaaaaatcgaatagtatgatgaactccatgtactgtacccatcacccagcagttcatagccaaccttctttctattctacttcatccctacccctactagattattttcaaacaaaccctgcacataatttcttccttaaatacttcagtatatgagataaatactctattaatattaccctagtagcattttcacaccaaaaaaaactaacaataattccttaacgtcctgtctattcagtgttcatatgttcccaattgcttcattaatgtctttttaaaattaattaattatttattttttgcgatggagtctcgctctgtcatctaggctggagtgcagtggcatgatctcagctcaccacaacctccacctcccgggttcaagtgattctcctgcctcagcctcccgaatagctgagactacagcctcaagccaccatgcccggctaatttttgtatttttagtagagacagggtttcaccatgttggccaggctggtctcgaactcctgacctcaggtgatcctcccgcctcagcctcccaaagtgctgggattacaggcatgagccaccgtgcccagcctaatgtcttttttttaataggacctaaacaaattccacaaattatgcttccttgaaatgtcttcttcagttctcttttgtttttagtttattttttgagacagagtcttgctatgtcacccaggctggagtgccgtggtacaatctcagctcactgtagcctcgacctcctgggcttaagccatccccctacctcagcctccagagtagctgggactacaggcatgcatcaccatgcccagctaatttttaagtttttttgtagagatgaggtctccctatgttgctcaggctggtctcaaacttttgagctcagccgatcccctcaaagtattgggaataaaggtatgagccactgcacccagccaagttttcttttaatctaaacaatttccccttctcttgttttcctaccatttgttgcagaaaccaatttgtcttgtagggcttttcctgttctgaattggcagattacatccccatgctgttatttaacgtgttcctctgtcttctgtgcttcctttaaaactggcacttagggcctggcatgatggctcatgcctgtaatcccaacaatttgggaggccaagtcaggaggatcacttaagcccaagagttggaaagcagcctgggcaacatagggagagcttgtttgtactaacaatgtaaaaacagcccagtgtggtagtgcgtgcctataatcccagttactaggtacctgaggtgggaggatcgtttgagtctggaatgtcgaggctgcaataagccttgatcatcccacttgctcttcagcctgggtgacagggtgaggccctatctccaaaaaaaaatttacccaagcatataaaatagtaattaccaaatggttgcttttctttggagatggagagaggaagtaggcaagttgtcatttaccgtgccctcacatttttggtcttaaatgacttcacttgagcatatattcatacataactatgactcttaaaaatcccatataaaagcttagtagcattgttgtaatggtaacatattttattgtacttcaggatcgtccagcgatgcagctttaccaaccaggagctcgaagccgaaatcgactctgtccccctgatgacagcaccaagtctggagattcagcagcagaaaggaagcaggaaagtggtattagccatagaaaagaaggaggagaggagtgataagtccagatggccttaggtgtcctgactgtctaggcagccaaagagcacacgttaagcaatccagaggtgccttcagggcaaagaatagagagaaagggagccgctgtgctggtggggtacactgcagaggagtaagtcttgtgtcaaagcaggaatctgatcagaggttcagaattggaagtacaatttcattgcttttgcaatttctacaaattaattttaaagtgtcagaaaaaggtgacggcaaggacatgcattgcaatttgcagggggaattgtcaagtgaggacttcatcacatatgacacgagagaaaagtaagagctggttctaaaatcaaaagctgttgttcatcctgaattgaattttctgaatttgggtggagcagagtcgctttgaagccttgttccgatctaattctattgtattgttgatgataagtgttgacattgggtagtgtagaagcaacaagcatgtccttgtagtacaggtacagtgaaggatagaacacactttcgttgatacaaaaatttaaatagttatgttacttctgtatccagtgtcctaaagttttaggattagttttagttttttgtttgcttatatgagcttagcgtaaagaatatttttaaacttcgtgttttgtcatcagcatcttttctattaagaggtaaaatgtagtccttgtttgactcttgacaatccagtgtgtttgatcttaggtctcatgatctgagtgcataccctctccaggaaggaaactgcaccagtgtctattcctgttaaatagcaacttttagtctcagcttgtttcgttttgatgtcaataaatagtaacagcattcaagtgtgaagctaagtgtgtttattaactttactaaatagctatgagttttgagaaattaaatttttgacatctgacatcactcaccttctagtgaagcctaagggagctttaactcatggcagaaggtgaagtagaagcaggcatctcacccaaaactgtaaacaaaagtaagagctggttctaaataaaacaaataaaagtctattaatttaaacataaaataggctggatgcagtggctcacgcctgtaatcacagcattttgggaggccaaggtgggcggatcacttgaggtcaggagttcaagaccaccctggccaacatggtgaaaccccatctctactaaaaatacaaaattatctgggcgtggtggtgggcatctgtaatcccagctactcgggaggctgaggcacgagaattgcttgagcctgggaggtggagattgcagtgagtcaagattgtgcctctgcactccagccagggcaacagagcaagaccccatctctaaaataatttttaaaaattagctgggcatagtggtgtgcacctgtagccccagctactcaggaggctgagactggaggatcacttcagtctgggaagtcaaggctacagtgagccatgatcacaccactgcactccagccttggttacaaagtgagaccgtgcctcaaaaaatttaaaaaaataataatttaaaaataaatataaactgttagaaacaataggaaagcaagtgtttgatcaatttctgcctccttttgttcagatacatgtttgatttctttggaaataaaggtagtatggagacaactcagaccttggctgtctaaacaatatttgagcacctcctagtatgtgttggcactgacactatggtagtgaacacaacgtggttgctttctcatgatgcttacagccatggggagttagctgctctggtggagagaagtgatgctaggggaaggaggcaggaaaaattgaaagggtgagggcagtggggggtagctagttccagggaagtgaaaaaggatgacttgggcattcatgaagctttaatgccttcaaaatctggaggaactggaactggaccaccctccacagcatgcatacgttaggtagtccggagacagtaatgaagctttgattataaaattaagatgtaactttctatggtattcacagatgttatctttaattccatagaggaaaggttaaggaggttttgtaaccttttgttggtataaagagtcctgtatgttacatgtttttgatggcagggtggggtcaggctgcctagatttttctttactgtctctgggctgtcctttatactacaaaaatttattaaaccaattatatcattattcaaggtagccaagattacacttggtaaattcttggaaagtgtatgctgacagctatatacataggattagtcatccttagaaatctcacaaaaggccaggcatggtggctcatgcctgtaatcccagcacttaggaaagccacggaagccacggtgggtggatcacatggggtcaggagtttaagaccagcctggccaacatggcaaaaacccgtctctactaaaaatacaaaaattatccgagtgtggtggtgggcacctgtaatcccagctactctggaggctgaggcaggagaattgcttgaacctgggaggcagagattgcagtgagccaagatcatgccactgcaatccagcctgggcaacagagtgagactccgtctcaaaaaaaggaatgaaatgggccaggtgtgatggctcatacaggtaatcctagcatttagaaggccaaggcaagaggatcacttaacttcaggaatttaagaccagcctgggcaacatagggagaccccatctctactaaaaatttaaaaacttagcccagtgtgggagagtgtgcctgcaatcccagctgctagggagctgagatgggaggatcgcctgtatctggaatgtcaaggctgcagtgagccgcaa

SEQ ID NO: 13645 - DNA, 7007 bp, Human
gctacacgggaggcagcctcattatgcagctctcacctcttaaattagttcatgctctcacattaggtgtaatcacagcttgcaacgctttctggggatgtctcagaaagatctgagttgaaaaaatatttttgtgtcattttaatttaaagtaaaattgctgcttcttccccgcccctttctttcctcctggcccacccagcgaccctggccggccgtgctcaacgggggcgggggtcggaggtgagatttcctccacataattccttaaacagctatcaactaagtctcaaagaaaaaaaaaagagatctagaagcagagacgtggctgctggcgatcccaaagctggtgttcgctcttgggggagagcgtaccctgggggaggccgggaggccgggccagaggctagcccagaggcagagggcaggagcgctcagccggcgccccgcgtctctccagctcccgacgctgcgctggctccgctgagcacgccaggatcaaggtcgcctggtggggaccggagcgccaggagcctgtgggaagcgttccagccggcctctgactgggatccggcgccgcgtttctgctttggacttgactgacaggtccccccgccctcccgccgccctactaccagcctgggttcatccttcagggctacgtctaccgcacccgggctggaaagcctggagcgcgcccttcctctcctcatcttctcagctctcctttctccctgccacttggcaaagctgcattttgactttcacgttttggactacgtgtgtgtagttccaagtccatgcgtggcacgaaaatccacttagggtaaaaattattctcgaaaaatcgcccatctcaggatctggtgtctacactcaaggctaggaggtgcaggtacgggtgcgtaaagcatgccgtaagggtgcacagtaaataaaaagtacggatgcaaaatgtaaattttaagtgcaaaacagaaaagcagtactcgttgccgccccgcacgctgggttttaaggggcacgaaggtgggcctcggctgcttttgctcagccccgcgtcctcagcgcccggcccagtacccggtactccgtaggggttcaatgatctcccctgaataagtgaacgaattaacaaatgaatgaatgaccgctcgatccgacctccgcggccggcagagcagtcgctggagaggcgggagagagcgagaggccaagctccaccatcgcggccgccggctggggcagagggacacggagacactcggcgccccggctccgcaccgagtccccgcggtgagtgcccgcccagcagctcccgggcaccacgtgcgcccgccagagccgcgcaggccccgccccgccgcgcgcgcacgcgccctgcaccccggccgccgggaccctgagccaggctcgcccagcgcgccggctgccctcgcgcccgcgcccgctggggggcgctcccctcccaacgggcgcgcccacaggcgggcaggcgactcgcagcctccagcgattccactcccgaccccggggcgcgccgcctcctacctgagggccgacgagtgggggcgggcaggagggccgagggaggcggaacaggatcgaggcgcgaggcgggagtcgagaaagcgagcggccgaggcgactctcagtgcgcggacgcgggcgcgcgcccgcgctcccttcgtcgactcacggcgagagcccaaccctgctgccgcgcgccacccgcctcgccgcgcctaataacaacggcgcccggggtcaggtggccgagcgcggacagcgccgccattggctcggtggggagcgcggcgcgtcaggattggctggggggcgtggtctcggccggggcgggggcagggcctcggagggaggcgggccgggaggcggcgggggcggggccaggccgaggtccgcgcctttgtgcccggcgcgcgctctccgcccgctccggctgcagcgccggctgcatcaataattcagagcggcggcggcggcggcagcggcgggtgcgggcaggaggcggcggcagcagcgggaccgagcagcagcggctatgcatccaagtgcggctgggcagccgcggcacccctgaggcccgggaggggctccgggaacacagcgcggaggggacgctagtcgcggaggggacgctagtcccggagtgcgaggaaaaggtgtagtgtccagagcggcggcggcggagctgcgcacggagctgaggagggggcttcggagcgggactgggacggggggggcggctggcgcgagcagccctgggggtggggggcggggtgggcgccggcggcgcgatgctgggcgtcctggagctgctgctgctgggggctgcgtggctggcgggcccggcccgcgggcagaatgagacggagcccatcgtgctggagggcaagtgcctggtggtgtgcgactccaaccccacgtccgaccccacgggcactgccctgggcatctctgtgcgctctggcagcgccaaggtggctttctctgccatcaggagcaccaaccacgagccgtccgagatgagtaatcgcaccatgatcatctacttcgaccaggtgagtgttccttcctcccgcggcgtgcagattgggctggtgaaggagggatggatggaagaccgatgcccggtcctctccaagggctctgcggaggcgcggggacgacagtccgggaccgattcctgcccactccccttcgttcccgtctcgttataggtactagtgaacattgggaacaactttgattcagaacgcagcactttcatcgccccgcgcaaagggatctacagttttaacttccacgtggtaaaagtctacaacagacaaaccatacaggtcagccgacgcctcgtgccgggccctggccccgtaggggggttactggcctcaggggtgctcgggctgtccggaggtggtaggcagaagtggcggctgcatgtacttcgggctgcttggagggacagatagcggggcctctcagttctgtggcttcaactgtcctctgctttccctgtctctggctcttgggatccagccccatcccccgagagacagaattttctgcttctgccttccgggcctctccgaagggttccctggatttcagggacttccttgtaacggctgttgttagcgccccagacagctgccgcttgggaagccttcccggactccccaggaagcaccgcgacagtacaccctaccccttgccccggctcagaagcctgcgatgcggcttgcgtgcttgtcttcagcaccacggacggggcccccgttttctcccacttgtccccaatccccaccccatgcggactgtgggtttttgagctagcagcatttagccccggagggtgaggggtagagagaggagggagggagggggcgtagtgctactctctcccggctccagccgtgtcccagcaatcactcgccggctctccgggtccccaaagatgtccaggtttcccttgggcgccgagagaggtgggacgcacagctggggagagggcgcgaggcccttggctgacggtgccaccacaggggcaaaaccaggcggtggcgggcgcggctggatgggggagggaattgagcccgtggtttggggaggaaatacattgtgccgctcggtgcgagacttctaatcacaaatcacagtggcttctccactgtgtcctggcagctgggtccaggagggatcaggggctttttgtttgttcgtttttgtttttccggtagcgccagaaggagcctgagttgctgggttttttttgtttgttgtttgttttttgaggctgaggggaaacgggagagaggtcaaaggtctcagggcgctagagccacctcatgggtttattaaattggatcacagagcacagtcgagattcgcttggcgcgctcatttgagaaactggaataagagcaactcccgttttggggacaggcccttcctgtcacccagatgtgtggtctttcgccccactggagcctcagcagtaagctgcaaagccccttttcctccattcgccccccccaccccccacctctccgtgcttccaggccttacaggctgttagccaagcaaggaggaggttcgctccaccgcggcttcggtgcctgcctaggttgcgcctctgaagcgggcctttctctttctcaggtgagcctcatgctaaacgggtggccggtgatttcagccttcgctggtgaccaggacgtgacccgggaggccgccagcaacggagtcctaatccaaatggagaaaggcgaccgagcatacctcaagctggagcggggaaacttgatggggggctggaagtactcgaccttctccggattcctggtgtttcctctctgactggctcgtagccggaagggaggcagggagagggcgaaggcaggaaggggagtgagaaagaggctgaaattaagagggcgagaaagcagcacgacttgaaacttcctacatgttctctaactgtatctgggtaaaaaggtgcgcgccagctgtgggacaactttgtccatttccttattaggagaaataaatttcgcttagctctgcgcactcccatttccaaaaataaactcgcctcccccattccagttgcagtaatcaagaaagagactgccttgtcattgtttcttatcccccaacttcatgttccctgcaatttatttaaagaaactttgtatttcactacataatctgaaatctttctccctagccccctctgaatccttctgcctactgaaatctgatatattacacacccccaaccttttttttttcagtttggaaaggggtaaagttttgttgttgttgttgttttgttttggatggggaaggtagttttaatttggcaagtgttgctcttcttaaaacactgctcaaattaattagctgaagatacttagtatcctcggctgcttgttagcagagaaaggactcaccttagtggtgactggtttaaaaaatataaatatatatcatttgtatacgaagaactcttcccagtggaaactggctgtgtttccgtatttctatgttctattcggagtgatcgtgaaatctaaggctgcttgatgttctgatgcttgtcaatgccgtcgtgctctgtgactccacgaaacgccaaggagcttcttccggacgcctcctcttcctctgtaacatacgtgtgaatagtcaaggtttaattttgctttaatctaataaagtcgaagtgggacttttatttttctgaaacagctttctaaaatccgcatcttccccagctgcgaggttgggggtctggggtgccaaagggcgaggttccgaaaggcaggagacttgggggaacgcaaccatagaaaggcctgggcgcgagggcttccttgcaaagccggccttgcgctccttcctgcgccaggccggggaccagcactgcattcgcctgtgttcacagctttggcggaaacgtaagaaatgtggccgaaatcttgctaggccaggcgcggccgccggcccaggagcgaagtttgatttttttctttgcattccaaatgcatcaggaatagtcccagtttgaggacccaaacgaccctgcctggagcggcagactcctcaggccttctgtccccggatgtctcccaccgcgtccccctcgcagttcccgaagcagcgtatgttttatacaccgcctctgaatccggagtccacccgccgcatactcgggcgcccaggacctatgattccgctcattcacaggactttattcaagaggttcgtccaggagttttgattgtatcggaacataatgtgaaagcaaaaatgaaataaacgacttcgttttaagtctgaaaggctgacccagttgcttcggcagcggggaggtcgggagccggagcgagtgggcagcctagggcgaagggccgggagctgggagctgcagccgggtggtcccctgcagttgtggttcctttcagagaaacgttttcctggcccaatattcaggaatgaattttatttcctctaggggcgtggggagaagggaaagttaataatagcacaataaacaacgtttctcggatttatcccagcggctggttcgagttagaaattcacggagcacggggcctctgttgaaacccgggcccgtttcttctccgcatgcaatccggtaagccgtggagcagctctagcgggcgcccttgcagccctgtgcctccgggacccacagagatagatagggacttcgcgagtgaggagtggacccgagtacttttctgtttctgcccaacagtttcccttctactctgttaggccccagggaagtgtgaatgagaagaaataaggggccttaaagggatttaaagaaaaactgcttttaataaagagacgcgctttctccgaagtctcctggttgggaaggagaggtcggagacagttggagcctttggcagcgaaactagctccacccagcagctctgccgttgcagggccagccctccgggcttgtggagaccctatagtcagtagggtgcgtgtaagcttgaggctgtagggccgcgaaggttggagagccaccgctcaaggaagctgcccctgtacgctttggcgctccctgggctgcaggtgggtgggtcacctctcttcctgagggcaagaaccaccagggttctggtctccgtggctgcctgttctgtggggccaccaggctgtgtcccggtggagtgactttggcaagtccgctatcaggtcctaaatttgcccatttatataaagacagggagaaatctaaacacctctcagagttcctcctgctctgtggatccagccctcctctgctcccagaccgggagtctgcagattctttttcctgggtgagtgagtcctggctgcagcctgtgcttacctggctgccaagtggcagctcctgagtgctaagcctcgggctagggtgcaggccaggggaagcctgtgcatcctggaactgggactca

SEQ ID NO: 13646 - DNA, 23640 bp, Human
  misc_feature (1)...(23640): n = A,T,C or G
attacaggcacgcaacaccatgcccagctaagttttgtatttttagtagagatgaggtttaactccaaaataattctttttcctgatcttttgcatgtgatttactatttgatttttctctttctctttgtttgtaaaacataattattctctccagtgtttttaaatatgtgtaaagctgtattaatatttttatctccttttctgggcacttggggcacactttcgatcagtatcacgttcttcagttctgggaaattttcttgcattattattattgctatgtatgtattttttgagacaaaatcttactctgtcacccaggctggagttcaatggcatgaacatggctcactgcaaccttgagacctcctgggctcaagcgattgtcccatctcagcctgccaagtagctgggactaaaggtgcatgccaccatgcctggctaatttaaaaaaattttttttttttttagagacaaggtcttgctatgttgcccaagctggtcttgaactcccggtctcaggcgacccacctgcctcagcctcccagcctcctgggattatgggcaggagtcactacacccagccagagtcccggtctctaaaagaaaataggccaggcatggtggctcacgcctgtaatcccagcactttgggaggctgaggcgggtggatcacctgtggttgggagttcgagaccagcctgaccaacatggagaaactccgtctctactaaaaatacaaaactagccggacgtggtggcgcatgcctgtaatcccagctactcgggaggctgaggcaggagaattgctcgaaccccggaggcagaggtttggtggctcacacctgtaatcccagcactttgcgaggctgaggcaggtgcatcgctttggctcaggagttcaagaccagcctgggcaacacagggagacccccatctctacaaaaaacaaaaacaaatataaaggggataaaaaaaaaaaaaagacaagacatgaatccatgaggacagagtgtggaagaggaagcagcagcctcaaagttctggaagctggaagaacagataaacaggtgtgaaataactgcctggaaagcaacttctttttttttttttttttttttgaggtggagtctcactctgtcgtccaggctggagtgcagtggtgcgatctcggatcactgcaacctccgcctcccaggctcaagcaattctcctgcctcagcctcccgagtagctgggattataagtgcgcgctgccacacctggatgatttttgtatttttagtagagatgggatttcaccatgttggtcaggctggtctcaaactcccaacctcgtgatccacccaccttggcctcccaaagtgctgggattacaggtataagccaccgagcccagccaaaagcgacttctaagcctgcaagggaatcgggaattggtggcaccaggtccttctgacagggtttaagaaattagccagcctgaggctgggcacggtggctcacacctgtaatcccagcactttgggaggctaaggcaggtggatcacctgagggcaggagttcaagaccagcctgaccaacatggagaaaccccatccctaccaaaaataaaaaattagccaggtgtggtggtgctcgcctgtaatcccagctacttgggaggctgaggtgggaggattgcttgaacacaggaagtagaggctgcagtgagctatgattgcagcactgcactgaagccggggcaacagaacaagatccaaaaaaaagggaggggtgaggggcagagccaggatttgtttccaggctgttgttacctaggtccgactcctggctcccagagcagcctgtcctgcctgcctggaactctgagcaggctggagtcatggagtcgattcccagaatcccagagtcagggaggctgggggcaggggcaggtcactggacaaacagatcaaaggtgagaccagcgtagggctgcagaccaggccaggccagctggacgggcacaccatgaggtaggtgggcgcccacagcctccctgcagggtgtggggtgggagcacaggcctgggccctcaccgcccctgccctgcccataggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaaggtgccgtcaggacgggagggctggggtttctcagggtcggggggtccccaaggagtagccagggttcagggacacctgggagcaggggccaggcttggccaggagggagatcaggcctgggtcttgccttcactccctgtgacacctgaccccacagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgagggtgagccaagaggggtcctgcaacatctcagtctgcgcagctggctgtgggggtaactctgtcttaggccaggcagccctgccttcagtttccccacctttcccagggcaggggagaggcctctggcctgacatcatccacaatgcaaagaccaaaacagccgtgacctccattcacatgggctgagtgccaactctgagccagggatctgaggacagcatcgcctcaagtgacgcagggactggccgggcgcggcagctcacgcctgtaattccagcactttgggaggccgaggctggctgatcatttgaggtcaggagttcaaggccagccagggcaacacggtgaaactctatctccactaaaactacaaaaattagctgggcgtggtggtgcgcacctggaatcccagctactagggaggctgaggcaggagaattgcttgaacctgcgaggtggaggctgcagtgaacagagattgcaccactacactccagcctgggcgacagagctagactccgtctcaaaaaacaaaaaacaaaaacgacgcaggggccgagggccccatttacagctgacaaagtggggccctgccagcgggagcgctgccaggatgtttgatttcagatcccagtccctgcagagaccaactgtgtgacctctggcaagtggctcaatttctctgctccttaggaagctgctgcaagggttcagcgctgtagccccgccccctgggtttgattgactcccctcattagctgggtgacctcgggccggacactgaaactcccactggtttaacagaggtgatgtttgcatctttctcccagcgctgctgggagcttgcagcgaccctaggcctgtaaggtgattggcccggcaccagtcccgcaccctagacaggacgaggcctcctctgaggtccactctgaggtcatggatctcctgggaggagtccaggctggatcccgcctctttccctcctgacggcctgcctggccctgcctctcccccagacattgacgagtgccaggtggccccgggagaggcgcccacctgcgaccaccactgccacaaccacctgggcggtttctactgctcctgccgcgcaggctacgtcctgcaccgtaacaagcgcacctgctcaggtgagggaggctgcctgggccccaacgcaccctctcctgggatacccggggctcctcagggccattgctgctctgcccaggggtgcggagggcctgggccctggacactgggtgcttctaggccctgctgcctccagctccccttctcagccctgcttcccctctcagcagccaggctcatcagtgccaccctgccctagcgactgagactaattctaacatcccactgtgtacctggttccacctgggctctgggaacccctcatgtagccacgggagagtcgggggtatctagccctcgttccttgggacctggttccctggttccctgcactgtgggacgggccagtgctctggggcgtgggcagccccacctgctggcgctgaccctgcctcccccgactcggtttctccctctcggtgtctctccttgcctctctgatctctcttccagagcagagcctctagcctcccctggagctccggcctgcccagcaggtcagaagccagagccagcctgctggcctcagctccgggttgggctgagatggctgtgccccaactcccattcacccaccatggacccaataataaacctggccccaccccacctgctgccgcgtgtctctggggtgggagggtcgggaggcggcggggtgcgctcctctctgcctaccctcctcacagcctcatgaaccccaggtctgtgggagcctcctccatggggccacaggctccttggcctcaccccctgttttgaagatggggcactgaggcccggagaggggtaaggcctcgctcgagtccaggtccccagaggctgagcccagagtaatcttgaaccacccccattcagggtctggcctggaggagcctgacccacagaggagacaccctgggagatattcattgaggggtaatctggtcccccgcaaatccaggggtgattcccactgccccatagggcacagccacgtggaagaaggcaggcaatgttggggctcctcacttcctagaggcctcacaactcaaatgccccccactgcagctgggggtggggtggtggtatgggatggggaccaagccttccttgaaggatagagcccagcccaacaccccgcccgtggcagcagcatcagctgttccagcgaggaaggagagcaccagactcagtcatgatcactgttgccttgaacttccaggagcagcccccagggcaggggtcagacctggggaaagggggtgatgagagacccttcttccggatggttcctccaggaacccagggggctggctggtcttggctgggttcgggtaggagacccctgatgaataaacttgggaatcactggggtggctgtaagggaatttaggggagctccgaaggggcccttaggctcgaggagatgctcctctcttttcccgaattcccagggaccaaggagagtgtcccttcttcctccttcctgtgtgtccatccacccccgccccccgccctggcagagcctggtggaactcagtgctctagcccctaccctggggttgcgactctggctcaggacaccaccacgctccctgggggtgtgagtgagggcctgtgcgctccatcccgagtgctgcctgtttcagctaaagcctcaaagcaagagaaaccccctctctaagcggcccctcagccatcgggtgggtcgtttggtttctgggtaggcctcaggggctggccacctgcagggcccagcccaacccagggatgcagatgtcccagccacatccctgtcccagtttcctgctccccaaggcatccaccctgctgttggtgcgagggctgatagagggcacgccaagtcactcccctgccttccctccttccagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaaggtctggctcctgggcccctcatcttgtcccagatcctccccctcagcccagctgcaccccctacttcctgcagcatggcccccaccacgttcccgtcaccctcggtgacccccacctcttcaggtgctctatggaggtccaaggctggggccttcgagtacaagtgtgggaggcagagtggggaggggcaccccaatccatggcctgggttggcctcattggctgtccctgaaatgctgaggaggtgggttacttccctccggcccaggccagacccaggcagctgctccccagctttcatgagcttctttctcagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacaggtgagcaagtgggtctcagatcttggctggaagcgcagagctgccctctctcctggagtgtcaaggagctgtagagtgtagggctccttctgggccaggactaggaagggacaccaggtttagtggtgtctgaggtctgaggcagcagtcttctaaggggaagcacccgctgtccctccctccagccagccacccagccatccttccaccactcattcttccaaccacccattcacccatccactcatccttttacccacccatccttctgtccactcatccttctgtcccctcatccttccaaccattcatcaatccacccacccatccatccttttgtccacacaaccatccacccattcttctacctacccatcctatccatccatccttctattcagccatccttctaccacccatccttcgtccgttcatccatccatccatccatccatccatccatccatccatccatccaatccatctatccattcactcatccttctaactatccattcttctatcatcagtccattcatccttccagctatccatctattcattcacctatccttctacccacccattcttctattcatccacccatccacccatccttctacccactcatccttctatccacccatccttctacatatccttctatccatccatccatacacccatcgtcctgtctgtccatccatccatccatccttccatccatgtatccatgcatccatccattccttccagctatccatatagccacccacccatccttctacctaccaatcttatccatccacccatccactcatcctgccagccatccatctatccaaccacccattgttctacctacttatccatccatgcacccatccatccattcatccatccacccattcttccacctatccatccacttatacttctacctacccatccttccatccatccatccatccttctatccaaccacccatccacccatccttccacccacccatccttctatcaacccatccttctactcatctacccatccacccatccttctacctacacatacttctatccatccatccatccatccacccattcttccatccatccacccacccacccattcttcacccacgcagtcatctacctaccaatcctacccatccagcaatctacccattaatccatgcttcctgccatctatctatccatccacccattcttctacccatccatccatccatccattcacccatccatccactcacccatacttccagccatccatctatccattcactcatccttctacctacccatcattccatccatccatccatccatccatccatccatccatccaccatccatgcacccacccacccacttattcttctgtctactcatccttctattcatctgtccatccacccatttgtctatctacacatccttctatctatccacccatccacccatccttccagctgtccatctatgcacccacccatccttctacctaccaatccatccatccatccatccatccatccatccactcatccatccatccatccatccatccatctgccaattcttccagacacctatctatccatccatcatccttctacctacccatccttccatttatccatccatccatccttctatccatctactcacccatccatccttccatccactcatccttctatccacccatcctattcatctacccatctacccttccttctaccaacacatgcttccatccatccatccaattcatctacccatctacccttccttctaccaacacatccttccatccatccatgcatccatccatccatgcatccatccttctatccatccacctacccacccatccttccacccacccatccttatattcatctacccatccacatattcatctacccatccacccatccttctgcctacacattcttctatctatccatccatccatccatccatctttccagctatctatctacccacccatccttctacttaccaatcctatccatgcacccattcttctacctacctacccatccatccatccatccatccacccacccattctcccagtcatccatctgtccactcattcttctacctacccatctttctatccatccatccatcctttatccacccacccacccattcttctattaatctacccatccacccagtcttctacctacacatccatccatccatccatccatctttccagctgtccatctatccacccacccattattttacctaccaatcctatccatccatccatatacccatccatccatcctttcagccatccctctttccattcacccattattctacctaccaatcctatccatccatccacccacccatccattcatccatctacccattctttcagccattcacccacccaccctatccatccatccgtttttttttttttttttttagacaaagacttgctctgttgnnnnnnnnnnnnnnnnnnnnggaagccacagttctcacagcctctgctcagtccagtaagggaacagtcacagaaacataaccagagccctgtggcaagcacagcctagagccaagcactgggcaatgtgagagtccaaaggaggacctcaccagacaggggctaggagctaggaagctatccttgaataggaaatgctgagattgaatttaaaggataagtgggtgttggacagagttctaggtggcagaagagttctaggtggcagaagagtatgtgcaaaagcccagaggcttcactcttcagggtgtggagctgtggaagttgaagtgtgggtatgagttggggcaggggaaaaaggagttctgaccatggagtgttgcaccagagccacagcttcagcagtttgcagccaggatctacacactctgcctctcaggaccacccccactggccctggctctgccctctgaggccctgccagaacttccaccacctcttcgtcgtgacagacactcaagtgctagaagccctgggcctccacaggtccaccaaggctgtccctggagattgattcctcaaggggagactttgggacctgcatgggactgagagcttccccaggccacaggctgggtcaggggcacccaggtgcacccagctgccccagcagcttggcagggatcactggatgctagcaggtgctggagggaggagaggactccgaaactgaccagtgggtttttaggggcagctggggagcactgaagccttggggtgagtggaggccagggtttgggggccagagtggaatgcagctcatgaggggaagcctgaggctccccaaatcagcctggatctttagtttcaagtctgtcagccggtttttctccccatgccataacagctgtcctatggggctgctgtgagggttgattacagctccgccaagaactagcctaggtgctttgtatttgatcttcacaacagccctggggcaactattatcgtcaaccgccccccatcttgcagatgaagaaactgagactcagagaggttacacataaccatggggaaatggagagctaggatttaaacacagctccagtcccatgcaagtcccaaagcctcccctgagctcttttcctcggagttacactctctcttggttttgagccatggctctgaagttcctggcatggagcagatgttctatttgtggggactgcaccatcttcccacataacccagctttctcacataccttttgctcagtcccagggaaaacaagaaaccttaatttgcaaaagcacctgagagtttaatcttgcctttggttttaaagaaccctaccccacgtatggtgagctctctttacatgttaagtattctttataaactaagaacttcagatggctcgattcagtcttggctgctgtagaccacatgaaaaccaacaagcctggtttcctctgcgcagcgcagccttgcccttatccgatggcgccacctaatggccacgtttcacctgtgcaagccaaatacatcctgaaagacagcttctccatcttttgcgagactggctatgagcttctgcaagtgagttaaaacaaagtacaccacgatcaatgacgattgctttgaaatgtaaacatatttctatctgcagatatgtgaaaggaaagtgagaaaatcgtgtgtcagcatgatttcttttgtctatctttaaatgataaaaagccaagaaataagttttcagaggacaaaaaggatggctatggaaaatgtgattctgaatcccgcccttttttctttctttctttatacttaactttaaatttacataagcgagccctttgttttaaagctagtttggaaagctggtgattaaaatgggcaacttggccaggcgcggtggctcacacctgtattcccagcactttgggaggcagaggcaggcagatcacttgaggccaggagttcaagaccagcctggccaacgtggtgaaaccccgtctccactaaaaatacaaaaattagatgaggtagtagccccgtctccactaaaaatacaaaaattattaggtggcgggcgcctgtaatcccagctactcgggtggctgaggcaggagaatcacttgagcctgggaggcgcaggttgcggtgagccgaaatcacaccactgcactccagcctgggtgacagagcaagactctgtctcaaaaaaatatataaaataaaataaaacgggcaacttttctgttggtcacacacgacagcagctctttgtgaagtggctggaatgacagaaagatgagtttgctatcctgttccatgtgcccagtcttgcatcaaattaaagttctccccctggtcaaatgacctttccatgaaacaactcctgggcccacaaaaaagtagacagccccgggaaagagtatattctgcaaagttataaatagtggtcactgttaagggaggagtataattttaaaaaatgcttagcgtgttgctttaggggcacaggtaagaaattaacacgtcctctttatgttcttcaaaattgtcatggaatcccagtggtaaaaagtaataacattggaacgatagctaggtatgcaatccacagtcctgtggcgggtcaaaaaaaaaaaaaaaaaaagagagacacttttcccaccttgcaaacttcttgtgcaggctcttttccacagctcctcggaccacagacttctttagtttcttttttttttggtttttttgtttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcgacttctttagtttctgacttaacacaagaagacctgaaatcctttgcggcacagggtttctgccaaagccatcttcttttattttaatgtttgattttagaaaaacattatcttagcaagtcgaaaaatgtttccctgtgaatgacgctggcggtgaaagctgatggacagcacacagacgaagctcacaaaagaactcttagtagccctcctccagctaatggccaccagctagacagatacacagacacacttgcaagtctgatcacacctgctttctcaaacttgtcaccacagtcctctggcttttttttttttttttttggacagggtctcactttgtcacccaggctggagtgcagtggcacgatcacagctcaccacagccttgacctctcaggctcaagcaatcctctcaccccagcctcccaagtagctgggactacaggcaagcgccaacacgcccggctaacttttgtcttttttgtagaggtgggggtctcactatgttgcccaggctggtcttgaacttctgagctcaagcaatcctcccacctcggcctcccaatgtgctgggattacaggtgtgaaccactgcgcctggtcctctgtcactttatataaagaaatggtggaacatcagatgcagaaatgttgagatatgatgatgatgatgatgatgatgatgatgatttgagacagggtctcactctatcacctaggctggagtgcagtgttgcaatatcggctcactgcaacccccgcctcacaggttcaagcaattctcctgcctcaacctcctgaggagctgggattacaggtgcacgccaccatgccaggctaattttttgtatatttttagtagagacagggtttcaccatgctggccaggctggtcttgaactcctcacctcaagtgatccacccgccttggtctccaggagtgtcgggattacaggcatgagccaccgcacctggctgagatctgatatgtttttgtattagggtgaaaagcaaaaaaaaaattataaattgctgcaaaggttccatctgattcataaaatgccaatacctgttgagtgatgaaatacgtaacctaggtggcatagacgtgcaccgaggcggtggggcagtgcgtccatgtgccaggcatccccccaaccccagcacacgcagatactagtcatgtgtgctgccacccccttcaggagcacctcgtaaaacactagaataggaactgctgtgagagcacagctttggggagtgattttatgatataaacaaggaaattaatatattctgaattcttctttagggtcacttgcccctgaaatcctttactgcagtttgtcagaaagatggatcttgggaccggccaatgcccgcgtgcagcagtacggtcgtgtggtgactacaggccccataaccgcccggaactccctctgctgctactgttgctgcttctattgcttctctggttttctgtttactttcttttttctttccctttttttttttttttctgagacagggtcttgctctgttgcccagactggagtgcagcggtgtgatctcggctcactgcaatttctatctttccaggcttaagcaatcttcctgcctcagcctcctgagtagctgggaccacaggcacctgacaccacgcctggctaatttttgtattatttgtagagacagagttttgccatgttgcccaggctggtctcgaactcctgacctcaagtgatccaccggtctcagcctcccaaagtgctaagattacaggcgtgagccactgtgcccggatccttggttttttttttttaatgatccatttatcagcccttgaatttcaaatttgcttctttttactcatctctcagtgcattcttagaggttaaaacagaaccaacctactagggaaggtatgtgctttagaaaaatatgttctttgacaaggtttttttttttttttttttctgagaagggtctcattctgttgcccaggctggagtacagtggtacaatctcagatcactgcaacctctgtctcctgggttcaagcgattctcccatgtcagctacccccaggagctgggaggcactaccagcacatgtcactacacccggctaatttttgtatttttagtagagatggggtttcaccatgttggccaggctgatctcgaactcctgacctcaggtgatctgcccacctgggcctcccaaagtgtgtgagagagagagagagagagtgtgtgtgtgtgtgtgtgtgtgtgtgtgtgtgtgtcggagtctcactctgtcacccaggctggagtgcggtgacaatctcggctcactgcaacctctgcctcccgggttcaagagattctcatgtctcagcctcctgagtagctaggattacaggcacatgccaccacgcacggctaatttttgtatttttttggtaaagacgaggtttcaccatgttggccaggctggtctcaaactcctgacgtcaagtgatctgcccgcctcaggcttccaaagcgtgttctttgacaatatttttttcttttttttctttttggagacggagtctcactctgttgcccaggctggagtgcggtggtgcaatcttggctcactgcaacctctgcctcctgagttcaagcaattctcctgcctcagcttcctgagtagctgagactacaggcacacaccgccacacctggctaagtttttgtattttagtagagatggtatttcaccgtgctgcccaagctggtcttgaactcctgagctcaggcaacccacctgcctcggcctcccaaagcgctagtagtacaggcatgagccacagcgcccagcctgacaatatttttttctttttctttttttttttggagacgcagttttgttcttgttgcccaggctggagtacaatggcgtgatctcggctcaccgcaacctctgcctcccaggttcaagcgattctcctgcctcagcctccctagtagctgggattacaggcatgtgctaccacgcccggctaattttgtatttttagtagagacggggtttctccatgttggtcaggctggtctcgaactcccgccctcaggggatccacccaccttggcttcccaaagtgctgggattacacgcatgagccaccgcgcccggccgacaatatttttctaagtatgaaagcaacaatattcatggtagaagatggaaaatacagaaaattatgaacatcttaatacctgtaataccaccatatgcaagtataatcattactttttaatatttatttattttttgagacggagtcttgttctgtcacccaggctggagtggagtggcgccatctcggctcactgcaacctccttctcccgggttcaagtaattatcctgcctcagcctcccaaatagctgggattacaagcacttcccaccaagcccagctaatttttctatttttagtagagacgaggtttcaccatgttggccaggctggtcttgaactcctgacttcaagtgatccacctgccttggcctcccaaagtgttgggattacaggcgtgagccaccgtgaccagccacttttttttttttttttgacggggtctcattctgtcgcccaggctggagtgcagtggcacaatctcgactcactgaaacctctgcctcctgggttcaagcaattctcctgcttcagcttccccagtagccgggattacaggcgcccgccaccacacccagtaatttttttagttttagtagaggcagggtttcaccatgttgcccaggcttgtctccaactcctaatctcaagtgatccacccaccttggcctcccaaagtgctgcaattacaggtgtgagccaccaggcccggcctaatcgttaccgttttggtgtgtgtccctccaattacacacaattcacatgtgtgagcaagtatacactattgtatgtagaaaaggggggcaattttatgtggtaatacacacaccccaaactgggataatgatcaaccatacctcatgtgacacaccctcaaactcccgggctcaagtgatcctcctgtctcagcctcctcagtagcttggactacaggcacgtgccacatacccagctccttttaaatttttggtagagatggggtctcactatgttgcccaggctgccctggcctctcttgagtgctgggattacacgtgtgagccgtgcccagtgagctttagaaagacttccaggtctttctaaaaacttcaatttattaaaaggatcagaagaataagctgaattttttgttttggagacaaagtctctatcacccaggcggtagtgcagtggtgtgatcatagctcactgcggcctcatcctcccaggctcaagccatcctcctgcttcagcctcctgagtagctgagaccacgccaccaagcccagccaatttaccttttgtagagagggtttcgctattgcccagactggtcctgaactcctggtctcaagtgaccctcccactttggcctcccaaaatgctgattacaggtttgaaccaccgagcccagctcctccaatcttactatcgtgtccttttctacccttactgccttctaaattgcaaccttttacattgaacctgtgccatgtcatgtgctgttccgctgcagcctttttttttttttttttttttttttaagacagagtcttgctctgtcacccaggctggagtgcagtggtgccatcttggctcactgcaagctccgcctcccgggttcatgccattctcctgcctcagcctcccgagtagctgggactacaggcgcccgctaccacgcctggctaattttttttttttgtatttttagtagagacggggtttcaccgtgttagccaggatggtctccatctcctgaccttgtgatctgcccgcctcggcctcccaaagtgccgggattacaggcatgagccatcgcgcccggccgcagatctttcttatatttgacatgagggtgctaaggagctctgggtggtttcaaattccctttctctaggaaaggcagcacacctcttcctccacatggacgactccccctcagttcagccatttagttacctcccacctcagcctctcaagtaattgggacaacaggcacgtgccaccatgctcggctttttaacctttcgtagagagggggtcttgccatgttgcccaggctggtctcaaactcctgagctcaagggatttgcccgcctcagcctcccaaaggtgcttctccagacctttggaaagttagcactgaaatgatcaatggattcctccctcccatgcttctttcttagttgttgactgtggccctcctgattatctacccagtggccgagtggagtacatcacaggtcctggagtgaccacctacaaagctgtgattcagtacagctgtgaagagaccttctacacaatgaaagtgaatgatggtatgcaaattcttcaaagttgggggtgggcaatacttggaacttgagcccccatggtctgaaaataaactttaaccaacatttttggctaaggctagacaaaagattaaaagccacttctcccatccgctaagtgaaatattatagctaaagtgactttaatgtcaatttgcaaaaatctgaaaacagatctagtaaatgactactacaaacacacaatgtattccaaatggtttaatttaacaagtcaacaccttatcattaagcacttgagatcttgatacatattcaagttacacatctaaaaggtttccactttgcaagcaaacatggtaatgcagagacctcctatttatgaaatcatgtaaaatggttcttcagacacctctatgtcccactgatgctcaagaatcaacatttttcaagggggtattcaagcaaatgacaaccatcttatacatgcagttaaacatttttgcttttccaatgatttgcaggtaaatatgtgtgtgaggctgatggattctggacgagctccaaaggagaaaaatcactcccagtctgtgagcctggtaatggatacatttatacaagagactggtaattgatggaaaggaggactgggtaggagacagtgaggagagctttagctgtggtaggcagaaatgtaacttcagcacttggctcttaggctgttattatttccaaatagtatgttctcattacccccttcccatatacagaggttgttaggtgctgactgcatcagtcatttgattctctttgaccttataactaggcaagcataaaaaattaaatgatttttaggccaggtgtggctcacgcctgtaatcccagcactttgggaggccgaggcaggtgggtcacctgaggccagcctgaccagcatggagaaaccccgtctctaataaaaatacaaaattagccgggtgtggtggtacatgcctgtaatcccagctactcgagcggctgaggcagaattgcttgaacccaggtggtggaggttgcggtgagcccagatcgcaccattatactctagcctgggcaacagtagtgaaattccatatccaaaaaaaaaaaaaaaaaaaaaaagattttaaaaattatcttgaccaacttatacatttataaacacaagttcttctgttgagttactattctatgttaaaatgctattaaaacccaaagcaaataatttccccaagcaattgttttcaacatctagtttttaaacatcaatgcaatctgccttttaatagtacttttttttttaaccagaattggctccaaagataatagttgagtagaattattattatttttttttgagacggaatctcgctctcttgccaggttggagtgcagtggcgcaatctcggctcactgcaacctccccctctgtagaatgatttaaaaaaacaaatcagggccaggcatggtggctcacgcctgtaatcccagcactttgggaggccaaggcggaaagatcacgaggtcaggagatcgagaccatcttggccaacatggtgaaactccgtctctactaaaaaaaaaaaaatacaaaaaattagcctggtgtggtggcaggcgcctgtagtcccagctactcgggaggctgaggcaagagaatggcgtgaacccgggaggtggagcttgcagtgagccaagattgcgccactgcactccagcctgggcaacagagcgagactctgtctcaaaaaaaaagagaaaaagaaaaaaaaagtcagcactttgggaggctgaggcgggcagatcgtgaggtcaggagatcaagaccagtctggctaaaacggtgaaaccccatctctattaaaaatacaaaaaattagccaggtgtggtggcgtgtgcctgtagtcccagctactcaggaggctgaggcaggagaatggcatgaacctgggaggcagagcttgcagtgagccaagattgtaccactgcactccaacctgggtgacagagcgagactctgtctcaaaaaaaaaacaaacaaacaaacaaaaaacccagaaagatagtaatatattaattacccttgtgttatttggctcaaattagtttttttaaacctgtatttggctaacacaacgtctgtaggtattaatgcaagtacactaccacaacagcaaacatatatgctacattaatgggcgtatttaatttgcaataaagatacaataaaacttagtttggaagaatcaactagaccaaaaataaaattttggaatccacagggtcctagccacaactgcaacattctaatttctaaaacatttgtatgttcaaaggtaaaagtaattttgcaaatcctgatactgactttagttcctgctttcctaggattacataaatacccattttacaagtaggaaaacagaaacaatgaaaaggttatatccttctaattcctatgcacatcatccagtccatctgctcagacaatgcctgcttgccctgttaattttcctaatctccttttttttttgagatggagttttgctcttaccaggctagagtgcagtggtgtgacttgtcttactgcaacctccgcctcccaggttcaagcaactctcctgcctcagcctcccaagtggctgggattacaggtgcccatcaccacgcccggctaatttttgtgtatgtagtagagacagggtctcaccatgttggccaggctggtctcaaactcctgacctcaggtgatccacccatctcagcctcccaaagtgctgggattacaggtgtgacactgcacccggccaattttcccaatcttatagaccaaattattttagcaaaacaaaataacttctaaaagtcagttttcactaatctcattttctgaggagctaagaaataccaaaaggttttatcaggtgtttgaactgtgatgttttaaaatagcctcacttgcctgtataggtggtcacccaccaattcatgtaatataatttttggttgacatcaaatatatacttcaaggcggtcataatttaagaaaaacacgattgacatttttacaaaggctctctacctatctgcttctttctccagtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatctgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcacctttgcccacccagtgtaatgtcactgctcaaattacatttcattaccttaaaaagccagtctcttttcatactggctgttggcatttctgtaaactgcctgtccatgctctttgtttttaaacttgttcttattgatctctgtaagtgctttatatattatggcagtactgattgaggaataaccttgaatcctttttttgggtaggtaggttggaaacactgatacttcagcccaggtattgactaaaatttccatgttaaaaaccaatactacaaaatggtgggatacaattattcacttatcaaattgtcagacaaaaggaacgtgaatagtagtactatttcacattgttaaagacaacataaacttcccaaggactatttggcaatacattttaagcaagaccaggcatgttcagggagggtggcaggccacagactggcaatacatttcaaaagcccttaaaaagcatgcataatctttgacctagcaattccaatgctaagaatttattttagcagtaaggatattcccagcaattggaaataacctgaataatgttcaaattcagaagactgaatcaaaacatggcatttccacaagatgaaaagtggcaattagaaataagtggtgacattatagagaaatctgtatttttcctctttacaatgaacatgaaatacttgggcacagtgatgcctaacaaaagcacacatcacacaacagttaagtacagaaccctaatacacacttaggggctactttgctcatactcaacaacaacaaaatcattcttactgttacacattatctcttggattacggagtagttaacttcctactttttcctactaaggacacaacttaagtgctgatttaactttaaaaatctcatttggttttagctggctattccttcctaaaaggttttaatagctaacattcaagtttttcagtctaactaaaagttaccattccatgtaaaagcttactgtgagtcttggcctcatttctcttgtgcatatgaagtacaacttcttgagactcaatttttattattttcttttttctttagagactcaatttttaaaggtaactttccagcatctgtatatcacatataaaaagaaatcgtgtttttccagtaagactccagacactaaactgtggtgtcaaaaaaaaattttatttatctggttcaaaaaattttttagaatgaatgcatttagattgaccaaatagatttttaaaaacaaatctttgccaaatagtttaagtacttttaaacttcaaaatcttcttagggtaaaataaatacccgtatctatgcagtaccataaacatgttaataaaaggccactcaacattgaaagccttctatgaccagtaactgaaatttacacaagtgtaaagaagggattaaaccatgccgttgacaagttaacttacccctgggctccttgaaggcttgtcagtttagtctttggaggtccccgagtaccattttaagtgttaccatgttactgctgctgagtaatagtgcaagtgctaaaatgcaaaattcagatggtacagggtttggaaatcatgcagattcagatgcagaaaaaaaaaattaaaacaactcaagatccctttacagaggaaactgaataatgaaacaatgtggcgattacaagtctaaaggatgacttcattgataaatgtttaaaacatgtaacttgcaaaatgacaaacctatttatcataatctaattaggtaagggcattaggtaaactaccaacacaacaaatatcacattcttccaactagaaaatgagctcaactctcacagaattagttacaaaaaagtacaacagagaatcaatgttattgcttttacatacttaacaatgcattgtgagagtgtgagttttgtaagcgattttattcaactgtattcaatgttaccacattcccccacctcctggaggacaaagcccattccacttaacacttccagacagacaacccaccctaattcttaaagctatcaggcctcttaatggatttcaggcacaagataatttgtggtttcttctactttatccctactgcaattaattccacttttcaaatcccaaactaggaagg

SEQ ID NO: 13647 - DNA, 28865 bp, Human
actgccaagtttatttcttcaccctgaactataccccagaccaatatattcatctgtttctttgacatcatcacttgcatatcttggacttgattattgttaacgacctcccgataatgaccaccaggaacacaactatagctgagcaacttggatgtattgcttgtttcagtacgtgagaatgcacaccatggggaaccatgggatgtcttaggaagagggtgttaaaaaggacttgttatagaatttgagtttgtgttaggagatttacggaagggtgcaagaaagagggactttggcctggattggaagctgtaaggaagcaaggataattctataattgggtattttaataagtattatgtagaaggaaggaagactagactgaggttaaaactataattggtaaagaagcagcaggcactcatattagctaggataaggagatatttgatcatttttatggcttgggcaatgttgatgttgtgtctgtgttcacatatgattatagagtgatcttacttttgtcttgatctatcacggtcacaactctgtcttgtctgatgttctgtgaaattgtttatgttcaacagaagaataccaatgcttggctgtgattgccaggccagctcaaagcaacagcaaaccaagctggtagtaccaggccatctcctggatgtcaaggtccgcttttctctttctcggtatccacactagaatccttgatttactctcttccacctcactcaatcaaaaaccattacctcacagacttcccttctatgtggcactaccacccacacatatgctagcccaaaacctaagattcactgttgatgatgcccttttcttcattttccatagccaatcaccaaatcccattgtcttctttcttttatttcttccgccattgttctggtccaaactaccattatgtttctcctaaacataaagtgcatcctatttcctctgcttccacacttgcccctctacaatccattctcttcataacagatagatcatattactcccttgctttaaaactttcaaatagcttccaattgtactcagaacaaacactaaacttcttaccctggctttcaaggaccctggtctggcttctgcctaactctccaccttcatctatctgggactatcttgcggctcactcactatgcttcccccacactggcctttcctgccctgcccctgcaacataccaagttcctctttctctctgcatttgccctatcctttctttgccaggacaacagtctccctaccagctctttctcatccaggtctctttgagagggcttccctgaccatctagatgccaccttcctggtcagtatttccctcaagtagtaatcaatgccggaaagaatactgttcatttattcatccgttattgtcatcgcttcattggaatttagcttcctacagggatggtgtttatcttgctcactatgattccagcccctagaaaaacccacctacctcatagccaagggctcagtaaatagtatacactgccttcctgccactgtgctaatttctactaacacagccacaaacaatcagcaattacattttctgcttgtttttaacggggaagtagggcactcaacgaaaaggaaataaaagcagagtcaagaaagtgccttttatccatggagtgcccaatgtgttgtgcggccggccacgtatatagggatgtgtcagcacctgagatttttccttctctgagctagcttctttcctggaaatcatgctgggcccttagccttatggttcaccctgttttttaagatcatccacgggcttcattcccgtaaccgctcttctagctggccaaggcggcgggaagaaaccccaccctcttgcgcaaacgcccagtagcggaatccgcggggtcgagggctttagtgtgcgcatgtgcaaccagagcggcggcgggaagtgttgcgcaggcgcatccgatcgactcggtaggtggggatctcttggagacggcgacccaggcatctggggagccacagaagtcgtactcccttaaaccgtgagtttccgacggtttgttccatggcgcgggattgtgagggattaggaacgaattctggatcgtgacttcggttttctcgccgtgcagttccttttcccgccccccttcggatccctccgacctgcggcgggaaagtcgcgcgcctgcgcactaagcatctggttcggtctctggcccgagggaagccggtccttcccggctgagctcgcggccagcgctggccggcggattcccattcattcacccttctcctcctccgcccagtactcgtggccagggtcgtatcagttctccgtcaacttgcttggggccttggacgagcctcctggcgcttcctgtcagtggcgaaaaggttttctccctcagttcttttcctgacttcaaaccgcccccggcgctcggcccctcccccacgcggtcccgctggctgtgccggactggcagcctcgccgtttcccactgcgcctgctgctgcgcgggtgcccaagccgggaaattctccctgcagccccctgccggtgtttctgataggtgaaaataaagcacatggaattccttagacaaggccacagtatgccctactgtggaggtttggacacatcgtgcgtttgaaaatgtttgcccctttggggggcagtagcatgtttttagtgcgtggtttagcgagtgatctaaatttctctagtgttctaattttcacagctgctttgctccccctgtggatgtaaccccttagctggcattttgcatctcaattggcttgtgatggaggcgtctttggggattcagatggatgagccaatggctttttctccccagcgtgaccggtttcaggctgaaggctctttaaaaaaaaacgagcagaattttaaacttgcaggtacgtgtttaaatccaaagatgtacagttataaagatttttcaggcaacaattctgtgttttcaattcctctcaaaaaataagattgaatcttataaagtgaattgtatgtttctataggacagtgttaaaacagagcttcgtatgatctaaatgtaggactgaattgcgatttggaagactgtaatacaacctgttttacggttgaagttgctatggtctcagtattggtaattaagaatgcagaaatttgatgatgcccaaattaaatttctcttttgtatctgtgttcttatctctactcaccacattgccttaagcttaaatgtagaaattgacactggagatcatcacttaagtattcaaaagcagaactcacagacaaaaaaatatgaaatgtttgtagcaataataaagcaccatatctcagtgtacagcatgaaatgttctttgaccgtaaaccagaccttagggtgaataagacagggtcaagcagtgcctgctcttgtacactcgcatgtgtaccttcatttctgctctggcacaggacctgggacatagtaggtatttgttaataataaatatttgttaaatagaggaattctagttgactgtatttttttttttctgaaagggtagccagatcatctttcccatctttgtcttaagtgaattctgtgcttgtctaaaagatacttattttgaccttttgtccatatattctttataaccccaccctagaaaaatatgacatcacatactttctgctttgatggaagtcagttatcccacttacctaaacttgaaactttaatcttcagctgatgctttttatttgttccccatatcgtcacctagctttatttctttttagtaagtatggcattgtgtcttctttccattcccatttccaccacattaattaatttccttacactttgttcctgatttacaacagtttctcacctatgctgcctgcttgcacttttccatccttcagttcatcttgtatgttggtgctagaataatcttaaaatgccactttcatccagtttcatggatactgttcctcttcctttccatttttccagcagttagctgtttttttagttcatctttcccttactagtcactggacacataacacagtaacacagtcattgtagtattctttttctattgcttaggactctgcattttgtctccactgtaaaccccttggcggcagtatctcctctggtttctaaagtatgttgtgacttcagcagagtatctgaatggatgactctgaattggttctagcatcatgtttaggagaatgccactattctaatattctgaaaatctgctgggaagtaatgaatggggtgaattttattacggatttcaaaagttttgtagcgtttatgtaacagaacattggacattataatatgataaattataaaacgtgctaaaactttactcttatggttcttttttaaatatgatcttaataacagctaaagttatataaacataacttcaatagggagcaaagctgatgaggtccaggcacataacagtctagtaatctaattgggaaagtaaatcaaattagatcatgagacaggtatatgcctgcacctcatcaactttactccttattgaagttatatttttgattggatgttttatatatcttagcattcccagagcttaacagtgtccagcacatagtaggtgcttgaaaatatttgaatgaatgatttaatgtaaggatataaagtaaaatacttagtgtaatggatgaatagcatgtctctttattttgagatatttgtcagatttttataacatttttctgataaacatgattattgaaatttttgaagtaaagaaagccaaaataaagtcttttcccattattgaaatattgccactgttgacattttgttatattcctttagcctttctaggcatacataggtacattttttagaaactaaattgggatcttgttttgtttttgtttttgaaaagagaaccagaatatgggatcttatttctgatctccattttttttaatatatatcttgaatattgctcatgtagtaaatattctacaactggatttaaggtccattgcatattatattataatatattcaatcaccttttactattgaccctatagattgtttctattttttcctattaagaaaaatgctgtaatgcacaaactatctggcataatattggtcaaatgtttattctttcactgttttggcaagcttttttttttttttttgagacatggtctctctgtcacaccactgtcactggagtgcagtggcgcaattacagctcactgcagccttaactcctgcactcaagcaatcctaccccctcagcctcctgagtagcttggattacaggcatgtgccgctacactcagctaattttaaatattttttttagaaacaggatcttgctatgttgcccaggctggtctcaaactcctggcctcaagtgatcccctcctatcttggcctcccaatgcactgggattacaggtgtgagccaccatgcctggccagtaagcttttatttttttttaagtatctactatatgccaagttttaataagtgagaaagatctgttcagtgaaagaatgatgtataaactctatattgaaagtctcctccatactggtgaactctactggaaggaaggcttgcttcattctgtttgctacaatgacacccttagccatgcttctaaaatgggctatgggtaccatctttgtttgcctgggacagatctagcttacggctattgtcacaatgtaattattattcctgctgccttttcactcaagagtgtcccagtttgggcttatattatgtattatcccctagttccaggaggtataaaccagagagtacatgaagccccagaataaccatgactatatgcctagagtgtcagttttaatccatgacaagatattgaaaacgtttcatttatgtgatgaatatttattgtctgttatatacatgtacttttttaggtgctagggataaatcaaaccataaaacagaaattaacactgtggtagttagacaatagacagagagtaaacaaaagaagtaaatactgtgctcaaaagtgattaatgttactaagaaaatgtaaaagggaaggggagataggaagtattggggaaggagattgtaattttagtgagtatggttgctcatagccttctgtaacatttgagctaagacttcaaggtggtgaaggagtgacctgtgcagatatttggggaagagcattccaaacagaggaaacggcaagtacaaagaccctgaaacggcaagtacaaagaccctgagatgggagtgtgcctagcattcaagaatagcaaggaggtcattgtggctagaatggggaaggtaattggaatgaagtcaaagagagatgtaaagaggctttctaatggagtgagatgtgaaaccattagaggttttgagcacaatagtgacaaggtgacttagctttatcagaatactctgtttaaactctgtttgctatgttgcaagccgactggctactatgttacagatagactccaggctggcaaggagtgtagttaaggagactattggtatattaaaaccaacttggatatattatgcagcagaaaacaaaagtgacttaaaatgtcaaaatagaagcctagaccttcatgtataaaatagaggcatttaaataatttttagcatattatagattttcgggatcctcctccagtcctcaaagtctgtttcatttgtctgtctttagtactgttttccagcttttgacatgaatgcacttttctgctttctgctgtcatttcccacttcagaatttgaggatattgcattcactttggttgccaggaagttttactgttgtttaaaattgttgaagttgttctgaagtgacaggaaaccttaataaacattttgatttttgtaaagaggagtagatgcataataagtgagtagtggtgtggaagtacccttaatgtttctcctccctttcacatctgttctccacttgtcatttttctgcttaaaaacttcctatagctttcatgtgcattctctcttgtcttcctcagccacattctatttctattattgttattattgttattattattgagacagggtctccctcttccatcacccaggctggagtacagtggcacgatcatagtttagtaacctcaaactcctgggctcaaggtatccttctgcctcagtctctgtagctgagactacaggcccgtgttacaaagcccagctaatttttgtttgtttgtttgttttttagcttttttaagagatagggtctcaaacacctggcctcaagcagtcttcttgccttggtctcctaaagtgctgggattacaggcctgagccaccgccccaggccacattgtatttcattgtctctcagccctccccctaccctaatcatccaagccttttttttttcttgttcctgtctttacagacgtagttaatttttcctaaaatgttttcttccactttcactacttggtgaatgcttcagaacaaaacttagctgtcaactgaaggcttcctatcaccttcagaaatcctccccaacctagtagtatatacattcttttattacaggtgtcaccttgtattaagaatgataacatgtttcctttactagaccaagctcttagtggctgcatcaaatttattggttttttttacatacccattgctgagcattttttaagacagcgtttatttaaatgaattagttctagccaggtgcggcggctcacacctgtaatcccagcactttgggaggccaaggtgggcagatcacttgaggtcaggagttcaagaccagcctggccattgtggtgaaaccccgtctctactaaaaacacaaaaattagctgggcgtggtggtgcgtgcctgtaattccagctgcccatgaggctgaggcatgagaatctcttgaacgcaggaggcagaggttgcagtgagtggagattacatcactgcactccaacctgggcaacagagtgagactccatctcaaaaaagaaagaaaattagaaaatatatataatcagcaacacctctgtgaaattgggcaaatgatttaacctccctgaattgagtttccttatctgaaaaatcaggataatcattcctgctctgccaagttcacagtactgttaggaagacctcaaaagatactgcatgtgccggtgctttgaaaatgtcttaaacttatgctatatagggctagtagagcctagatactgtaataaaatctgaagacttatctagttctcttctgtatccagtagtttactgggttttgtattattgcctccccttgttttaactatgtacatttttataaagaactgatacttatttaaaagtagcaatttatctgcagtcaaggatagaggatactactggcaattgggacaaatttttaaaaatacttttttacatgcttgagagctttagtaggccttctctctgaaaatatagtgtgaatatttaatacataaaattttaccaagcctttaagattttgtatctttacgggaaatagttttcaagaacatcgcaatgtgtccttgtcatgccatctagtgatcacagcacaaattgtttagttattttaaaaatttggtgctttttcatgttgtaatctctacagtaacaatgtatctcttagtatataattccagtatagtagaaatttggtgtatttaattctgggactgtcatttttgtctgttcaagaggtgtgtgtgagttatagcaacttgatgggttttaatcttatcacaatgttattaaaacttatgtataattaattactcatattttataatttatttcattgagctttttaaattttaagaaactgtaaaatatactgtcattgattaaaactctaaatttttgtttccttgaaaggtgttaaaaaagatattgagaagctttatgaagctgtaccacagcttagtaatgtgtttaagattgaggacaaaattggagaaggtaatctggggatatgcttttactatttttacgaggtcttttttccattctattttccttttttagtcttggttttcattactatttcttattgaaaaatataccactttttagactattaagaccatagttttattactaattatggtaacagcttttctttttcaaccttaaagaaagaataaataataaatatttactgtaaaatgaagtcctgttttaatgtattatgccattgaaacagtttttacaatctatcttagaattgtttcattaacatttttaaaaaccagatattgaaaaatttaataaattgttttacaggcactttcagctctgtttatttggccacagcacagttacaagtaggacctgaagagaaaattgctctaaaacacttgattccaacaagtcatcctataagaattgcagctgaacttcagtgcctaacagtggctgggtaggcaatttaaacatattttaattgaacttgtatataatttataagattttaaagtagatatttagcagggatgaggggattatatgtgaattaaatacatttttcagtcaagtgtttgcaatttgctagcactttccttctaaccttgcaatagttagttaaatttatagtaattcttttagattggatttcccttgaggctcgacctgatttcctgtcttttatcactgctttttgtaaccttcctgccaaatcataaaccttggctttcatggtttacattattttgtaaatgtagggaactcacatttcacatttccccagctattgacgacctcatctaatattttatttagaataacagaatcatctggtatggtttctctctgctaggtcatttctgtcaacatatggacatgatttagaatcttaccctcctaaactgccctccttcttccacctgctccatcatttctttgttcccccttacagccagacttctcaaaaattatctgcatacattgttttcattccacacctctctttcactaaatacctattgcggctgttcttctctatgctaaactggaaactatagagtcaatcattactctaggcatcatttaacacaattgacgtgaacccttgtcttgacttctgtcctgccacaccctccttgttttcttcttccctcatttggcctttcattttcagtgtctttgctagctcttccacttctatctgacccctaaatattggagttcctcgtgcttgctcttaggtttctctgtattcttagtgtcctccatttccacatgatctaaagtaatgattcccaaaagtatatagttaatctcagaccttttatcttaactacaggtttgtgtatatccacctgcctatttaacatttccacttggtgcctgataaatatctcaaacctaaaagacaaaactaaaccttaacataccaaaaaaaaaaaaaaaaacaccacaacaaatgttcttatccacccgtctctgcaaatggcccatctacacacttgtttgggccagaaacctagaaatcatcctcattttctctatttctctcctaaaccacattaatcactaagtcctagccattttggctctaaagtatatctagaagttcatccatgtctttctgtcttctctgccactacctcagatgaagcctagactacgactgtagcctgcttcttccttctccccttaattctgtctttacacagcagccagaatgatctttaaaatataaaatatatatgtatataacttaaattgggtcattagttccaccacttaaaatctttcagtggtttccctatgtactttgaaaaaaaaattcaaccttctcatgcctatcttcccacctccctcactgtgctccatttctttagtttatcaaatttgtctcaagagctttcttacctcagggccactgcccagactgtttccccattcaggaagacctctcccagtcattgcttgctgacccttcatcttctgatctgagcaagagtgaaactggacgcagtagttcatgcttgtaatcccagcactttgggaggattgcttgaggccaggagtttgagacctgcctgggcaacctagcaagaacccatctttacaaaaaacttaaaaattatccaggcaaggtggcacacatctgtagtcccagctacttgggaggctgaggtaggaggatcacttgagcccaggagtttgaggctgtaatgacctgcgatcactccattgcactccatccagcctggtcaacaaaacaagaccctgcctctgagaaaaaaaaaaaagagtgacattgcttgaaagatgtcttctctgaattaaattagattctcctatttttttttattgtcatagcatctttagatttctttcaaagcccttatcgtattctgtcattataagttaccttgttattatctgtattgtccactagatagtaaactccatgaggacagaaattctgtaaattttattcactattgcatcactaatgtctataatccctaacagcaaataacagtgccaactaaatactgaatgaatgaataagcctgtttgtttcagccttctgtgtattatagaagacaagaaaatgagatggcctctataaagaatgcttgcatacattcttgtaccctaaatatgatcatttctttttctatacttttaactgtctccctctaccactttttctttttctgtgcttaaaaaagtacatgctaaaaatgccttcatctgatcttacaatgcagtcaggcaaattgtcttcaggctcagcttccattgtgttatattttccttccttctgttttgtttcttcctttccacttaaattgctgtcttaaaaattaccagttaattattctttgcctaactaaaagccttccctcagttgttattctctttgacttccatgctaataactcttccttcaaaattcctttcttatttggctctctaacttggcttcttccaagctcagttttcttttctcgctattaattttcatgtctgtaggtatcacttctctgcaagtactctcactgacttctcacttgtcttctcacttaaggcttagtcccttgtctagatatctctatcaaaatgatgaggtctggttttagatgcttcttttactggcttctctactcattttttggtatctctattgttttcttactcaggctcaaaatcatagaaatcacctttgtcctattttcctcttttatgaagcagtgtaacatagtgattaagaacatatatctggagcaaaatgcctgggttcaaatcctggctcattgatctattagtttagtgaccttgatttatttattactgttaccatcttatctgctaagtcttattaatcttttcccttttttctcattctgctgcttccccagtcacaactataattacctcgtttgaattattatagtaacttcaaaactggtgccatttttgttttaaaagaaaactttaacacgagaacacaagtcacttgtgtttatattatgtgatgatgatttaagtcagttttctagcaatatgtatgcattgctaaaattgcggtttttaaaattaggcataaagtttcagtccctctgacctttcttctaaaagttccttgtgcatttttccactagggggcaagataatgtcatgggagttaaatactgctttaggaagaatgatcatgtagttattgctatgccatatctggagcatgagtcgtttttggtaggttttaatatttcttgaatttttattagctaaatatttaattgcaaacaatatttgtaactcatttcatttgtaactttgttttaggacattctgaattctctttcctttcaagaagtacgggaatatatgcttaatctgttcaaagctttgaaacgcattcatcagtttggtattgttcaccgtgatgttaagcccagcaattttttatataataggcgcctgaaaaagtaagtatgaagagttactagaaaatatttatcctatttcttttaaaaaacaattttattgtctatatttaaggtattgaacatgatgttatatatagtacaaaagttactattgtgaagcaaatatttatctcagttacccatcttatttttgtttttacggcaagagcagctaaaatttactcatttagtatgaatctcatatacagtacagttttattacctgtaatcttcagagtgtgcattaggtctagatttatttatcctacatatctgctactttgtatcctctgacttatatctcttagatataatataacatactgcaatagccatgcacagattatttctgtttcagtttctttgtgattggaaagggaaatttggtgatgaagaagataaaattgtattagtggaataatgtacattattagatgtactatggttcagtggaaatagcatgaactaacagacttagagtctaataatttttgaccttagacatgtctcttatctctggacttcatttttcttttctagtaagtgaggggattggaccacatgatagccaatttcctgttttaacacaaaagttttatttttatgtatactttttaatgctgattataattatagagaaattataagctaaaaataacataaatacctctatataatggatcatattaaacataataatattataacttcttttttgagcttttatatgcctgactttttaattttctttaattggatcagattttaaaaccatgattttaatttttttaagctttcttaactagaaattatctgctatgatgccatctctgccaccatcagagaacaacggactgtgtttatgttatgtattcctcttctgccttattaacacagaccactggaaaaagaaaatttgattgtgggacaactcttaattttcaatcctggttagctgttaaattcttactttgtctggaaaacttatttttttttcttttttccagaatgttataaattcctaattgatcccaaaaagaattacagtttttatgaggatggtttgagagtattacaatgttactaagctttaattgctacagataagtaaaaatgcttaattttgtctcttaggtatgccttggtagactttggtttggcccaaggaacccatgatacgaaaatagagcttcttaaatttgtccagtctgaagctcagcaggaaaggtgttcacaaaacaaatcccacataatcacaggaaacaagattccactgagtggcccagtacctaaggagctggatcagcagtccaccacaaaagcttctgttaaaagaccctacacaaatgcacaaattcagattaaacaaggaaaagacggaaaggttctatctcttttatttcttaagtaccgacactgttttagaaatatactccttcaaccaacagagggagatagaatactaggatagtacttataatttaaaaaacttttttttgcatttgttatatgtattcatttgattaaattttcactaagatttgtactgaatcattttggttactattttaaaactaaaatttactttgtcagtttataacatctgtcattaactattatgaaatcatattttatgacaaaaatggaaaatattaaattttccctgcatgttaaaaagttcagattaattatcctttttaaaagaaagcattagttataggggaggaattctgaagtgtctatctccattttagctgcacagcaaaatgtaacatccatgcaggtggtttttgaatttttttttagttatatatatttgtggactatgataacattgtatgggtgttgagttctgtctagactattttctcctttcacagaagtggtttggtgcctgagaatgacttggatgcagctgtttttgtttcatctcacttaactctttcaaaactatggcagagtacagctggcagaaagtgttacagatataatccttattttccttgtttttgttggtattgtaggagggatctgtaggcctttctgtccagcgctctgtttttggagaaagaaatttcaatatacacagctccatttcacatgagagccctgcagtgaaagtaagtaatgtagcttaatagcataatggtcagtcagtcatacactgaagagaatttaggtaataactagattaacatttattatcagaaatttttttaaactagagtttggctttggcagaaggtattactgctttaagcatttagtcaaaacttgttttctccagtttttttctgaacttttctggtggaattttttctcatttttggttagctattactgtctttctctagaggaacatttagaacattaagggctttctgtcattgctagagtgtgagctccatacagttagctaactattctgacacatagttgatagtgtaaagatgtttgtaaagttaacaaaatcatcatcaatgtagatgatttcagattgacttatgatatcttgtgacagctagacagcatgagcaacaaattaaaactgtgattttagccaacgtacttgtgcagtttacagttctgaaatggagttagacactagaacataactgttttatacttctgtaatatatcaggaaaagttctaataaagtataactcaaatattggccaagctaggactaattagtaaattttaatataaggtgactttacagaaaaacccaagaagaccttaaacattttaatagacaacagtttatttacagtccaatagccattcagcagtttttaaagttatgcttccgctattgctttttgccatactagcattttaggacatcatgtttaatatcatgaaaatagaaaaatgagacttttcttttacagctcatgaagcagtcaaagactgtggatgtactgtctagaaagttagcaacaaaaaagaaggctatttctacgaaagttatgaatagtgctgtgatgaggaaaactgccagttcttgcccagctagcctgacctgtgactgctatgcaacagataaagtttgtagtatttgcctttcaaggtaatgtgttttgatggtgttataaaatcaccagcatgctgccattagaaattgcattgacttgggtggataattttgtgagtgcaagggatcagttcagatcagtgaactgcaatgggccttgatgcagagcagtagtatgttgaagagcaaatgataacagttttcatatattatttatttaatatggatatactctggaaaacacatttgctcttatatgcaaataagtgggacggggtggcttttagaagcttagaatcacacattttgattgctgatgtagtcttttctgttttctctttttattcccgcttatgtggagtaaccagaaccaaatagtagagctcctcttttactcccacctccaactctttgactcataaatttcttcctttccttcaaggcttggctttcataaagcctttcttgattaactcaaatatataagtgtatctgtgatcaattactccaaacaaatgaatttttatacctgtgaattgctattgggttctattttttctattatggctcttattatccactactgctttttattcttggaggttattttaaacctttctggagtaagtccggggaactagtagagggggtaaaaaacagaagaagaaaaatctaggatttttatcacactagattatcatttactttatagtaacacttattatataggtatcaaggcaaaatttactgtgaactaaattgatgaatgttattttttagacttacatagttcaactttaacataactagagaaatcttatttcatcataaggcgtcagcaggttgcccctagggcaggtacaccaggattcagagcaccagaggtcttgacaaagtgccccaatcaaactacaggtatgttgtactggaaatacagaacctagttaaaatggattgttccagacgtattttattttatgatctttgtctatttataactaatatttgagttcttctgcttttaattatgtaagcagttcttgcagtgtggcattcctatttttgagctaatgctattctttatgaaagtttttaatcctaatgttgcctctctttttttgtttaaacagtttattccatagattacattttgcgtatttatttacaagatgatcttaccatcttgtaaataaatacgcaaaatgtaatctgtggaattttgctgacatcacctttgtgggggaaaaaattatgtttaatagtttttgccagccaaagacttaaagcattttatttgcttgcttaatacctcaaaagtttcctgtgatgtagatatatttgtgtttgattaaaattacttttgttattatataaacaatataatagcagttagaaggttttgaaaaagaaaaatgtcttccgtaatctaaaaacttaccatggagctggaatccaggaaacatcttgaatgaatagatgaatcctgctattcacttggattatgggctttgaagaaatgtattcattcattgaatgtctgttcttgcttgctaatgataacaaataaataaatgagaccatctgttcacactctagtcaggacaccatcaaataattataaaataacctgttgagtatggtaataaaacttattcagggtatttaaggagtatctaactatcctaacccaaagagattatgaaaggcaattcatgaaagaaatgacctcttagaatgtaaattgggctgagaagttagcatagaggcatgagccaaggaactcaagaaacagcatacaggaaactaaaaaagtttcattttggccagacgcggtggctcatgcctgtaatcccagcactttcggaggctgagatgggcggatcacctgagatcaggagtttgaaaccagcctgaccaacatggtgaaaccccatctctactaaaaatacaaaaatcagctgggtgtggtggtgcgcacctgtaatcccagctactcaggaggctgaggcaagagaatcacttgaacgcaggaggcggaagttgcagtgagccaagatcgcaccattgccctccaacctgggcgacagcaagacttcatctcaaaaaaaaaagtccaattttgctagaatattaagatgcaagttgaggaatggtgagagataaacctggaatgaggtagacaaggtcagaccacagttgttacagtttggactatatactgtagatattggaaagttaagtgaaaaaagtgacaatggtatatcctagatggatcattctggcaggcgtgcaaacagattagcttttggagagtggtggcatgaatttgtccgggtgagaggatgaaaatgtgaatgagggtattggtaataggaatgaaaagaaaagtgaagggttagaaaggcagagcttggtggataattggatgtagaattagggtgtggtatggtgagggaaaaaggcattcaggatgtttaccagattcctagcttgggagacttggatgtgtaccagtaaccaaggtggagagtaaaggagaagtaactggtttataggggaaggtaaggttagtttggggtataattggtttgaggtatttgtgggacatccaaatagagatttccagcagaatcaaagttaagtctgatgctcagcgaaggagctgggctagaaatacagatgaatgtcatcattatataaatgacagttgaagccatgaagtggatggaccaatcagggagagtatacagagggagaagttaaaactctgaggaatatccgtcagcacttaaggcttggagaaaacattgaaggagcaggcagaggtaccaaaggagctaagaaaggcaagtagggccgggcacagtggctcatgcctataataccagcactttgggaggccaaggcaggcagatcactaggtcaggagttcgagatcagcctggccaatatggcgaaatcccgtctctactaaaaagtacaaaaaattagcagggcatggtggcacacacctgtagttccagctactggggaggctgaggcaggagaattgaacccgggaggcagaggttacagtgagccaagatcgcaccattgcactccagcctgagcaacagagtgagactcagtctcaaaaaaaaaaaaaaaaaaaaaaaggtgatacagtagcccaaggaacagagagcagataacctggtgatactaggaagtcaacaattaagagagatgtcaactttaagaaaaaaaaaaaagagctttttaacatcaagttgagctagtcgtaatctttaactaccagaattcagaagattaaagtttctatagtgggaatgtaaattagtacaaccactatggaaaacaatttggacgttcctcaaaaaactaaaaatagagctactacatgatccaacaatcccactgctgggtatatacccaaaagaaaggaaatcaatgtaccgaagaggtatctgcactcccatgtttgttgaagcactattcataatagccaaaatttgaaagcgacctaagtgtccgtcaacagatgaatggataaagaaaatgtggtacttacacacaatggaagtactattcagccacgaaaaagaagatcttgtcatttgcaacaacatggatggaactggagatcattatgtcaggtgaaataagccaggcaccgaaagacaagagttgcatgttctcactaatttgtgggatctaaaaattaaaacaattgaacccatagagagcagaaagatggttaccagaggctgagaagggtggtgggagggtgtgggggatgtggggacagctgatgggtacaaaaaatagttataaagaatgaattatccagcactttgggaggccaaggcaggtggattgcttgagctcaggcactcgagaccagcttgggcaacatggtagaaccctatttctaccaaaaatacaaaaaagtagctggatgtggtagtgtgcatccgtggtcccagctactcaggaggctgaggtgggaggatcacttgagcctgggaggcggaggttgcagtgagccgagatcacactaccacactctagcctgggtaacagagccagaccccatctcgaaaaaaaaaaaaaaagaatgaattaagacctagtatttgatagcacagcagggggattatagtcagtaatttaattgtgcagtttaaaataactaaaagagtactttgaggggctgaggcaggcagatcacttgagcccaggagcttgagaccagcctggccaatgtggcaaaacctcgtctctactaaaaatacaaaaaaaaaaaaaaaaaaaaaaaaaagagctgggcatggtgacatgcctgtaatcccagctactcaagaggctgaagcatgagaattgcttgaacctgggaggcagagattgcagtgagctgagactgtgccactgcactctagtctgggccacagagggagaccttgtctcaaaaagaaaaaaagaaaagaatataattggattgttcgtaacacaaaggataaatgcttgagggaatggataccctgttttccaggatgtgattattacacactgcatgcctgtatcaaaacatcttatataccccatcaatatatacacctactgtgtactcagaaaaattaaagtcttcacagtcacaaaaaaataaaaaagtaattttttaaaagtttctatagcagtagttggtgctagtgtcagctgaagaagagcttctaatgttcattacttttcactaaaatgaaagcactttgaccagtatggtatgtaattctcaaggatcattcagattttttcccacatagctatttttggattccttttgatcctataaaatgtgcgtttacttagtgtttcctagtgattaaatatccttttaaatttaccaacacgttgctcaagaaagaaaacatattttgcagtgaggattctcagtcctggttgtacattaaaatcacctgaggaacttttttaaaacattgatgcctgagccctacttcagaactgttcaatcaaaatctttgggtctgggcatctgaaatttttaaggctcccaaggtgattctaatgcataataaatgttgaggactattgatttagatgataaaattatagatttgaaatttatttttaaaatttgtcttctgttgcagcaattgacatgtggtctgcaggtgtcatatttctttctttgcttagtggacgatatccattttataaagcaagtgatgatttaactgctttggcccaaattatgacaattaggggatccagagaaactatccaagctgctaaaacttttggtaagcagttttgtattatagaaccaaacaaaatgcctttgattatctcctacaaatcacttaataaattattgtgaaattttctttacaaataaacattcagtcttgataaagttctctaatattaagtagaaaattcttcagttgcttgaaaataaatttatcacctctctatacatataatcatttaatcttattaagcacaaagtaatacactgttgcagtatttaaagtttacctttataattttataagaataaggagtaaaatcttaactccttttagttatggtttgacttttattacataaatttaccttttattaaaggcatgttttactttgtaatatgttttacttttttattgtcttttaaacatcagatgcactatgtcttggtacttagagtgtccttgccttaaatgatcttaggctatactaacaagtaaacagttaattattaatacagtgtaataaggactagggaagagaatggaaatgtgtgttgtcaggttgtgtaggtttacggtagcagagaagcagaatgcatagaaggccttaactgatgggatattattgtaagcatatattggacttggatgtcatctccttagccacgcaagttcttcaagactgggatgtgcagtgtacttcatagggcacataagaattatctcagccttgctctggccaacaatctgaactcaagtgcccatttaatgtttattttccacgctcagttatagttaatactttccaaggaataagtgggattgactcagcttactaccatacaatacagaacacctcaggagacaaagtttcagccagcctacctcaagagtagctgggctgtcttgtgctcaaccccaggatcagtgggtcttaaccagagttgcatgtcagaattatctgagaatctttaagaaatacatatgcctgcccactcagcctattcttggaaaatatgattcagaaaaacaagatacttaggaaggctccagccttgttagtttgaaaaagcaagtgattctgactaagaaactatgggtgtttaagaaccactgcaaaaattactgcccttgcttatgcactagtgctatagtctaatctacaagaaaaacttagtggtggttgtgaagaaagcctcatcttaatagaggcttgccaaaatatgtttctacagtaaagtcagtccacgatttgtaactatcttgtacttattgtaagaaaattttatttgaagataataggatgaaataatacaagggaaaaaaagtgaccatgagtggaaagcaagattgatatcttagaaatggcattcttacataataatataacaagtatgtttattctcaactgagaaaactttcatctactattgaataacttcgtgagaggtttatgaacatgaagtttatcagccaataccaacatattttattgaagagcttgaatctcccccattgtaatccaagttataatcagggccaacaatggaaatacaacatctgacccaaaaatactctagatcaagtgccatgatagcaagcaagagcttttagagatttatcattgtaatacttctcatattaaaaaaaaaatagggccagccgtggtgactcacacctgtaatcccagcactttgagaggcttaggtgggcagatcatgaggtcaggagaccgagaccatcctggccaacgtggtgaaaccccatctctattaaaaacacaaaaattagttgggcatggtagcatgcacttgtagtcccagctactcgggaggctgaggcaggagaaccagctgaacctgggagatggaggttgcagtgagccaagattgcaccactgcactccagcctgacgacagagcaagactctgtctcaaaaaaacaaataataaaaataatgccataggacttgtctcagttgtattagtatgacatctgtagttattttagtcttgatcttactataactttggactgagtataaaagcctcaaaatttcaacaaacacaactgtgttcccctttgtaacctaaagaaatgacttggctgagattagcagtgagagcacctttacttctcttatctgtcctcaacccttaaacctggctccattgtgggttgtcattaagtactcagtgaattgtgttgaataaattaaaaagaaaagtcttgagctgaaacaaattcctgacacatagtagtctgtaataaaatatgttgactgatagtgttacttgaagttatttttcctgaatattgtaaatgaaccctctttttggtcatataaaaaaaagcatattgtataacttggggacatgctataacatatactattagttattttatgacttcagaacaagctaataaaggaataaaactatatgaatattcccccctggctataattttctagagagaataggaatgatagaatcagtttaaaagtaaaaaagcattggcatattgtactctcaaagaatttggtcttcagtaattgtttgtttcctccctttccctcccccatttttttccctggcttagtacaccagtccagtagttagttcagaatatgtaaaggtaactttttatcatccacagtcagattaatgactttgttgacaatctacattctcagaaaggcatctaaatgttgtggtacttgttgtttcgtacatttagtatatttctgtttaataaggaaatgtaaggcaaaaataatacatgattgccatttgtgtgattaacttttttttgcacatctgataataaacccatcaggaagttatttcaaatacatttatatttttaaaaacagatctagtttgtttatttgttcattcagaaacatttattggggctttatgtgtgccaagtactattgcgagtctctgctttcacagagcttaaattctagtgagggagagaacataaataaatactatgagaaatgagtggtactgagataaaaggaaaaggggagggaagaggcttatttaggataggttggtcaagaacagcatctctaaggatgtatgtgtcatttgaacagttgttgaaaagaataatgcctttttgtctagtccaacagacattaactgactacctaatctgtaccaggcataggctgggtttggggggttcaaagataaataagacagttcctgccttcaaagagctcagtctactaggtgggacagacatatataggatagcaaaagtaatagtagaactctcaagatacagtagaaactgaaattgatcagttctctctgagggtgtcaagcctcagaggtgattcttgatctgagtggtgatgtcagtgagagtgtcctgggcacacaaggggtgcagggcatcctaggcaaagacaggagtcatgtagtcaaagacatagaagcatggaaaggaagtagagtgggggcgtgggagctgcagctagttaaagattatagaagggtaagatgaagcttgagaaattggcagagtcaagtgagtgcctggcatagcttagtaagtcactgctttgtacttactatctcccactttatctcccactatgcaattcaaatacaacttaaatatagcatgtggtgctctatctcatactgtgtgtgtgtgtgtgtgtgtgtgtccatgtctataaagcatatgtttgaactttcatgtttctcatgagagaggcttctgatatattcaaataataaaatgtttttttctgttgttgttttttcttcttttgcttttagggaaatcaatattatgtagcaaagaagttccagcacaagacttgagaaaactctgtgagagactcaggggtatggattctagcactcccaagttaacaagtgatatacaagggcatgcttctcatcaaccagctatttcagagaagactgaccataaagcttcttgcctcgttcaaacacctccaggacaatactcagggaattcatttaaaaagggggatagtaatagctgtgagcattgttttgatgagtataataccaatttagaaggctggaatgaggtacctgatgaagcttatgacctgcttgataaacttctagatctaaatccagcttcaagaataacagcagaagaagctttgttgcatccattttttaaagatatgagcttgtgataatggatcttcatttaatgtttactgttatgaggtagaataaaaaagaatactttgtaatagccacaagttcttgtttagagaccagagcaggattaataatttattttaacattttagtgtttggtggcacattctaaaatatagattaagaatacttaaaatgcctgggatagttcttgggactaacaacatgatcttctttgagttaaacctacctaagtagattttaggtgggttcctattaggtcagatttttagcttccctaattacctttcactgacatatacagaaaaaggagcagttttagttttaattaattaaaattaacagatgtgatgaggattaaatgaatcaaaagacttaatttgtagattcttttagagttatgagctaggtatagtttggggaaactcaacctggtgctggtgctcttaacaattttgtaaataaagaagataatttccttttctagaggtacatattaggccttttatgaacactaaaacaatgaggaaatgttggtcatggggcaaagtatcacttaaaattgaattcatccatttttaaaaaacacttcatgaaagcattctggtgtgaattgccatttttttcttactggcttctcaattttcttccttctctgcccctacctaaaacattctcctcggaaattacatggtgctgaccacaaagtttctggatgttttattaaatattgtacgtgtttacagttgggaatttaaaataatacatacactggttgataaagggaagctgcaggaccaaggtgaagattgatagtccaaatgcttttcttttttgagttgtatattttttcacaccatcttagatataattaggtagctgctgaaaggaaaagtgaatacagaattgacggtattattggagatttttcctctctgtagagccatccagatctctgtatcctgttttgactaagtcttaggtgggttgggaagacagataatgaagtaggcaaagagaaaaggacccaagatagaggtttatattcagaaatggtatatatcaatgacagcatatcaaacttcctatgggaaaaagtctggtgggtggtcagctgacagatttcccatttagtagtcatagaatacagaaatagtttagggacatgtattcattttgttattttgagcattgataggtcagtatatctacctaatctgtttggtaagtataggatatataaaccattaccattgatctgtcttatgccataatcttaaaaaaaaattgaatgctcttgaatttgtatattcaataaagttatccttttatattttttatgtcagactactcatttgaaaaatagcttttttttttaattgacaactgggaatatttttcttttgagatgggtgaatggtgatattctttcagcaaatagtatgttaatgaaacagtcatgttaacatatattcagaaattaaagaggaagaaaaatttacccaaagggtagataaggagacattctctaagaaagtttaatattcagggctgttgttttaactttcattaatggcaaagaacttggttgatattgagggggaagtaaaagggagctagtgtttttaaatatacccagtgttacaaattagttctcggggaatttcagtcccactgaagaatattgcctcaattttggacaaatattcccaatgtgctaaatcagaattggcagggagcttttatatgcgtattctttagatttttaagccttctgaagaccattttaaataatgggaaatgtctctaaaatatttgaatttctaaggatagactaagaaggtaactagttaatgccatttcctcttaatcagctatttttcactgtcagtttttaaaaattcctagtgctcaggctcgataaaactgttaagggtattttcatttaaaaagccttagacatttagaactattaatataacaagctacaagtattggtttttgaagcaggctgagctctctggcatttttaatgaaacttccttataaggagatgattatagttgtcttaatgacctaaatatgtggctcaataatggttattccaaagaattaatcatggtttacttcaagataatgagcaagtcatcaagtaaaacgttaatatcttactgttcctggcatcagcattttagggacaaaatggtgttacagatgtcagaatattgattgcataaaatcttgaaacccacaaaactcgtaggcttaagtcttagtaatttctgttgtttatgtaatttcagccctgcacgtcactgaaaagttatttatcttaacaaactggccaaatttggcgggtaatgctgtctgccagtatctgcagatgtattgtttccgcctacatttgtgcatgttgtctgtggtctttaaagaacactaacaccagatagaaatgtcaactctgttcagattttttcctatgttcgaagaactgatgttgctgattcctaattttgtcaaattatgtgtctgaactgtcttcctttcttgaaaggtagatattaccaaacgtataccagataagtaatcagaagtagttaatattgtgtcaagttacagcacagttttcaacaaagtaaccacaaaggtcagtgctaaggcaaatatttagtaaacgatgttttagctatctaaagtaaaaaggcatgatcttaggaaagtgattgcaaattaaaagagagaaaattaaaaaactgaagtttggaaaacaagtaattgcaacagtttcaagagtttaatctgacctgattttttcttctgtagaagacaatgaactaaaaggacacaattgttctcgatctctgttttgagtgctttaaaaaattaatatatggaagagttcaaaatgggcaaaataaaaacttatttggagagcatacgcatagtttttttataaagcaagaacgatgaccagaaaacagatgtaaatggtttagaatttctatttaagcataaaccatgtgcaaaattactcttccgaatttaacacatcatgtgttagccattagctgattccatcttggaccctactgaagcaattctttaaggaaaataacaggcttagcactagaaaacaacatatgaaggaaaatagggaataaatactttatagatacatctctctagttctagatttagagaatgccagtgttactccagcaggcaaccaagaagatggatcaaggaatgggcttctgacagacatcctgaagaaactgaacactgtcagctgtggagtgagtagtacaaatcagaaaatgaaagatccattga

SEQ ID NO: 13648 - DNA, 18112 bp, Human
  misc_feature (1)...(18112): n = A,T,C or G
tttatctagtgtggaaggccccacagagccccttccacgtcccaggctctgctccagctgggttaagtcaatgcatatttgaaatagaggaaggagctcgagggactgacccgggctccgtcaacaggttcaacgtagcaaagtgaaagttctctcccaggttaaagggattctcccacggcggcccaggagatggtggcggcgggcgcccggctggaggcctgcgcctttaaggagccagggggcggaggggcggggcaggaagacgactccccggagacgccgccaccggctaggtctttttttgggagggggcgggccagacccttttatgggctccgccccctttgcggctgccgcgtcccccttccgccctcggctggaggggaggaagctaggggggcgttgcagcggaccccgtctgggagctccccgctgggcgtccggcccgcggaggcgcgagtttgctgactcggagggagccgctggggcgggggcgagtgctaataatacccgttcgttccgcagccgcgctttacagtttacacagctgtcaccttcgtttctccttaattaataataaaaatagccgccgttcgggagcgcgggctgggcgccaggcccggtgccgagcgcggtacgagctcggcccccagagccggccctcgccacaggatccccattttccagagcgggaagccgacgctcaaccccgcgccgcgacttgcccgaggtcacccagtgggccagcggctccgggaccgaggcgcggggcggggtgaggcgaggcgcggtgctgcccccggctccccggggcggcgcggggcggggcgggcggcgcggagggcgggggcgcgcgcggatggccatcttaagtggccgcctggagcccagggccgctgtccggggaagggggcgccggagcagcccgggaggtgggggtctgcgtgcggcggccgggatcccggtagggaactttctactagacgggccagggatcctcctggcttcggactgctgaaccccctcaaggcccggcctgcgggtgtggggggtggtgctggggaacttggccgagagggggaagggctctgcggggctgggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgcggggcgccgggcccggggggcgccctgggcagccaggccccctcctggtaccaccgcgacctgagccgggcggccgcggaggagctgctggcccgggcgggccgcgatggcagcttcctggtccgagacagcgagagcgtggcgggggccttcgcgctctgcgtcctgtgagtggggcgggggctccttgcgggctggcgtggaccgggagcgcgggcacggccgggtgtggaaagggcccgggtgagggtttctggggcggtgggacgccagacccgcctccaccccccagagtgggagccttggctttctcctgggtctgaggagggacgcaggggcacttcctgctgtgtgtctgggggcactttcaggagccttgagggtagagaatatggggttctgtggcccagtgtgactgtgatgacgaaaaattcgggcattccccggcagaccccttcaggcatcctccaggtagaagggagcaggggagaggatgtgcattccacgttgtgtgcagtcccgtttggatagggactgagtggtgagcaggagagggagtcggggcagagggactgacggggtgtgtggggatgcctggcagcttccttagggcccctttcggtgctttggggttctgcctggccgtgtatgggtggtgggggcggtgatgggtggtgtagagaggaaggcttggggaagcagaggctgaggctgtatgggaccttgccattatttctgaaccaatgagtgagtgtttgagccctggctctgggcttgagccctggttacctggctgccctagccctgagctatgagtgctgagtgagagcagagccagacttggtgcttctctgagtgggccaggtcctgtggctgtgcctttcagcccagtgtggttggtagtggtgctggggtgagttagcactcttggttttgcagccttctagcggctttgtacctcctgccctgcagtctgacattgagttggcttctgtgggcccagtgagtgggaatctgtgggggctgctttatttagatcagttatttagatctttatttagatctttcttagctctgtgaaccccctcccaaactcctgtcccactgtaccttccttacccctttgttctcctgacatctttggtcggggcgcacattagcctagaccaggggagacctttttttttttttttttttttgagaaagagtctcgctctgttgcccaggctggagtgcagtagtgcaatctcggctcactgcaacctccgcctcctggattcaagtgattcttctgcctctgcctcgccagtagctgggattacaggcgctcgccaccaagcccagctaatttttgtatttttagtagagatggggtttcaccatattggccaggctggtcttgaactcctgacctcaagtgatccacctgccccggcctctcaaagtgctaggattacaggtggagccacctcgcccagctggggagacatttttaattgtcacaactgggatggtgctattgacatctagtgggtagaagccggggatactgctaaacattctacagtgcacaagagagtcccccacaacaaagaactgtgcaatccaaaatgtcagtggtatggaggttgaaaaactctagcctaggcaattgacccaacaaggaaggggccctataagtcttagcttaggcctcaagtctgaggcccagtagggggagactaaggagggacagactaggcagatgaatatccccaagtcctgcttcccagccccctctgaggcataccccctaattaggctggggagggaggcaggtgctgggtcagctgttgagtgggagggggacagctggggcctgtgtctgggtgaggaacattattgtcccaggagggggagaatcctggcctcattgccaagggaggctgtgaatggggtgaggggtctgtctgtgagtgggggcttcaggtttgccagctgactctggctcttccccgcatctcaagagcctgggggtaaggatcagacgtgggcgatcagacgtgggcaatatcttagatttgccaaatacacacatacttgcttacctgtatacattccgggtgttcatggataacatgcaagacacgcccctgccccagcaggcacaggcaatctgaccagcaagctaggatactggccctggcttctgccatggtttaaaatcccaactccaccttttacttactctgtggccttaggaaaatcacttttattctttgagcctgtttcctcagctggagaatggggataataatatctgtttagaagtgtgagaattaagtaagatttataggacactgggtacccagcgtgtcacagataggattcagttaatggtatgctattgtaataaacacagatagtgtttgtaatagtctacaaaggaacacctggtgacagacactcacccagcataagcagccaggagagtcacctagggtgactcctgggtgactccttggggaagcatgccctgaggtgcggaggcagaggatcttccatcccccgctgattgtgcacctggctcagctgccacctgctcaactgcggctcctgtctgtcagcacccctcttgcccctccttggcttggggctcctagaggcccaggtctcccatgggggccctctttggtgggaaggcctagggtgatgcccccacactcctcggcacaagtgccctagacatacccgactccagcagagccagagagcagcataaacacaggaggcatacacacgtgttagcacgttgcccgtgtgtgcaaatgggctaaccaggcttctgaagactcttactctggcggggagcccagactggtaccacagcccagaggggctgtttagacagctgtggaggccacaaaagagctccctgttgcttctcaggccctgccctgtggtgggtgtggagtctgtgtaggtctggtggggagacgggggtgttctggtcattcctgcccaataggcaacaccaggagggtggaagtggaccggccacatcattaaccctgtgcagcctgggcaggtggttttagggaaaccaagctgagggggttggggtgctgagcttgctggcaggaggaaggggtgctttgggtcttagaccccagcctgggggtgacagattctggccctgccttggcatcaggtatcagaagcatgtgcacacgtatcgcattctgcctgatggagaagatttcttggctgtgcaggtaggagcttgggcccctgacccctgaccttgatccagcctagggcttggggacctgctggctgacccttcctcccacccttgctggcccacagacctcgcagggtgtgcctgtgcgccgcttccagaccctgggtgagctcatcggcctgtacgcccagcccaaccagggccttgtgtgcgccctgcttcttcctgtagagggtgagcgagagccggacccaccggatgaccgggatgcctcaggtacttcccagtgtgcaggtcccctccctgcccctgtcccttggctctacctgcctcttcccatccccccttctcaaccccacctctcctgtaaccccctttcccttggccatgatgccggggccctttaaccctctttccatggaagtcactttacagctgcatcgtgcctcctactccactgagtgtgggaggcccaaacggctgcccactgacccctgcccacagatggggaggatgagaagcccccgctgcccccgcgctctggctccaccagcatttctgcccccactgggcccagcagtcccctgccagctcctgagactcccacagctccagctgctgagaggtgagacccccatcccatccactgaacaggagaccctttctcctctgagaactatttccctaccaaaggtggggaggccttctaagaccccaccagggacccccaccccacctcagcccagaggcagataacctgatccatcccgccctggttgccacaggtactatctcctctagggatggggcagaggtgctgggacaggtcagcaggacctccactgacttcttaacccctccccaaagtgctcccaatgggctgagcaccgtctcgcacgactacctgaaaggcagctatgggctggacctggaagctgtgaggggtggagccagccacctgccccacctcacccgtaccctcgctacctcatgccggaggctgcacaggtatctgggacatccagccccatgtattacacccttacctctgacctgtcctcacctgcttcccggctgcacaggtgccctgatctctgatcctgaacagtgaactagccattgcctcttgactttcctcactggtagcctttatccttgtggtgaggttgaggctacacccagcgcccccttccctatacttaggtcggggtgggagttcttttgatctgatgtcttccctagtgaggtggacaaggtcctgtcaggcctggagatcctgtccaaggtgtttgaccagcagagctcgcccatggtgacccgccttttgcagcagcaggtagattgtagggagacctctgggaggtgcgttcgtgttctggagctgggtgggaggctctgcttaggtgactcatgtacaagcctggttcttcctccccccagaacctgccacagacaggggagcaggaactagagagcctggtgctgaagctgtcagtgctaaaggacttcctgtcaggcatccagaagaaggtggcatgatctctgacccttgacccccgattcactggccactgtcattggcctagcactgatctcaaccctcagtctacaacttaacattggccccaaggtcaattgtgtccctccctgccccagccttcagtgtgtcccctgaccccgccctgcccttgttccctccaggccctgaaggccctacaggacatgagctccacagcacccccagctccgcagccatccacacgtaaggccaagaccatccccgtgcaggcctttgaggtacatggcagtggggcctcacagggccaagggtggttggaggtgaccagggtgctgcctactccaaggtcttgtcagcagcctccccacctggcctacaggtgaagctagatgtgaccctgggtgacctgaccaagattgggaagtcacagaagttcacgctgagcgtggatgtggagggtgggcggctggtgctgctgcggagacagcgggactcccaggaggactggaccaccttcacgcacgaccgcagtgagccagggccagacctgggaggggtgggcagggcggagcccctggcctaggggcacaggcccatgtgaccggtcctccatgccctagtccgccagctcattaagtcccagcgtgtccagaacaagctgggtgttgtgtttgagaaggagaaggaccggactcagcgcaaggacttcatctttgtcagtgcccgggtgagcagcaggctgggccaggccactggggactgcgggggtcccccacatgggtgcttcccattggagggtaagaaagggaacacatgatgtaggcatgccatccctcctggcaggggtaggtctgacagggtagagggtgttgagaacgggtggcctgagggtggataacatttgccagcactgttatatgcttgagcagtgggtatgcagtggagaaccagacagaccctctcctcatggacatgagccaactggcagggtatccctgtggacggggggcttcctggatgcctacccgcccctgagtggctgctgttcccccagaagcgggaggccttctgccagctgttgcagctcatgaagaacaagcactccaagcaggacgagcccgacatgatctcagtcttcataggcacctggaacatgggtcaggcccgggctggggctggggcgggagagagggatggccccagagcaggtgcctaacccctccagacccacctcacccccttcacctccaggaagtgtaccacctccaaaaaacgtgacatcctggttcacatcgaagggtctggggaagaccctggacgaggtcacagtgaccataccccatgacatctatgtctttgggacccaggagaactcagtgggcgaccgcgagtggctggacctactgcgcgggggcctcaaggagcttacggatctggattaccgcccggtgagggggggtcatcttgtccaggaccctgtcctcacacaccacctccaaactagcctacttgacttcatgggcaaccctgggagcacagcttcactggctttttctctggtccctgagcatatcctttgggagatctgacctgagtccttcatgccacgagaggaaccatttctctccagtccgtcaggaagaggggtggcaagccttcctaccctgtgatggacacaaaagtctatttatagtgcagggggaaatgcaggcagtgggtgcagcagggcagtggtgaccatgcactctctacccagattgccatgcaatcactgtggaatatcaaggtggcagtgctggtcaagccagagcacgagaaccgtatcagccatgtcagtacgtccagtgtgaagactggcatcgccaacaccctgggtaagtggggctggcaggtgcccaagagtggcagcgtctctctgtccatggcttctgcttcctctcaagcctaggattgccccatttttggtgatcttagtttccccatatatagggtactttgaactttgaaaaacatattcatattctaaatctctcccagcaccactgggaaggcaaggccaggataattacccccttttcacagatgataaaactcaaacccagagtggttgagtgacctgcccaaggtcacacagcaagtaagtggtggagccaggcattgtgcccaggtctcctgattttcggtctggtgctctcccaggtagattctgcgcagaatctgcagggcctttcagcttcacccttggggtcccctgtgatctccaggggctctgctcacacatacagacagactcaggccatccacacagaccatgtgtgcccaatgaggacccccccctcccccagggaaggtgtgggtgtgtgcaggggcctgcccatgtcacagcgtctggtgggctcagcgggaggatcctctcactgcagctttgagaggcagaagggagagttgggagccctctgaggatgacccaggccttcctctcttgcttgccttaacagggaacaagggggctgtgggcgtctccttcatgtttaatggcacctcatttggctttgtgaattgtcacctcacctcgggaaatgagaagacggctcggtgagggggcgcctttcccatggtctctttacacccatcccattcacctgaggcctgttcccgctcccataccctagcccatgaccctcccgcaggcctgtctccagagaccccctgctctcttatcccaattcaagacccttctgttcctgaccctaaccttgtccccaggggcccggatctttaccccatccctgactcctgagacttcttccctttatgcctatccctgacttctggccctgaccctggggatctacccctccccaccacgcacccctcaccctaggaggaaccaaaactacttggacatcctgcggctgctctcgctgggcgaccggcagctcaatgcctttgacatctctctgcgtttcacacacctcttctggtttggggacctcaactaccgcctggacatggatatccaggtgcgagcagggccctgccatggctgtagggaggctaagggccacatgggctatcacccctggctctggctccggaggaatgtttctagcctttgtgtcctccaccccaggagatcctgaactacatcagcaggaaagagtttgagcccctcctcagggtggaccagctcaacctggagcgggagaagcacaaggtcttccttcgattcagtgagtgtgggcctggtaggtggtgatctgagggctaggagacttgcagtatccctgggtgtcagggccctgaaccccacctgtctcctgctttccttaggtgaggaggagatctccttcccacccacctaccgctatgagcggggttcccgggacacatatgcctggcacaagcagaagccaactggggtgagccaagaaaacggcatgggccttgggggaccgcaggcctgcgatgaatcaagaatttgggtcaagggtatgggcctctgcagcttccactccagcctccatggcccctctgaggcctttgggtgatcctgggtattttgaggatccaagaagggaggtgggtgctagggcctctagtaatagaagtgtggggactcatcagctctggagtggggtccatgccaagcagcctcctagctgtcagctctaaccatgctgccatcccctgccccaggtccggaccaatgtgccctcatggtgtgaccggattctgtggaaatcctaccctgaaactcacatcatctgcaattcttatggtcagagcctcccggacagagtgatgggagatctggggtggtcaccatctggactctgccctaaccttgggaggtgggagccgagggtgggaatattccccctgagtccccattcctatcccctctccccaggttgcactgatgacatcgtcaccagcgaccattcccccgtgtttgggacatttgaggttggagttacctcccagttcatctccaagaaaggtgactgttccagatatgcttgtgggtgtggcataatctaggtgggcacaggtggtggcctcgggatgtacataggtttgactatgtaagtgtgtgtgtgggtgtgtgtaccagtgagtgcaggagtgtttctcaaggtgtgatgtgtcagggtgtctgtgcgcctgggccatcacaagagttgtgtgcccatgagtgtgtgtgcatacgtgagtgtacacctatctatgtgtctgtgtctgtctagggccacgtgtgtgtccctgagtatgcctgtaggtgtgggaatcctgcaggcattctggtccccagcaccctcttcaatgggttttttatccttgggttgtctctttgctctggtccagggtctggcctctggagattccctgttggtggcttgggactggggaggcccctcctggccctgcctccttgctctggacccctgatttcctgtcccagggccctgtttctctgtcccattcctcctgtgatcctctcagtcctcctgtttgttctcctccctttctcctcagggctctcaaagacttcagaccaggcctacattgagtttgagagcatcgaggccattgtgaagacagccagccgcaccaagttcttcatcgagttctactctacctgcctggagggtcagaggcgtggcaggggctgggtgtgggccaaggaggatgggaggcaagagggtgcagtcagccccctacttagggggaaaggaagctgagaggtggtgctcagttgggtgtctcccacccccaccccagaatacaagaagagctttgagaatgatgcccagagcagtgacaacatcaacttcctcaaagtgcagtggtcttcacgccagctgcccacggtgaggctgtgggcagggcccctgcttatgggtgagggcacagagaggggtacataagagtttattggagagcctgcctgggagggagtgtggggccagcagagagagagagagagagtgtgtgtgtgtgtgtgtgtgtgtgtgtgtgtatgggcatgggcatgagtgaggataaaggcgtttgctttattttgggagtgtggaaccttgttgcagtttgttcattcattcaggagatgcttcttgagcttttgctagatgtcaggtcctgtgttagctattgagaaaattaattagttacagtgatgctaggtgctgtaaaaggcctgtatagggctgtgtcttctgcattaaggatttggctcttctctgaagagttgagtgtgagtgagcacagatgacctgagggtggggattgagtggtgtcagggggcagcgcgtaggaggggcaggaggaagtggcggggctttgttcctcactgggcctccctgcttcccagctcaaaccaattctggctgatatcgagtacctgcaggaccagcacctcctgctcacagtcaagtccatggatggctatgaatcctatggtgaggggtgaggggtgctgaggggaacaggaagccagacagggccctagattagcttggtaatttgctggtttgtcccatctgctcctcaggggagtgtgtggttgcactcaaatccatgatcggcagcacggcccaacagttcctgaccttcctatcccaccgtggcgaggagacaggcaatatcagaggctccatgaaggtgcgggtgcccacggagcgcctgggcacccgtgagcggctctacggtggggactccactgggacatgagatagggtggtgtgaacagatcaaggagggcagggtgcggggggcatgttggaatctctgggatacctggaggttctgcagccacagctgggaatagtcctgccccaaggcatagctgggaaagggctggcaggcccactgggtgtctgtgggatccaggagcccaggtctcctctgagtctcccttcctgccccctcagagtggatcagcattgataaggatgaggcaggagcaaagagcaaagccccctctgtgtcccgagggagccaggagcccaggtgagctagggctgtgttgaatgtcatatgaaagggtacctgggggcatctggtcaaccccacttcatctctctcctgtgcatccctggcaggtcagggagccgcaagccagccttcacagaggcctcctgcccgctctccaggttatttgaagaaccagagaaaccgccaccaacggggaggcccccagccccaccccgagcagctccccgggaggagcccttgacccccaggtgagaggaggaacctgtcaccgcccccccttcccccacccacctctatccatcactatcccctgcagggtctcagggttggcctggagatcatcagctgcttaggtgccctgccactctgtggttggagctgccatggccttatgcctgtggccagccaggccacccttagctgtggctctgagtcaaagggagcagtcagcctttcctctcaattctgcctttaaaaatggaatgcgaaattgtttctaagacagctccctccatgtaaacagacctagcttgagccttctatttggaggaggcacatggctcggcctgggatttcccagggtaccttctttggaactctgtcctgcaagaggccccagttgaaatgggtttgtggtcaaatgagtttgggaaatgctttttctagattcttttcttagacattcccagtgcatgttagtattagcaaaagctctgagcatgtggacaggaaggaaacctcttttcagctctgtttaatatagtttcccaaacttaatgggccaggaaacttattttccatgtagtaactattaacgttctggggaattagtgctctgtgtcacactttgggaaagtgaggcttgctttctaattatatccgattgttgcttaaacttacataaactcctaggtacagtttggtgctttttcactcatcttcagctgttgtcagtcaccccggttttatccctaggcttgaataagacccacctgaatctctgagaaagattctgcagcggattgactgtgggtgcctcaagaggctttccaaacctggcctctcattggaggcttcttgccctgtcttctggcacctctattctgacccatttagcttgggtttcacagctacagataaagtcatgaaagatctaagtatcttagcaagtgaggcaagggattgtagggttatccattcaaagggttatcctccctctgacctttagagatgaagaaactaagggcaggtgatgtgctcaaggtcatgagaaagtctaggaccaggggactttctgactcccgtctagttctccttccactgcttccactgccttagacctgggttcctggatcctggcttagtcgttctgcttccacacccaggttgaagccagagggagctcctgaaccagaaggggtggcggcccccccacccaagaacagcttcaataaccctgcctactacgtccttgaaggggtcccgcaccagctgctgcccccggagccaccctcgcctgccagggcccctgtcccatctgccaccaagaacaaagtggccattacagtgcctgctccacagcttgggcaccaccggcaccctcgtgtgggagaggggagttcttcagatgaggagtctggaggcacactgccccctccagactttccacctccaccactgccggactcagccatcttcctgccccccagcctggatcctttaccagggccagtggtccggggccgtggtggggctgaggcccgtggcccaccacctcccaaggcccatccaaggcctccactgcccccaggcccctcaccagccagcactttcctgggggaagtggccagtggggatgaccggtcctgctcggtgctgcagatggccaagacgctgagcgaggtggactatgcccctgctgggcctgcacgctcagcgctcctcccaggccccctggagctgcagcccccccggggactgccctcggactatggccggcccctcagcttccctccaccccgcatccgggagagcatccaggaagacctggcagaggaggtgtgtggagcagggtggctgtctgtgtgtgcctgagtgtgcttgcccacagactggtaccctttcactccaccattcagcactcatggtgtccctgctaccctgaactgatcactgggaagttgggagacacatgtatcagcccagcccttcccttccttttccccagagcatgcagcagaatgtgactgcaggtgtttctatggggggcactcagctccccctgacatgccctgtttccttaggctccgtgcctgcagggcgggcgggccagcgggctgggcgaggcaggcatgagtgcctggctgcgggccatcggcttggagcgctatgaggagggcctggtgcataatggctgggacgacctggagtttctcaggtgggggaggggctggccccgggggcggagctggggccctcaggatccccttgcccatctcacttcccagcctgttttactccacagtgacatcaccgaggaggacttggaggaggctggggtgcaggacccggctcacaagcgcctccttctggacaccctgcagctcagcaagtgatagcggaggcaccacgaagctgtgaactcagagcccctccctgctaccaaggcccagctatggccccagggttgaaaagttatgagggtcagggcagtatctctctgcctatttattggggtgcctatttattggggatctgcattccccgctgcccaatcatttgcaatgccctaattagggcatcctgcccctcgccttttaggctcaggacggaaggtcagttgccatggttaccgaggaccctggttactctggtgctgtcctgttttactggaccccgcctcccagccccaggggtgcctgtgggggtccatttgggtacgtctgggcccccactttcaccagtttctgcggccttccaccgggcctgaaccacagcggaggagctccgctaagacctccccacccccgctgggggtgggggcgggtgtccgtccggaaatgaaggaatagcccgaggaccgggctggggtttatttaaactgttctgtgtgggtctggggagggagagcaccttaatattattggggttggttggggtggggcaggatctcagccataaagtgccagtttgcttagttctcactgtctcctggtctgtgctgccctgctctggggatgcacggcggcagggtgggggagggaggttcctcgcaggtctcagcccgggacagggtcttgcaagcagcctcctgggcagtcgtaagggttgcggcgtgatgtcttcaataaattaagttttatttggattgagtaaaacttcaataaattacaagtttttcaaagaaaaaggacaaccaaaaaaattagggaaagagaatccctctgtcccattccccaggcagcccctccactcctctaacaggtccaccctctgtgccagacgggctagggaagagaggagacacgtgagggatgaattggcggtggtcattaattatcccggcgaccaccagcctctgtacgggtgggcccgaggggtggggcagcgggctttcctgatcaccagcgtaaggggtgacccagccgctgcagagccagggaagggggctgtgccgatcctccttgaggaccttcactttgagggcactgttagggacaggcctcatgtgataccgcatccaaagaaggccaagctagaaggagctccggggttctcctggaggaggtcccggtataaagaactccgctctgctggtagagggtgggtgaggacgagagtggccctgacttggtctccaaagttggggaggacacaccgaggggtgagacagtagggagtggagacggatggggacttccaggcgggtggccaggatgggaggggctgtcaggtcctggaggggcagggacgtctctgggggcaggctcggagcctccagaggccggcagctagaagagattggtcttcagggcggggccgggcttccggtgaaaggaggacagaaccccggagaagggcccggggccggactccgccggctgccaagccttaagtagttcggccgctcccgcgccaggcccgccgcccccaccgcccgccacaccggcccacagtgcgcccttgagcggctgtggccccggcccaggtcccggcccggagcccagtgcgacgggcagcgggctggggctcaggcgcgggctggccaggccgggcgcaggcggcggcggcagcgaggcggtgctatcgggcgtggggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccgcgcgctcctgtttgcggaacttggcccggcggttctggaaccagacctgcgggcacaggggccagtcagcctggacgagggtcggagaacgcacggggtcagcccgcgtccgcaaggctcgagtgagatcctggttcggaaagaaccgggcccgggttcttactagttggaggggccttcggccctccgcacgcagcccgctgcactccgcgctccactggcccctgcctccagatccctgggttcttgcccttgggatccactcacccgctgactctgctgcctcccagcactcttggtctcccggaggggaccctgccttcgttctcctcactctaagttcttcccccaattccttcttttaggaagctctgggacttccctcctggagtgttccagggccgtggagagcagtttagggcgccagtaaaccttttgtctagggcatccagtcaaggcgggccaactgaacatctgtacacggagttgtacaaatagacaacagtctgctctagcccggctctcttcggccctgtgcctgccacaaactcagcctcccgggctccgggttttcaaagctgcagcgccggggtagggaaccccaggggtgctgactggcctgccccctctcctcctcagctcggccctgaggtcccctgggtctccccctctagcccctcggcctccctcctggcttctcaagcatcactcggaactttctgccctaagagggagacagagcggaggtagcctggagctaaacagatcgggtctcccaagggcctccaagtccgggccctgctgcctcccgtagctgcccaagcaccctgggaccgcgccctgccttcgggctgcatctgcctgtattcccctacccccaggtgttagacattaagctcccacacctccttccatgcgca

SEQ ID NO: 13649 - DNA, 74550 bp, Human; identical to SEQ ID NO: 12310

SEQ ID NO: 13650 - DNA, 74550 bp, Human; identical to SEQ ID NO: 12310

SEQ ID NO: 13651 - DNA, 4455 bp, Human
aaattgctgcggcaagatcccttgatgggtactaaaattactaattgaaaggtaaactgtaaacaatacttgcatattcttaaattatctctccaaaatatctgataattgccaagggaaaatagtaattttattttattttaaaaatttttttgtagaaatagggtcttgccatgttgcctgggctggtcttgaactcctgggctcaagtgatcttctcacctcggcctcccaaagtgctgggattccaggcactttagtgtcaccatgcctggcacttctagtgagccactgcacctgtctggaaaatagtgattttatagtggaggattctggtagacaccaccttagccaagtcatcaaggttaacatcacctataatacacatcgacatcacatacccacaatttggtgcactgagaagggcagatcccctccagtctatggtagccttccctagaatgcttaatttcaatctaatcatgagaaaacataaaaaaaaaacaaattgagtgacattttaccaaactactgaacagtaattactgactcttcaaaagtgacaggattataaaaaacagaaagacaagaactattacagattggaggagactaaggaaatgtgacaattaaatgaattggatcctggaacataaaaatgacattacaggaaaaactagtgaaatctgagtaaggtttatagtttatagtattgtgccaggttttgaaaattcttttatcattatgtggatgttaacataaggataagctgaaagaaagttattcagggaatatctctgcaactctaaagtctaaagtctaaaattatctcaaaataaaaattgaaagaaaagggaaaggaggaaggaaaatcatgaaaaacatccatgacatcttttccctgggcacatggctactctatatttcccaccatcccttacagtcaggttttgccatgtggctgagttttaatcaacagactatgagcagtaatgctgtgtgctatttccaggctcagacttttaaaaaaagaaggtaatcccccactattccccctcacactttcagcaggtgaatgcagtgatgccctggtgggaagggcagatccattagacggaaggggcctgagtccccaggtcactgtaaaggaaacccaccagaccagggaaaaacacccttttcaaactcttgcatatacaagcaataaagttctgttgtattctaccattttacatttggtaggtctattttttaccacaaactaaaatgaaaacatattgataacttttctagctcttatttctcactagggtatgctacaacttttattatttgaaatgtttatctccatcacaagggctagacataactaataataaatttggcaagtacaaagagctgctgattgcaatatctgtcaaagggagaaactgaatatataagatataactcttcattatatgatttgagtttattttcctggaatatatccaatcacaaaagaatattgtttttctcagaaaaactgagccaagtagattcttctttataccatactggtaaaggagaaaaagcaatgctactaagttccaataagaaatttcccccatctctatgttagtctacctttataaccattcaggtggaaaaggctgataaggcaatgttgggcaattctttctaattacttcctttgaaatgtctactactaacaggactgatcaatattctcattatgcaaatgtttcttatctattgttcaactttcatatgaccactggatatcagagatgtatgagaaggtagtatataacagacactgggaagagttagtaaatttagaagacacggacccttgcctcaaagattttacaatgtatgattcattccagctaacaaatatacaaggaaaattgaacaggaaaaaaaacatgttttatggtatcctgaaaacaagatgggaaaatcacattactggtcccatagataaaatttaaatagagacgccgggcctaccgcgggagcatgagggaagccatgcattccgttccaaggcatccgtgagcccgcggagtatacaccatgagcaaagctcaccctcccgagttgaaaaaatttatggacaagaagttatcattgaaattaaatggtggcagacatgtgcaaggaatattgcggggatttgatccttttatgaaccttgtgatagacgaatgtgtggagatggcgactagtggtcaatagaacaatattggaatggtggtaatacgaggaaatagtatcatcatgttagaagccttggaacgagtataaataatggctgttcagcagagaaacccatgtcctctctccatagagcctgttttactatgatgtaaaaattaggtcacgtacattttcatattagactttttgtgaaataaacttttgtaatagtcagaaaaaaaaaaacttaaataagaactttaaatattttatcacctcaaaatcaatgccatacatttaaattcctttgcaggagaggctcaatacaaattcctgctgctcccacccccgccattacctattcccgaaacacccttgctctcaggagaaccctaacccggcaggcattgggtgggtgtgggcttctaatacaggcatcagagaatgctgggaaggacccctaaccttgtgaagttaaaaaaaatgaaaatgttctattcattcagctctactctacatagcaatatgactttaggctagttccttaaccgtcctaggtcagtttcctcaactgtatacaattatgactggattaaatgactgtctagctctgccacttgagttggtgatataattattttgagaaataacatcaaattgctagcttcccaacactcccattttttaagattccattggacataataataaagatattcaggcctggcactgtggctcatgcctgtaatcccagcactttgggaggccgaggtggtcagatcgcttgagcacaggagttcaagaccagcctgagcaacaaggcaaaaccctgtctccacctaaaatataaaaattagccaggtgtggtggcacatgcctataattccagctactcggaaggctgaagcacgaaaatcacttgaacctgggagaaggaggctgcagtgagccaagactgtgccactgccctccaacgtgggtgacagagtgagactgtctcaaataaaaaagatattcaacattccagcaattcgtttccccaaataagtactccatatataatgtataatgccaatctaatggcataatagaaggtaagtcaaacttcaggatggctactgagtgatcatatggacaagaccagctgagtctagctacagaaaagttctgttatagctcatgtgcattcactcaacaaatattgactgaggactcgcgatgtccaggacactgttccagatgcttcagttttactggtagatgaaacagacaaaaattccctgccctcatgttgcttacattctagtaggagtcagaactaattaataatactatgttaaaaagtgataagtactataagaaaaaattaagcagggggaggcaggagtgtgtgatgtcagagggagccattttaattaataaggtgatcacataagccttgtctggagtttagcctagagttctatgctagtctcagttttattggtaataaaatatgtacccttaggcaaagaatatagattcctgtgccttattcactcttcagataaatgggtaaagtcataaaccccactccttgccaacaactcacttcaggagtaagaactcttgtttccttggaagaagattgtgtctacatctagggtaggaaaaaaaaatcaatagaatccagaacattctgttgttgtcagaaagcaatgatgctttcaagaatgtcaacacaatagaggctttcaagggctcacacaaagccagactgtgacaaactgagcttcaaatatgtaatagctacattgcagttaattggaatatattaaacctatgaaaggtcctatgttcatggtgatactctaaggctaaaaggtaatatagagtgttgataaacgtagttgtaatataaaaggataaagtaatagaatatatgctgtattttatttatatatttatttatcttatttttatttatttattttttcagatggagtcttgctctgtcgcccaggttggagtgcagtggcacaatctcagctcactgcaatctccgcctcccacgttcaagcaattctcctgcctcagcctcctgagtagctgggattacaggtgcgggccaccatgcctggctaatttttgtatttttagtagaggcaggggttcaccatgttggccaggctggtctcaaactcctgacctcaggtgatccgcctgcctcggcctccccaagtgctgggattacaggtgtgagccactgcg

SEQ ID NO: 13652 - DNA, 28216 bp, Human
  misc_feature (1)...(28216): n = A,T,C or G
ataccacaataatgaaagccattaattatagggaaaatggaggggttaatatgggtggctggcttttgctatttctagcagctccattttatctacaaaagacaaacattcattaagtcccaaaaaggtaaagaatgacaaattaagcatgtatcttattagtaagagtaatataaagatgctcactcatatttataaatatttgacaatcatgttaaggccagaaaagagaaaaaagggtaggggcaaaaaacgcaaagagaaaggagttagtatcttttctcccgcactcattagctattaaaagaggatgtttgtttaaagctgctcagagctggtaaactaatgttaagtcactaacgggaatttaaaaggtttcattaagaactgcctgcactagattcctccaccctgagacattaaacaatcacgataaacctcctgagtggtaagaacgtgtccatttaaaaacaggctatagattgtcatgcagttttatctactaatcggctaatgcaccgccaaaaacaaacaaaaaaacccaaagggatgaaagtttcatccatcaaaggaaacaacagtcaccttggttcccatcccactcatatactgccgccgtacatgtcaatcagatgaacctgtgcgtatctcttaacgacaattgacccacctttttaactgaagtgaaggggggttctgctccgcgaccacttcctggatctctcccttcaccctctgtgttctttcgggtgcaccatcgggtcaaagccgcagcaacgccgtctctgtgtgatcgcatgtgcccttctgcacacgaccttcccccgagagtgaccagctaccggacaggcaccaaggagggctaccgagcacctcccggaccggcggctgcaggatcgcgagcgcctccgctagggagaccgcacgttgcgcctgtgcttcctgcggtggcgccttctgcaaggagacctcgaccctgctccctctccggggctggatctgactccttgacggtgattccagacgcgagacccaaactgacggcttctagaagaggggcgagcccggccgcaagtctttcacgtagctaagtcatcgttgcttccggcttcttaccgttctcccctttgtaaacggttacctcccgaaaacccaggctctcctccaacagtggttctcaagcgaggcgatcttccccgggaggggatatttggcaaagtctgggggcatttttggttcactggggctgctacttgcatccactgggtagaggcgggggatgcagctacacaacctgcgaagcacgggacagcaccctccccaacccagacagaattagccggcccaaaacctcagtagtgcccaggctgagaaaccctgccttaaacaaacaacaaagaaaagccaagtcccataagtgggtcaccgcgccgagactggggtccacgggacaccccagccacgccaagccgggaagtccccgcctcctggagctgaacccgcccctctcccagaggtggagctgcggggggcgggaacaggcacggagaaaataaacaagactaaaaagtcctgagtagcgctgtgtggccgcaaacctgaacccaccttttgcaccacgcgggacccggcactcttcctgccacccacccctgagagggctgcgcggccgaccccagtactagaaaacactcgtcacctcactcaagacgggtacgaaggccaacggacgccttcctttagaacgctcagcacacagagcaacttctcacgcctactctcaaatggcgtactccaaactagcactcccgacgtccagctgtgaacccagagcggcggaaagcccctgaacccagcgcccgggcatgcgcagacgcgttgttgtggtgggcgtggctccctccggacccggcgccccgccctccgccccgtgtccgcatgcgcgactgagccgggtggatggtactgctgcatccgggtgtctggaggctgtggccgttttgttttcttggctaaaatcgggggagtgaggcgggccggcgcggcgcgacaccgggctccggaaccactgcacgacggggctggacgtaagtgtcgggcggggagtgggggtaagagagtagcggccgcaggctggagaggcctcggagccggggccgtctgacgggctggtgcccacagcacaggctcgttgccgccaccctcccggaagccgcagacccgggctgagccgccgcggacctctcctctcctgggtccggcggcgccaggagaaggcgacggcgtccagaccccgccaagacggagaggggaccgcgccctcccccgggacaccccaggatccctggaaaatcccccgatcccccacttcacagctggacaagccgaagccccgagaaaggagcgtgacccggccagctccctcagcgaggggtgccccggctaaaggtggctcccccatcttccagcggcgtccctcgagacctaaaagtcccagagtttggagggcggggtctggcttgagcgtaccagtcgtcgtgcaaagaaaaatggattcggggtggggccattgggatgaaccgaaaataacacttattgaattgcagttcttcccggggaagaatcaaatgagtgaatttcctaaattgaacttgtcccaaaggcatcttagcattggctgtaatcatatattttaatatttaatttttaaaagagaagttaaaaatgggagacgttgctctattgtagggtgtcatatttttggacaaccataattgctggctacaaagtatcttaaggaagtcaagttcgctgtaggagtttgggtgttgttattcgcaagttatatgtatttcaggctttttcatactctgaaatagagataacatggctgtatctcaggtctctactgctcggcttacaggaatgttttatataatttgtaaagacagcttgggtcggctatatttaaatagcagttggatttttgtaatctgaattactattaaccacgattctgtgcttgcttttggctggaaacacccgttaggatcagagatagggatattaaagtggatgttctttatatagaaatgacaccaaaaggcaggcttgcagaaagaaaaataatgaatgaagtgaaaggaaatgatgtgggtagaggtaagaactgcagtgcagtgtttaatttcttgatttaggtgtgaagaaacacacgttctgtgataaaatatgtaaattagagaaatatttttcatttgaatctgtaattccactcagagccaaagtttatcacttgtctctctactaatgttagtgctcctggactgtaaatatcaaattcatttaataagtttggaatcaaaatgatacaaaagagctcctgtggattagtaatcatatacttggtattaaaagtaccacctaaactaatttaatacctacttagaaataataggatgtgacagattttcaggaggaggtcaaccagtagttaaaattttttcaatatttggagacccacctttgttaatactgcttaaatatatccaaaccatttatttctatttatttattattatttttgagacagagtcttgctctgtcgcccaggctggagtgcagtggcacgatctcggctcactgcaactttcgactcccaggttcaagcgattctcctgcctcagcctcccaagtagctgcgattacagacatgcgccaccacccccggctaatttttgtatttttagtagagatggggtttgccatgttggccaggctggtctcaaactcctgacctcaggtgacccacccacctcagcctcccaaattggtaggattacgggcatgaaccaccacgcccggcccccaaaccattttttacattaaaaaagatactaaatgaatccagatattactttccaaagttataatgtggaaattcatcaaaaactaaatcaaatattctgaagaagtatgtggaaccaaaataaagcatttgtaatttcacttttatctaattattcctgagctattaattatttttcgggcttgaagcaagtaaatggaagtacttatttaattgtttgtttgtttgtttttaagtgacctgaaaaaaatgtctggatttctagagggcttgagatgctcagaatgcattgactggggggaaaagcgcaatactattgcttccattgctgctggtgtactagtaagtgtcattgattatttgggccttattttttggtgcgtttgtgtttatgggttttgaattctgcaggatgttttaaaatatgtactatttattttatctttgaccactttgaccatgttgatattttgttgtttgtggagagttattagttccactttaagagtttatggtttaaaatttgattaacaagtggttgggttgttttaactgcatggtaaaaatggcataataaaacatttgttcattatatggattatatctccttttaatgagtatattaaggtacaaggaagtgtttaagacgcagtcaggtcaaaaccagtcaatagatgtgattgcatttctccataatccagttaactttcttctcagtctcagggaaaaaaaagtgctcgctttggcaacacatacactaagattggaataatacagagaagattagcatggccccttaaaatttttttttaaaaagcaaaaacaaaaaggaaactcattaaaatacattgtgtggaagtaatttacagaataaaattcttatttacacttcagatccctcaagggatctgctattagttttttatgatcatatggtgtcgtaggctctaaagagtaattttttatttttattttttgagatagagttttgctcttgtttttttgttgttgttgtttttgttttttttggttttttttgagacggagtctcagtctgtcgcccaggctggcgtgcagtggcgcaatctcagctcactgcaagctccgcttcccggggttcacgccattctcctgcttcagcctcccgagtagctgggactacaggcgcccgccactgcgcccagctaatttttttgtattttagtagagacggggtttcgccgtggtctcgatctcctgacctcgtgatccgcccgcctcggccttgcaaagtgctggaattacaggtgtgagccaccgcgcctggccttgctcttgttttagtagagacggggtttctccatgttggtcaagctggtcttgaactcccgacctcagatgatctgtctgcctcggcctcccaaagtgttgggattacaggcatgagccaccgcaccaagccattttttcttaagctttaagatttatttattttcgagacagggtctcactctgtctcccaggctggagtacagtggtgaaatcactgctcattgcaacctcgacctcccgggctcaggtgatcctcccacctcagcctccggagtagcctggaccacggatgaaggccaccacaccgggctaatttttgttttttttgtttgtttgttttttttgtagagatgaggtctctccatgttgcccaggctggtctcctactcctgggctcaagtgattcactggccttggcctcccaaggtcctgagattacaggctattgcacctggccaaaaagctttgagtttttagtctatgaagaaaatatcttaaatacattgagctgagggtaaaaagaaaggcatatgtactcatgctagccattaaaaatgttattaatcgagtatggatctgtctgtaacctgataaaagtaatttgactagcctaaaattgttactttaaaataattgccagaagatgtcagttgccagagctaactgagtcagggtttggtgtggggataggaaaggaaagggggttacttttaaaatcttctaggctacttgtcagaatttggttaatataattttattgtaaatatctgctcagatgataaaaactgtttttgaagttttggcgttattttgttatacctttgcccttgataatatctagagccaaattcaattagataaattgtaatctggtgtttaaattaaatttaaaatcacacctgaaaccatatttagactgcactggaattcatcaaaagcagaacctcagagctgttatttcacaccaagaagatagctaaaattctgtgaacaatagttgttctccatattaatttgactgcttttttcttgattttggggaatatttctctggaagtttatcatatatcaacaggacacttctgtcagttggaattggagtcacttttttcctttccccctccatgagataactggtttctagttcaccaaattagattacaaggctttattatgataaaaattaaataatgattgaagtaggcttagagaaaagttatgttaataaatataaattgctctcagatttaagggtacctaatcagttattaggccatgtgcaaattacatgtgggaaaaagctagaacatttttgaaatgtattaaaagggatctcctcacttaaataccttgcttttagccagtgagatacagaattgctatgatttctcattggtatcacctttgttttagttttttacaggctggtggattatcatagatgcagctgttatttatcccaccatgaaagatttcaaccactcataccatgcctgtggtgttatagcaaccatagccttcctaatgtaagtgtcatcgtaattggcattacttacatagcttgccacaaaataaaaatgtttcaaatatagttgcatagatttaaaattctaaatattatcagattaacacactggacatgatttaaaagtcacacagtagagatggacttatacagaaaagcagcagtcctctttattctttttgtgtacctctccactccctcccagcttctctcagctattcttttattttatacccccagggtttatagctttatatttaagtccgaaactgtgtattttgtctaagggataattctttcaacaatatttattaagcttttatattccagactctgctctaggtacaggacatatagtagttagtaaaacaggaaaaatccatgtctttttgtcatttaaaataagtgcaaaggagaaaaaatagagaaaggagatatgtgcaaataagtgcaaaggagaaagggatgtcaataggagggatagaaattaaaaaaattttttttttatagagagggtgtctcattatgttgctcaggttggtctcctgggctcaagtgatcctcccacctcgacctcccaaagtgccaggattacaggtgtgagccaccacacgtggccagaaattttcagcagagtcagagaaggtctcactaagaaggtgactttgagtaaagacttgaagaaagtgaaggagctgaccaggggatggggatatataagagaggttcattccaggcaggtgaaacagcaagtacaaaggctttacggcaaggagaccagtataactgcagtagcaagatcaagggaaagagaaattgatgaggtcaaagaagtggtggagagggacagatggtatagggccttgagaagcattataagaactttactttcagctggatgcagtgactcatgcctgtaattccagcactttgggataccgaggtgggtggatcacttgagctcaggaatttgagaccagcctgggcaacatggtgaaacctcatctctaccaaaatacaaaaattggtagggcatgcctgtggtcccagctgctccggaggctgaggcgggaggattgccagagcctgggaagtcaagtcgatgttacagtgagtcatgattgtgccactgcacttcagtctgggtaacagagcaagaccccatcacaaaaataagaactttactttcattgtaagtgtaatggaagccattggaaggtttcgagcagaggaatgaaatgaccttatattttaataggagcattcctgttgaaaaatttttaaaaccggtaaacaaaatttattgcagtgccaaatagtataagcaccatgactctgtgcttctcaaatttatcaatgtattttgaaaatattcttgtattcttaccagtttctcaaattcataaaatcgtttagtttgcttcatacttgggctgtgactttgttatttagtattgttttttcctatagttttttttttcttctttaattaagacgaggtctcaccttgtttgccaggctggtcttgaactcctgggctcaagcgatccacctgccttggcctctcaaagtgctaggattataggtgtgagccactgtgcccgacctttcctagagtttctgattgtttttttttgttttttgttttttgtttttttttggtggttgttggtagaaagaatgtatattttctttaggattcattttattcttcttgaatgctgcagttctaatttggacagttactatgtggaatgtagtagccttgttcagttttttgtttttcctagagtttctagctgccttttctttgttttcttgcattttctactattatcacatctttatttttttcccaaattctcaattatattctttaatgtattataacttcttttgttttagaaatcaacatcccagaagcccgtatctgtctgtttcattatgaattaatgactgtgtaagcctgctgcagcactgtcaccatgggacttccctcccctgttgatcagggttgaatccactgtttttccagttaccacatcttcttttttttttttttttttttggatacaagaagtatttactttggccgggcatggtggctcacgcctgtaatcccaacactttgggaggccaaggcgggcagaccacctgaggtgaggaatttgagaccagcctggccaacgtggtgaaaccccatctctactaaaaataatttaaaaaggctgggcgcaatggctcacgcctgtaatcccagcactttgggaggccgaggcaggcagatcacgaagtcaggagatcgagaccatcctggctaacacagtgaaaccctgtctctactaaaaatacaaaacattagccggctatagtggcacgtgactgtggtcccagctactcgggaggctgaggcaggagaatcgcttgaacccaggaggcggaggttgcagtgagcagagatcatgccactacactccagcctgggcgacagagtgagactctgtctcaaaaactaaaaaataaattagccaggcacggtgttgcgtgcctgtagtcccagctactcgggagcctgaggcacaagaatcacttgaacctgggcagcagaggttgctgtgagccgagatcacaccactgcactccagcctgggcgacagagggagactccgtctcaataaatttaaaagaaaaaagtatttatttannnnnnnnnnnnnnnnnnnntgagaaaagagtatgtgagatttcgagaatggtgtgaaacaaacaacgaagaataattgatgagttgtagaagaaattttggtacgaaatgtatcaaaacagaaactgatcattctaaggtagtgaattcttccattatgttcaactgtgctattaaccaccatattcccaacaaccttaactttcaagtactgaatacacatgtgacttttaaaaagttaccagtgtttactatgtaaccattatatgtctgattatttatttttttttttgagatggagttttgctctgtcgcccaggctggagtgcaatggcgtgatcggtgctcactgcaacctccacctcccaggctcaattgattctcctgcatcagcctccctgagtagctgggattacaggcacacaccaccatgcctggctggtgtttgtattttctgtagagacgggtttcaccatgttggccaggctggtcttgaactcctgacctcaagtgatccacctgtctcggcctcccaaagtgctgggattacaggcgtgagccaccacacccggccgatatgttttcttagaattctcatctctttatctttttattttatgttccaatctgttaaacatttttgcatttcagttctcatgttttaatttctaagggcctttgtttccttaattatgaatgcttcctttagggatcaactctctctgtgggcctttcttttttttcttttcttttcttttcatgttagacgtgtaaggtgctgatgtaagaacaaggtttgagggaggcacatctcaaacatgcacatgaacacccaatcatcgtgcctaagaactacaaaagaatcaggttttccttttaaattaaaaaaaaaatgttttagaagtagggcctcgcttgtcacccaggctggagtgcaaatggtgtgatcataacacactactgtctcaaaatcctgggcttaagcagtcctctggcctcagcctccccagtagctaggactacttgcacataccaccacacccagctattttttaaacagtttttttgtaaagacaggatctcactatgttgcccaggctgttcttgaactcctggtctcaagtgattctcctgccttggcctccgagagtgctgcatgataggtgtgagtcactgtgctctctgcctttattattttaaaaatgtaatataaaatgcattctggccaggcatggtggctcacacttgtaatcccagcactttgggaggccaaagtgggcggatcacttgaggtcaggagttcaagaccagcctggccaacatggtgaaaccctgtctctacaaaaaaatacaaaaatcagccgggcatggtggtgcatgcctgtggtcccagctactgaggaggctgaggtggggaatcacttgaatctgagaggcagagattacagtgagccaagatcacggcactggattccagcccaggagacagagtgagactctgtctcaaaacaaacaaacaaacaaaaaacgcatttagtgagatacataaagtgcacaagtcatatatacatctcaacaaatttttcttatatatacacccatgtaaacagcatctagatcaagatttaaaacatcaccccagaacattctcaatcagcacttccatcacacctgtatagcccccatcctgacctctaccattgtccatcagctttctgtagacctttttttttttcttttgagataggctcttgctctgttgcccaggctggagtgcagtggcatgatctcggttcactgcaacctctgcctcctgaattcaagcaattttcctgcctcagcctcctgagtaactgggattacagacgcccaccactgtgcccagctaatttttgtatttttagtagaggaagggtttcaccatgttggccaggctggtctcgaactcctgacctctcaggtgatccacctgccttggcctcccaaagtgctgggatgacaagcgtgagccaccatgcccggccttctgtagacttttaatttaggttgtagagtcatctcatacaggcttccaggtaatccaagttgaaaattacacacatttttaaattttgctacagttacttaagtgtaaacacagtaacttgtattttcagagtaaagcaagtggctaagggcagccagtttgactgtgcctggcatggagtcagtgccagagtagttattcattcgcagaagtaaaggtctgacttcagaagccactgatagcaaagggctgtggtctttttctttgaagttcagccagtatgcagctatttctagttctttccatcttgttgcaatttattttaccgtaataatgatgctgttagaattcttttagaaagctgacacctaaatttcaacattggtttagatttaaaagttttatttttgtgattgtatttttgtcctgcttttgttctcagatctttaaaaaattattttgttccattttgaagcagtagcaagtctgactatggaggggaattatagctgtatatgagcttgaatgtactattcaaacgtgtttcctgctaaacttacattctgttgcattaacataattatagcagagctgacttcatgtctttataaatgtttatcatctatttggcttcagtttacatctttttattatagtgtcagatagtgtcaggccataattttaaacaaaaactgttagttaattataattcaaatggataggagtcaaaaagcagctattctttcattaatgactttattattttttctcttattacaaaagttctctgattttgtggctttaaaaatattaataaatgttctgtgtattactctgtattttttaattttaaaaatgtagggtaggccgggcacggtggctcacgcctgtaatcccagcactttgggaggccgaggtggaaggatctcgaggtcaggagatcgagaccatcctggccaacatgatgaagccccgtctctactaaaatacaaaaaattagctgggtgtggtgacacgcgcctgtggtcctagctactcaggaggctgaggcaggggaatcgcttgaacccgggaggtggaggttgcagtgagctgagattgtgccactgcactccagcctggcgatagagcaagactccatctcaaaaaaaaaaaaaaagtaggatatgccaataagcaaaaacgaagttgcctataatctcaccaaactataacattttgacagatattctaccagtgttctcttctgttttctctttctctaacacacatctatatgttttaaaagtaatatttaactcttctccacttcctttcctcttcctggaaaaattcagtccaaaaactattaggtgaggtcaagcatgagaggcatcctctatagaaagacaagttgtggtggcccagagcaggctgctgggctcaggcagggtgggaaggggcagctcagcatgggctcagatcctgagcagggtgaggaggggatccatgcagcggagcgtgggatggaagaaggcagccctacatgggatgctggagtctgagcagggtgaagaggctgtccagatggggcaggagaagcagtgtggcagctctgtccgctaagagtgcccagaacagctacaccccaacaccaggagcacacctatagcccccagttatggagcatcatgttgacaaataccagacgtttcagtaaaaagattatttaactagtaacttttctataaattggagaacatacataaaaataatcatagcagagaacaaatagagattgttcattccaaagtgtccctaatagtgaagacaggattgtggtggctcacagagggctctgaagtttattcagatggctcagcaaggaaaacgagctgagaaccagtaacccaagaacatttatttgtgttttacttttatatatgaaacctgtttttaatgtatctattttatatacaaaataatttagtactgtacagagatcactgaaaataattgagtattttgatcattctgaaacttagatttgtatgaataaattaagacatcatattactgtgaaaaaaactaggattcctatattcacttttttttttcatagatacaaggtcttactatgttgcccaggctggtctcaaagtcccgggcttaagcaatcctcctaccttggccttccaaagtgctgagattactggcacaagctaccaggcctgacctaaacacatttattgagcacctactatgtgcgaagcccctagccttgtgctaggcattgagaatgaaaatgagaaacaagacagacaatggctcctgtcctcatgaagcttatattctagtgttagacacacacaactaaatgggtatatatatcataggtataatgttttgtaactttaacttgatgtattgtgaacgttttcccatgacatttggaatgtttcaaaggatacttctaaagaaagcaagcctatctcaatttagagtggtatgctatgaagagttagtaaaacaccttatgtttagagcctgtatcaaggatttaaaaaacaagattttaccacttgaatctctattcgataatatcttcagagcaaaaagttattgtattgtttgaaatataattatttctccaaacatttgatatcagtacaaaattactacaaaaaaatttattccaaagccaattttaagaaatatttggattatccagggcccattttctccctctgccattgccatacatgagtacatgttatgtctgatacatacaaatggaatatcagatagaaccaagcaaaattatctttttacctgttccaatcttagcaaaagaaaattttgagaattttgttcccgattttttttttaagagacggagtttcactcttgtcgcccaggctgaatctcagtggcacgatctgagctcaccacaacctgtttcccgggttcaagcaattctcctgcctcagcctcccaagtagctgggattacaggcatgtgccaccatgcccagctaattttgtatttttagtagagacggggtttctctgtgttggtcaggctggtcttgaactcctcacctcaggtgatccgcccaccttggcctcccaaagtgctgggattataggcatgaaccaccacgcccagcctcgttcccaaattttaacaatccagactcacctgaaagacttgttaaaactcagatttctgggccccatgcccagagtgtctgctttgctaggtttgggttagggccaagagaattttcttgtcaaataggttgccaagtaatgctgattccgctagcctggggcccatgaccactgctctagagagtatctggctgggcgcagtggctcacacctgtaatcccagcactttgggaggccgaggcgggcggatcacaaggtcaggagttcgagaccatcctggctaacacggtgaaaccccatctctactaaaaatacaaaaaaaattagccgggcataggtggtgcatgcctgtagtcccaactactcgggaggctgaggcaggagaatggcgtaaaacctgggaggcagaggttgcagtgagccgagatcgtgccactacactatagcctgggagacagagcgagactccgtctcaaaaaaaaaaaaaaaaaaggagtatctggttgaagagaccagtcatatgaactctttactcaagaactgaaggcttatgagccaggtgtagtggcactttgggaggtcaaggcaaggaggatctcttgaggccaggagtttgagaccagcctgagcaacatagcaagactttgtctctacaaaaatttttaaaaattagctgggtgtggtggtgcacacctgtaatcccagctactcaggaggctgaagtgggaggatcacttgagcctgggatttcaaggctgcagtaagccatggttgtgccactgcattctagcttgagcaacagagtgagaccctgtatctttaaaaaaaaaaaaagactttcaggcctaaccttacatttgagaaactgtagattattgtttctggtaattggtgtcatggaccctgatttcttggttttattttattcatacaggattaatgcagtatcgaatggacaagtccgaggtgatagttacagtgaaggttgtctgggtcaaacaggtaaataggtgcaaacagcatcttattatacatgcttaaatccttaagatgagaatttcacatggaaataccacttttctatttgttttaatatatctgtgagtaacagcttattattttgaatctattgttttatgttttgggcttgaaattgggaattaatatataacattctatttgccgtgctttattgagtgtaggcagtgtttttattaaaatgtatttatgcaaattaaagaggccctatcagaattcattttaggcagtcatgactccatttatttatagcaaatcttcataaacatgttaatgtgatttgaaagttgcctgtcctcctctgttaacataattttaatgcaaccttcctaagttctagtcacagtaaatttgaatttattttgctgcctaacttccctgaaagtgaaatatggtagcttggagattcgtatgtcactgaatatgaattttttactgtatgtctgtgttactgtttgaaagtactcttggaagatctgggagcggccgggcacagtggctcacggctgtaatcccagcactttgagaggccaaggcaggcagatcacaaggtcaggagatcgagatcatcctggctaacacagtgaaaccccgtctctactaaaaatacaaaaaatcagctgggcgtggtggcgggtgcctgtagtcccagctactctggaggctgaggcaggggaatggcatgaacctgggcgggtggagcttgcagtgagccgagattgcgccactgcactccagcctaggagacagagcaagactctgcctcaaaaaaaaaaaaaaaaaaaatgtgggatcattgtctatataaaagcataaggagaatgagcctctaaatatggtgaaacagattttatgagatgttttataggaaggttgagtataggttttctcagtgtaggcagttggggaaagtaagtatatgcacttatacagactcataaataatttttaaaaatctatacagaccaaccaagaagaaaaaggccaacaggtacactgatgaagatgtttaacacatcctttactgttctcacgttagactttaatggcagttgcactttttttttttctgtttgggttttattttctttttgaaagttaattgtactgccctataagaaagaattctggtaaaatattatttctttgaaggtgctcgcatttggcttttcgttggtttcatgttggcctttggatctctgattgcatctatgtggattctttttggaggttatgttgctaaaggtaagagaaaacataggttacaatttacttcagtggaatactggaattttgcattaaagttggttattttagaataaaatttttttcctatagttgggccaactactagcgatgcatttatatccgggaccccccaccctccaccgacagtgtttggttttctttgtcttatatatttttagtattcctttcttcagtcatttttcttcttatccagagcctggaagggatgagacagctctaaacactgcttttctttggcttccaaaaatctcaaaagcagaacatatgttatctagctagttagcaagctttgtttcttttttagagacaagagtctcactatcacccaggctggagtgcaatggcatgatcatggcccactgcagcctcaacctcctgggctcaagccatcctcacacctcagcttcccaggtagctagggccacaagcacacacaaccacacccagctaatttttaaattttttatagagatggatcttgctatgttgctaaggctggccttgaactcctggcctcaagcctggcctaacaagttctgactttcagaatatctgtgcaaagctctaacatcccagaattgagatttattcagttaagcctccctggtaatatgatgtcacctcctttcagacagaaaagtaaactaacatttaatatacatctgctatataaggccactttaaggcaagctcaggaaaaggtatactgttagaccctgggagaaatttcaccttgagggaccctagaaaaatagaaaacccatttaatggtccaggtaaaattgctatgggtgtcatagtaaaaatacagtattaatgatttataaaaactggaccaggttatatatattctgctcatattttaacacttatttgaataaaatgtaacttgtagattaaaataatgtttcctaaatttttattaaaatcatttaatctcatagatgggagtaatagatatttccaaatatttgtatttttaattttattttaattattttttttattttttgagacagggtctgctctgtcacccaggctggaatgcagtggcacaatctcagcttactgcaacctccacctcccaggctcaagcaatcctcccactcagcctcctgagtagctgagatgacgggcgcatgccaccacgccctgctagttttgtattttttgtagagatggggcttcaccatgttgcccaggctggtctcaaactcctgggctcaagtgatctgcctgcctcagcttcccaaagtgctgggattacaggtgtgaaccactaggcctagccatgtgtaatttattattaaaatcatgttaccaaaattgtagaaaataaaaaagggtgggtgcagtgtaatcccagcacttcaggaggccaaggagggagtactgcatgaggccaggattttgagaccagcttggacaacatagggagacaccatctctacaaataataaatatttagccgactatggtgacgtgcatgtgtggtcccagctactcgggagactgacgtgagaggatcacctgagcccgggaggcagagattgcagtgagctgtgattgtgccactgtactccagcctgggtgacaaagtgagacgctgtctcaaaaaaagagaaaagaaaagaaaaaaagaaaaagaagtaataataatttcaccactcttcaatattttggtttatttccttttttcttatgtttttagttattatcataatttttatcccccgtttgcatttcacatgatattataagttagttgttcttttgctgctataaaatctgttttttatatgtatatttgttgcccaggctggagtgcagtgatgcgatctcagctcactgcaacctccgtctcccaggttcaagcaattcttctnnnnnnnnnnnnnnnnnnnnnnnnnnnnnnnnnnnnnnnnnnnnnnnnnnnnnnnnnnnnnnccacttgtactccagcctgggtgacaaagtgagacgctgtctcaaaaaaagagaaaagaaaagaaaaaaagaaaaagaagtaataataatttcaccactcttcaatattttggtttatttccttttttcttatgtttttagtcatcatcataatttttatcccccgtttgcatttcgcatgatatcacacacctccaatcccagctacttgggaggctgaggcacgagatctcttgaacctgggaggtggaggttgcagtgagctgcgatcacgccactgcactgcagcctgggtaacagtgggagaccctctcaaaaatcaaaacaaaaaaaaaggaaaaaaattaccttgttatcatgggaattgcataatgcttattcattatagaaaactaagaatataaaagaactcaaaagaagaaaatgaaattactgataattctttcccagatacaactattaatacagggtccctttttataggaatgtctttatctcataattttaggctattttcctgaaagcttctggagcaaggttatgttttgagaattattagcagcagatctgtaattttataaagttggctttataacatttttagaagccattctagtggtaatggttatttaacgtgaaatagtggtgaagacctatgcaaaccatctgttatgttaatcagattaaccaaagctgttctgaaatgagaaaaatttgacagttcacctatttattgtgcctctgtcaatgagcagtcattaacaattccagtagtagaaatttatgagaatttcaacttcacttctagatacaatcagaaaaaaatgttgctccagcagtccttccaatcttagttaatggctggctactctatctttccaggtgtttaggccaaaagccctggatggtgaaggcctgtcaaagatgacatttgtcttcctcccacgccccatatccaatctatctgcagatcatgttgactgtgctgtaaaatatatcctgagtctaaccaccatttaccatctctccattgctaccaccctggttcaatccatcataatctctcacctgatttcctggaagagcctcctaactggtttctgtttcctctcttgcctcctttaatctaccctcagcacagcagccagagggatcctcttaaaatatgtcatctcagatcacttttctgctcacaacccagtggcttctcgtctcactcagagtaaaaatcagagtcctcactgtgactgccaggtctctgctgcccagttgccctctttctttaccctgtccctgctcttccctcttgtgcctacgtggctgttcctgtaattcactggcgtgctccctcagggcgtgtgcatggcttcttccccacttcctgcgtgtccttactccagtgtcaccttctcatggggtcttcctggccatctgtgtccaatgtcacactacacttctccacctttcctgcattattttatcttctttttattcagtatattctctagttccatgagggcaaaaaaaattttacctgttttgtttattgcagtatcctcagtattaaatagggccagcatacagtatgcccccagtaaatatttgttaagtgaactaagggagctatcatttactaaagccatgctagactctgttacacattatgtcttttaatactcaagccaaccctaattctaagaaaaatcaattcttctaggcaggaaaactggtatttgccaatatatctgaaactaaatgttttgagatcataaccctctaaacactgcaattatttttacagaaaaagacatagtataccctggaattgctgtatttttccagaatgccttcatcttttttgggtaagtttgttttgcattctttatgtttgtttgtttttttttaaaatagcttcttttatatcattttctatatttagttgcctaattactcatccaatgcccctcccccatgatattttcataaaacatggagagtaaggttgagaaggatattttaaatagatgagttggtttgctgccaaccttaggagcatatattaatttttaagattgctaccacgcccccttttaatgagtgagtaactatgattcatgaaaatttagttacataacactggtgatgttcattttaaacttagatctctaacagttgctttaagtgaaagcctgcctaaaaccatttatccttaaattttggtttctgatatattttataattcttctgtccttgatatcgtagagtttgtgagtgagatttgaggtgtggaggaaaagcccaaacatttttttatccttccctttcaattacaaatgaaaagatgacgaaaacctctaaaaacctcaaggcttttatcagtaatcttctctgatgttcatctttcctagaaatttagggcctgcccttttctctacccatgctgttcctccaaccagcccccacaacctacccccatcactggccgaaaaaccccacaaacaaaacagctcaacagctcttaatcctctgtatcaggagtgtgtgtgtgtgtgtgtgtgtgtgtgtgtgtgttgtgtgtgtgtgtgttgttttgagacagagtctcagtctctcacccagtgtgtgtgtgtgtgtgtgtgtgtgtgtgtgtgtgtgtgtgtgttgttttgagacagagtctcagtctctcacccaggctggagtgcagtggcacgatctcagctcactgcaacctccgcctcccgggttcaagtgattctcctgcctcagcctcccgtgtagctgggactacaggcacacgccaccacgcctggctattttttttgtatttttagtagagacggggtttcaccatgttgtccaggatggtcttgattcctgatctcgtgatctgcctgcctcagcctcccaaagtgctgggattacaggcatgagccaccacacccagcctgcatcaggagttcttttttttttttttttagagggagtctcactctgtcgcccaggctggaatgcagtggcgtgatcttggctccctgcaaactctgcctcccaggttcaagtgattctcctgcctcagcctcccgagtagctgggattacaggcacctgccagcacgcccagctaattttttgtatttttagtagagacagggtttcaccatgttagccaggatggtcttgatctcctgacctcgtgacccacccgcctcggcctcccaaagtgctgggattacgggcatgagccaccgtgcctggccaagagttcttaacctttattctttcagtagtcttctgaaggtgaggtatcaccagacatttccatatgcaggaaattggtgttttgtgtatttctggaaagagatagtctgtggctttcatcagattttcaaagaagcccctaatccaaaaaaggctaggaatctgatgtatattacaggacctttccttccccttcccttcccacccacctccaaaaaagaaacaaaaatcccatgtttactgaagccctcttgaaatagtaatagttgcccttcagaaagagccaccagttggtattcacacctattctattccatcaccaggcatttttgccattttgtaaaatcagtttggaaataaaaatgtaaacttagatgtgacaagatgcacagcctctttgggttataccttgtatcctgtaagcagattgaaccccaggtaattttgacagtgtaggagggactggtccctggctcttgcccaggaaactcttccgattagagttcatatcttgtgacgagtattctgaagttacagcatctcttttaagctatttggacagtagaggcctctaataaccaacttcagtttttctttgttacagcagtagatcctatattaactagaagagcagagatctgggattacaggcgcatgccaccatgcctgactaatttttgtattttttgtagagacggggttttgccatgttgcccaggctggtctcaaactcctgggctcaagcgatctgcccgccttggcctcccaaagtgctgggattacaggcatgagccactgtgtctggctcatagcccccatttcatttggtgcctgggactgcgcaccagctgccccatagagcatgcaggcaggcatccccatagagcatgcaggcaggcagccccatagagcatgcaggcaggcgtctgcactctggctcatctaaggcacctgtgggtaatttgccacccttggcaattggctttccaaagcctggctgtgtccattccctgcctcctcatggccaaccataatctggccatggtggattcttccttgttctgttaacacctcaggtatcattttatgcatacagttgcgctcttgcctcttttaaattgaagccttaaggacaactgtagacgttccctcaccgaaaccctagaccaggggtgtccaattttttggcttccctgggccatattggaagaattgtcttgaggcactcatagaatacaccaacaatagctgatgagctttaaaaaaaaaaaaaaatcacaaaataaatctcataatgttttaagaaagtttacgaatttgtgttgggcctcattcaaagctgtcctgggccacatgtggcccatgctttgtgggttggacaagcttgccctggactgtaagctctgtgagggcaaattcctgtcatactagtctcctgggcttttccagaagccccatgcttttttatgcctctttcccctttgatgtactgtttcctgtccccgaaacacctgccttcatcatcccgctaggtcttgttcctaccaatctcccattcaaacccctgtttttccacaaaagcccatctcacatattaccacctctgtaaatccttttctaacttattcagggtgaccgaattctgtgtttctgtgcccccttaatacttgttatataagtctccttccccaaccacccccacacttaccacatcacgttagcaagaatgagagcaatttgagggcagtggctttgtatcttatttatagccctggcaccaaaacagtttgttgaatgaatttgataaaatcagacgtatagggctgggcacagtggctcacgcctgtaatcccagcactttgggaggccgaggtaggcggatcacgaggtcaggagatcgagaccatcttggctaccatggtgaaaccccatctctactaaaaatacaaaaaattagccgggtatggtggcgggtgcctgtagtcccagctactcaggaggcagaggcaggagaatggcatgaacccgggaggcagagcttgcagtgagccgagatcacgccactgcactccagcctgggcgacagagcaagactctgtctcaaaaaaaaaaaaaaaaatcagacatataatggttacatagtaaacactggtaactttttaaaagtcacatgtgtattcagtacttgaaagttaaggttgttgggaatatggtggttaatagcacagttgaacataatggaagaattcactaccttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcatttccatgctagccatggtcatctgacagtctctacgctgtgaatattgcctggtgatcaagactctcctcaaagaaatgacttgctgtcatcccacatgaactcctgatgttttttctacaaaagtccataaaatgtgaaaactggagaagatcttagaggttgaagcccaccttctcttttcacataggagggaacagaccatggaaatttaaacgacttcctcacggtcacagaactagttttttaatcctcaggcagtgcatccccccaccctacaactgagcacaacctctttccccacagtgcaattcagaatatgctcagggaatgccagccaccttgtaaaactgctgggagaaaagcatgattcccacaaggactaagtatcagtgatttgtaattttcctgttttgtattatctgctttgctgatgtagacaagagttaactgagtagcatgctttattaagcatgagaaagaatcttaagaattgtcaataaaattaacccaaaactttaataatgtgtctgtaaccaagaaaatattgatagcatcatcctaatgaaactaaacatttattttaaacttattaaattgactcttaaactaagtttttagtctttaattttttaatatcaaatctgtctctgaccttgtttcattatacataaggagactttgctgtcatgagcgtttctcacgtacaaatgcaggcaacagtgagaggaagttgtcttgtttttgaacaggccttgtttttcttggatgcttttgcttaaaatccaacagccaaatgaggaaactgtaaaagcaaaacaaacatttttattgcagatgaacccacatactgattttggcttgatctcttgaaacagcctaaatgtctcattacaaagaccttagaaattctttcataaaatctgaattggaagagatcttggatatataggttttatttcatctaacgttttacatggattgttgataaatggccatctggcttttatttgaatgcctccaaagacagaggactcactactgccatatgaagtagctcattccatttggcagacagttgagattgttagaaatttatactgcacctcccctgggcctagttaaattctttggagaagtgtagagaaaaagtatttttcttctacatgccagttttttttttggttttgtttggttggttgtttgttttgtttgagatggagtttcgctcttgtctcaggctggagtgcagtgatgcaatctcagctcactgcaacctctgcctcccgggttcaagcaattctgcctcaaccaccggagtagctgggattacaggcacccgccaccatgcccagctaatgtttgtattttttagtagagacggggtttcaccttgttggtcaggctggtatcaaactcccaaactcaggtgatccacccgcctcgacctccaaaactgctgggattacaggcgtgagtcactgcgcccggcctacatgccggtctttcaagtgttcgaagagccttcttaggtctcctctggccttctcttctgcaagctgtgcatgcgctgagttctgaagtggtgccacaccacagcctaccatacaacgtcactgcatgtggcataaactgggaccacagaactctgaaaccggaaatcagggtagctaacacttgtttgctaacatttcacatacattatctcctttaaaccctaacaacacagtgagacagttactgttatctccatgtcagatgacgagactgaagctacaagatcacagagctggcagtggtagaacccagatctgtctgactccagagcacaaactcttagaacatgggatttgatctcattttatagaggaagaaactgagccccagagaagcgacctgcccaagggcaccagcctgccagtgggtgaactaggactagaattcagatctgcctcccagaacactggccctcaccgaggctaggggagtctgttggcaggctgctgatgtgttttcctagtttactttttttttccttttttttaatatatatattttttgagacagagtctcctcactctgttgcccaggctggagtgtagtggcaagatctcagctcactgcaacctccccccaggggttcaagtaattctgcctcagcttcccaagtagctgggattacaggtatgcaccaccacacccagctaatgtttttgtatgatttggttttgttttgttttattttgagatggagtctccctctgtcccccaggctggagtgcagtggcacgatctcggctcactgcaaccactgcctccccagttcaagccattttcctgcctcagcctcctgaatagctgggactactggtgtgcaccaccacgcctggctaatgtttgtgtttttagtagagacagggtttcaccatgttggccaagctgttcttgaactcctgacctcaagtgatctgcccacctcagcctcccaaagtgttgggattacaggtgtgagccacggcgcccggcctgttttcctactttaaaagctggctctccttgtgttgttgaacaagcgtttgttgggcccttactgtgtctctagaacatttatttg

SEQ ID NO: 13653 - DNA, 25131 bp, Human; identical to SEQ ID NO: 12385

SEQ ID NO: 13654 - DNA, 45226 bp, Human
ggtgggggtgggggtgttgctctgaagcaagaagagagaggagggcggcagaaaaggtcactgagactaagaactgttttccaaatgaatcaaacctttctctggcaccaagaagggacatacagtattccgagctctgcccttgttttcttatcaagttttctctaacagctggaagtggttgaagggggctgtcttaaggagaccccctgctcttcttttgacagctgatcaaaagaaaataggtcacgcttctcaaacttatgtccaccctgtccttaattactgtctctttaaacaaaggcaacatctgcgcaacctcagctagcttgaatcttcggaggcaaacagagcgcaacctgctttggaagaatcttgttacgtttaaggctttatgccgggtgttggcctctctgtcttcaactacccctccaccccgactcggactgcagaaatctccaactctctgtcccccagttccactcccacctccagacctggggttgccaaacaacggaaattctaggaagacgtaggtgcggtttttaaagccttggcttgtgagcgttctcaggctggccggggcgctggtcttttcagaaacaaggtttgaatatgcaggtgtcagccaggattccttgtcgtctgcccaccgccgtttctctcccgggatttgagagaagcgggagtgtgtgtgtgtgtgtgtgtgtgtgtgtgtgtgtgcgcgtgtgtgtgtctcgtgttaggagaaaggtccgtggttgccgtctcagctggtttgcttactctctgcccccaggagaagtttgctcacttgggacaccagcgaccctcctcacctccacctcaccggttctacactctccccacttctttccaagtcgctgatgcagaaagcacttggtcaccttgaaacggcagctcccggaattctagttttgttttgcaatctagcagggctcttcggaagcctcataactgagatttatgggctcaccgggtaattaaatgatgttattgtgttaactttgcatgcattactgctgcccgcgccgcccgtgggccgccggccggccgcagctcgctggcgacgagggcactacagttgctctgaccgcgtagattatgcatgtcccggcctcgggaatttaccatgcattagaatacattagcgcctgcattttaaaaggctaaactattggctcccagctagggactctcggtaagtggcttgttagtgacgagtgtttgtctatactggcacatagcggagtcttttgctcccggcttactcgcctccaggaaagctttggggtgaggcgaaggcgattgaagcaatgccccttcccccagatcgcagctgctcaggggggacacagcacggcatctttcaccgaatctctctcgctcgctcgcactccagcctccctctccccagcgacccccccaccttctcctccctccctctccttgacgtttgattccagtagcaaaggaggtaaaaaaggcaccgagccgtcagccaaacctgaaaagtgcggccccgccccctccacagccactggtagcttcccgtggaaggcccgcctcccggggcagctgcggcctcggagtggttgcgcttggcgcccgtcgggcgtggccccgccccaggtccgggagggtaggttggctgccccggcgagcggcagagcccttctggacagctcccgctcacccaaacagaagacgtcggcgccggagcgggctcggacatggcgaggctgcgagccggcccgagcggcggggcccggtgatccctccctccctccccgtcccctcccctctcccgcacgcacgccccgtccgcccccaccccgcccccaccccgggcgagcccgcccgcagcccggggcgcacacccgcacgcgcactcctctccactcactcccgcgcccgcccccactcccgcagccgagccccgccacgcgcgccttgcccgcccgccggccgcccccgccgcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctgggcggctgggtccgcgaagccaatgcgctgaacggtgcccgagtcttcctaactatcctgtgcttggccgttgccactgggccctggtgactaagcccaagtttgaaaatgacgtggctaaagctgcctgctaacggcagagcttaatcagccgcagatcccctcctatcctcatcggttctcgtactaaaaaggctcacgcgcagactttttacgcaggtgcattcgttggacaattaaacgtggccctagtaacaaaagcctgagcttcatccctccgagtagcaggctctgcgctggactggtcgggtctaacagggagaatcttgtgtcctaccttggctgggacaggaagtaagagaagcaaactggggaacccctgccccaccccttcccaccccctggacgtcctgggccgaggcccgggtcactggcccatcgcgggtaaggaggtgtcctgtggaacacctgcattgactggaaaagaaagaactttaaagctcttccttcccgcttgtgggggacaccaccacaccctgccaaccactcccctggccaaatggtggcttgtttttccagaaggagcactaaggtgaattttatggaaaaaaaataaaagatcagggacctaagtgggagtaggatgagaactaattcttctgggttttttttttttttttttgaaattatgaatcccacctgttgaagaaggctgagcttttccaacagcgggtatcaatcgggagggaaagcagtgttttccagccctctccaagaacagtaattaataagaggaaggaaaagagagatgggaaagcaaatcgtgcattgttctgctttgagttgaggcagagggtaggctggtgtttcttcctcatcttcccactagtgttcttccttaaagaagggagctttggtacaccaccttggttcctagtcagaaagtgccctaccggacccttttaaactacaatgagatagctgggtaatcagatatgtaactaaggaggagagcaggtggtttccctttggtctggcggacaactggctccctccccacagcccccacttgaaagactcctaggccctgggaggggcgagtgggcctttagaggatagaatcatagactctctcctactcccatcttagaattccaagattgggcaggattcctggtgaatggtgaggtctgggcaaaggataaactgattaccccagattctctgtccctacaaggcaccagcagctgcttcactctccttttgagccaggtctgccctgaggtaacagtaccctaggccagttttaccatcccaagtgccagacttcagccctgagggaaggagagccagcctctcctgctgtcttcaaaccaaggcttcattttacagtcacccccgatatgagagagagcctccccaccaggttttctggcctttagacacttctcttcaaagaagagaccagaggaacaggactgaaaaactctcaggaagaaagtcctgggctccacactccatggctagtggctggatttggcagaaactgtcttcatgaaaagtggtatcatggagggggatccctggagcaaggaagacctcaagggagaagcagagagatttagtttctgggttcttgccaaaggaagggaaattaggagggaataaatagaaataattgcctgtataaagggccctggggaggagggtgaagacagaggcaccctaggccttaaacttcatctagactccctgggctgtgctgacttctgacccttttagggacctttgtttttgctgacttgggaaaagttgcttcctccagggagacaactcttcttagaggggagagtccataatgaggaagccctctggggtgatttatttatgctgtcaggtatagagctccgtcaggctaactcaccctgtggggccctatcaccccctcttatcacccaggctttttccctaaccaacctctgtgcctttgggggaaaggctttttgatttcccagtctcattcaaggcaatggctgaaaaatgtgcataggtttttctaggggcaggtggggaaaaggtagggacgtggattgtgtgacccagcccatctaatgcctgacatggtgcagatgggcaagacttggaggcaggctgtgggctgtgcagatagagatagcctcacttcgggagcaggattcctagaagctgtggacgtttattatgaaaaactgtcccacacaaattgtcccaaagggcagggaggctctgcattccacctcggcacctctttcaccatttgaggacccattactcttctgtagaaagcagactttgtttgggttggaagcacacctccaatgtaatttaatcagcattggactttggctcttgtaatcaaatatacatatactttctcctgcaagaagaaaaataatttctctgtaactggtattgacttgaagtcatgtaatctctggaaagcatcacatttttaaagggaaaggtaaaattaaggggaaaagaacccgcagtgttagtggtttgctttgtcatactaagaagagccagttaccacttaagaaagggcagaagaagcattcctagagcataaatacttgtgctgctccaattgtagatatttcatttacagttttctctgtgcaatcagccttggagatggttaaggataggaaactaggttgactggctcaccaaattctagaatgtgggctttattacttatgttgcattgacatccttgaaggaacctgtttgacggctcatttttctgccgtatttggagaggccacaggcagcagcagctccttgagttccagcaggatctgggtgggtagcaagcctttccttttaagggtgattggcagccattggcagcttgcttcccactccaccccagtgcccttgagcatgaagctgtgccctactgcgtcctcctggagcaagcttggagtccccaccccccagggtgaggttctgggctttgcccaagttgagtctgctagggaatctgttgtaaacacagatccattgatttgcatttgtcagagagtaaagttaaaccagtgaaaagagaagcccttatccttttatgcagggccagggaaacctttcatattgatcctattgatccaacctttccctttaaggaaaccacatagttaaagaccctcgttcaatagatttacccttcgtgcttgtgatattcctttaagtgttctcatctaggatagctgggcattaagcccacactccaaaccaaacaaaaatgggaaggggggtgggaagagagggggtcaggaggcagaattgtgggaagtgaaattaaatcaaactgaaatgtgtaatgacccagttggggatgtttttctcattcttctaaaatgacatgcagggataaagacaaaatagatgcatttggcatctttttttttatgagaaaagaaaatctgtttatatgcctagagtaaaaatgtctcaggaacatcattttctactgtaaaattatttcaattaagccaccagtttgcttcattaagattggttcacttaaaagcagtgatgttgccacaattattttggttcatttgtagcaaatcagaaaaaggattctccccagaaatgcaatattttggactctgtatatgagcataaacactgaagtcacttgaaaagagagaggatttggagtttttgtgttctgctggatgtgggaagcaacgggtagaacttttgttgtggagcagagtagacgcaataggaattgccagatattgctcagtatccctcttgcttgtagatatgaaaatgtaagtctcatttgcctccagaaccatcggcacaatccatttcatttcttccctgatccttttttcctgtctaaataacatccatttgtgatttttttcaacacggtacatgacctgtttctaattggctatctcttgggttgtttttgtacattcatgtttgttttatctgattgaaaaatattaatgatttcgtaggtgagctaatgtatttatctgctgagcgagttcaaagggcagagttcagctatggttcaggttaattgaacaggaagcagtgagctctccaggctgtgttgaacaagggatcagtcccttaaaatatcacactcagcaaacacaatttcactgtcttcatcctagagtctgatgtaaaaggctcagatcaacttggatcacttgtttaaaaaaccaaagcaaagcacagtaactgcagcaataccctggagtccccctcggggaagaagagttttctcattggctaattgctttattggtagcactgacctgcagagcagctgcaggagcctggatgaaggcttaggcctcagaataatgtgctccattagaacagggcaaggcattttttgtttactcaattggagctccctgcaaagtgccattaaccccggcccaactgcttgtgtgctgcaaaagccaaaggtcacgccagtcagtctgtaggcatagcagctctgccctggtaggaaggttggggtcgcatcctgctggcactgccctcccaggggctcgggccagccctctgggccctttccagagttttgactaaagcaagcaattgcacaacttgtttacatttcccaactgctgaatcatgttttgatgattaaacagttttgatctgagcaccatcaatcacacacatacagaaaatccccccactgcccctctattttctatttatgttctcttcattactgtgcattacagtaaacagaattgtgcaaacggtgcttttagcaggaatatagttctgataagtgcttggatcaaggggaagacagacctccaaacatggctggggggctgtttggtggaagaaaggtttcaagtggagtcggggagcacagtcagggcttccaccgccagcaggtgaactagagtgccacctgccgggagtcttctaactgcactaagccctgcaccttccacaaggtccaagccccttccttcactttgttcctaatatccttgtccccattccccaccctgcagatcactacccatgcaagcattatcttcctagaagtagcttaaagggctttttcctggtcctttgaaactgtaacctctgcctcttctaattcattgccaaggagaaatcaacagttctgctgtcataggtgaggtgatttgcccatcctgcacattgaggtaatagtctcctgcttagttggactgtgcttgggggaagagaagcaaagaaagcaaaaaatagccgtgggagggaaaacgaatgattatgtgtggaagaaaaatggctccgttgattgtgccagtgagggctgtgccaactgtaaggtgttctgcaaagataaaatattgtacaaaggagagaggatgggagagaattagcatctacagggaggacatcgagaaagagatatgccaaatcagcaaactcgagtttaggctttgtgaaatcccctggaaagagaaaaagtgaaccagccgttttgcaattgcaaagaagtgagccagtgagctagacttcgagccagactgtggagctggctgtagctctgtgggtggcagctatttccacacttgcttcacatggacccctgcctggagcccctggtagcagagcgcctgtgggtgggttgctgcctccacgccccggcgcaggcttcagcaccacgaacagcgccatggaggaacgctgtttgagcgaattggagatggaccctctactgcggttaaatccaggcaagagcctgaccagtagctctagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcatcaccaccttcgataaatctagaaactggatttgatttcttgagagtctagtgatgaggctctttttaataaaaaccttgccactgcttctgtccctgaccccctacgaagggccagagatgttgagtgacttcctccaggccacacagtggagtcatatggcactggccagggtgagaactgacagtaggcactgacccctgactctggcctttttcaatcagttgctttgctttatttctggttttattccagagaaaagagataggagagtccttttggtcaatgattgagcacaactcacatctctttgggtttcgagtaaaatggtccttgacttcccaaagctaattaaaatgtaaaactcttgctttatttcaaataactttagttcagacctaatttattgctaaggtggttctcagggaggtagagcattggaatagacaagtgtgtctcctttaaaagtcaagggtatgataaatgagaattttttttcccctgtgacaatttatcttcaagttccaggtggccctttgtgtaaaaggagggaaaatccatcccaaaacaaaacaaacctggtagagcattcaaatttgatgttgaaaaaaattgtttctgtgtgtctaaatgcccaaaattttgttctaaaaatgagcaggaacatatctgaatcagatataaaaatgggtgttaaatgtattttgtaagctttgactaaagaagtttcttccagctgtgtagtcttcgaatctgtggacgtgcctttctcaggagttgttgggttccactgtcaaaaccttttccagtaaaacatggagtgttggcaacagtaagtgtagcctttttggcctactttatatgcatcactgcatcttactaaaatgaggcattacactctacaaggacttgtactgaatgcatttcctttgtagtgaactcaatatgcttttgaaaagatattttacagaactgccacataaacaagaccttttctattatctgttttgaccctaaatactgaaaagtgtgtggagtaagataattttatgcttttctgaatcagtgccatagatccccaaacctaaaagatgtaggggaaaaattcgtcttggatgcaattgcctcctaatgtataccagagttcatttctgttcatgttcaagggacaagagtgaattctgtattcactttcaatgactaacccttctcatcctttccttcattcttctgaagaggaagaggtggacttcctgttgaagaccaaatcctctcctgccttctcaggaccccatgcttcctgtatatagatgtccctgcttttgtgaagttttctctgtcctcctaaattgggatctctttggaccatccctccctttgcatttagaacatagataggtatcgcctgctgacttgtcagtgtcagcccattagattaagatccagaagaggaggttagatacagcatacaggaggcagccaataaatatctgtgaataagttaataaatacttttcttttatatgacactgtttctacccattgtatttcccccatattattgtagatggcatctgagtaggaatcatcagccccagcacatcatttaggagaagcatttcacaatgtcaagttctcatcaatgtcattttcctcccaaattacgatattataactatgtattaattttaagggaatctcaaagtaggattgagtcttatccaaatcttcagattatcgccaatggagcaagagatgtgaaatgatcatcactagactctagactaaggacccattttgccaattggctctagttaccccaaagtaaccctccccagtcagtcagttctcctcgttttcctgcttaggcattgtcctcactgtcctgtccatgtctttgcacgttctgttccttctgcctggaattccttatctcatcagtccttctccaggtcctatcattcctagccacctccgatctgcctctgaaatcttcccagctaactttggcccattcctttctgtttctttctgaactcgatttgcaatcattgcaaatgacagaacagccttgttggctctggtcttacactgctctctaggtcttttctgtgtctccctttcttccccatggctctggaggggagatagcatatctttgagctccccatggactgctggtccatggctgaacccacaccaggtattcttttttgagtaagtcatttggtggcctcctgtctatctttacagaagcccctattctcaacgagagaataggttgggtatgtttacttacatctatcattcttttctagcttcttctctcaaaagggggtattcttttcttattttatttttttgatctggagccgtactttgtcacccaggctggagtgcagtggtgcgatctcggctaactgcaacatccgtctccagggttcaattgattatcctgcctctgcctcctgagtagctgggattacaggcacctgtcactatgcctggctaatttgtgtatttttagtagagatggggtttcaccatgctggccaggctggtctcaaactcctgaccttaagtgatccacctgccttggcttcctaaagtattgggattacaggcgtgagccactgcacccaacctgaaaaaggggtattgttttctataaatgctttggtcattgttggaaatattggctacataatttaaaatggatttctatgttaatctgaaatgagacataagcttaatatagagaaacagggcttgtgatgtcttcgttaatagcaaaggttgttctgcttcatacaaggtggaaaattttacccacctcagggcaattgtgccagcaattatatcagcaaatcagagggactgctttcctattttaagtcattttaattatcagtaaactaaacttgcatctaaacagccattacttgagatactgcaagtgcttaggttgttaataacgtaaagttacctgtgaagaaaaaaaacagaggttaatatttttatctttttattttattttaattttatattttattattttcctttgatgaatccattgctgcctacactgtactgaactaagtagttgggagtgaaaatatatgaactagcccttgtccctttttgactttactgtatatttaagatttgaatggatacatcctcacttacctttacatatccatatggaattgagtgagaacagagtttattactatgtcaactttagttggaaactgaaactaagatcatttatttgctatacatcttacgtggaaattatatattagctcgtgatatttcatcttttttacagttatgttttgacgttcatattacatgagtaacaaattatgaagactaaccatttatgaacagaatttagtgttaaatgaaagcattccagatttttattttctgttgccttgaattgaatgcattgctgtgctgcatgataactaggtaagcaattgacctgtgtgactgtcatttctgtgccttgcataaccaaaccaagtttcctctgacactgaggcagagacaggcagggttgcgctgggcaggaagcagctctgaggcctccctgaagggccttagactcccaatgggggagtcagaggccaccctgttctctggctacggcaccatagcctagacatgggtgtcaccaaaggctatacacttctttacctccttttctgccctcttcctaaaggaagcatctggaaccagaaggagtccatatcgctagccccactcctccctaaccagttctccatcccgagccttagattcaggcttgcataggcagattctggaaagtccattaaaagggcaggatgtggagtaaataggtgattggattggagggtaaagggcggaaaattcacagcagagacaggtggacttttctaactggataagctacaccaactcatgaatccaagtattccacccctggaaagcaagaggtgaaagcaagttggttccattggtgaaagcaagtcacctgcctgagcccagagacagggtggaaaggctctacaaagttacatggcaggaagcatgggcacagaaaaggcaagcatgaggaatggggggggcggtgttggtgtttttctttgtttgtttgttttgttttgtttgcattctacctcatgccatgtattttagctcatttattcttggaagctgccactgctatggtgatacacagacatcaaggatgtccaatagtatagggctaattttggcaacacagaagataagtgtgggggtatttcacattcataagtaacaaacctatgcccacctggacaggaaccacgcctctttgtattgagactgtttgtgacatgcttgatcttctcgactagatcatagcaagcagggaccctgagctttgttctcctgcatcttccctttagccccaccacaatgcctaacacatagtttgcacttagtaaatatgcaaggataaatgatccccagaatcccactgctctagtgtcccaatgggagatcccctcaagacccaccaggtgattgcttgtagctcaacctgtattttattttattttattttattttattttagagacagagtctcactctgtaacacaggctggagtgcagtagtacaatcttggctcactgcaacctccacctactgggttcaagctattctcctgcctcagcctcccaagtaggtgggattacaggtgcccaccactatgcccagctaattttcatatttttagtagagatggggttttgccatgttggccaggctggtctcgaactcctgacctcaggtgatccactcaccttggcctcccaaagtgctgggattacaggcgtgcgccaccacgcctggcctcaacctgtattgtaaaatagggtttcactttaaacttttaaattttgttctactacaataattaccaaattccaggggagcaaaggtccaagcctgttgcctacagaattaaggcatccaattcagatctcaattattttgtgttaagaaaatctaaacaaagcaaacactgcttagggtttaccaatgaataaagaagcaagttggaagggatatcaaaaagatcaaaatgtttgcgcatttataactttaacaatgtctaagtttttttaaacttaggttctacatctggagcatacttttttaaaaatcataagcagtgttaaaaaatacttgacagttttgtcttgattcttaatgtgggtgttaagggatgccgtccattagtgagtacaccccagatcatgtgtttattgcatcctccttcttccctgcctgtcccctaatgatctggtgcacagagggctacttgagctgagttatatggatctcagttgctgtcatttgcacatacttaattcagacaggtgatcacattgatttccaagacccaatttttaagacactgtactcacgtagatatcttagctgctctgactatgttgtctgaaaaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcatcctacgaatcaatacccagtgctcacagttcccctgaatgtgaagaaatggcacccttagtaggcagttgtagtctcctgtaattcataacaagctgtccctagttattgaacgtgtttaccctgtaatcccagaaagttcttgtgtttttatgcctatggttttgcaggctggtttattcagattctgagcattgtgaactaaattcataacttctttcatgcattagccggagtcataggactctgatttacagactcgcagtccagctcacagcggctagctttctttgggtcataccagagtttcatctgcatggccaaaggggtagaattccaacttgggtttgaaagcaaataggataaattgtcagaagatgtattcctgtgtacatctttggaaacaagacataggaacaaacccttatttttcaactccacccaccctgctactgaggacagaagaacaagccctcctcatcttttatcctgcctctccttgagacagccattccattaaattctatggcgagggaatctatggtgttcgagctgtaattgaagaattagcattccataaatgctgccttaatttttttaaaaaaattgttccaaagaactgctttttgttgcattgttaattagcctttgaacatttttgaattcattataaccttcaaggtctgccaaggtctttaaggtttcttctttatggctttgcctctaaataacaataggtacattgtaaggttattgtgagccttaagtaagttaatgcatacagatgcttagaataactggtaaatagtaaatacttgctaaaatatctgccattattgattgattgattaattttttgtaacttctccatatatcagcaggaaatttggcctgagtcaccaatgttcccatagcttttatatattaagaatattgcttggcattgtcaatgacagcatgagccaaacagatccagtttgtatctgagccaccatttactagctctgtgatgtcaggcaggggacgactcttgaagagcctcagttccctcctctgtaggaggaggacaaggtaggtcctgacgttatctagttggtgtacagattaaatgagacgccataagggtatatggcacctggtacattgcctcctatctcctcagttttacagctaacatcctattacacatgggccacatctgtacttcaacataaattttttgtcattttctcagatgagatttaggatgagtgagattgccagactctacactcatcactgggcatgctgtttgcaaactggccaaccatgcagccggactatttactccccacccccaatgtccttttaagactcccttaacagttatggacattttgctaagctcgtgcttagaacccagaagttgactgtgcacacagtaggttctgactgaatccctacaggcttagattggaatacagtccattttgcaagtgtggtatgtattgagcagacattctgtatttgatggaagttcacatataaaaatggcaactgagccaacaaaactcacatcatctgtctctataatgatcacaggtttggggggccttatcagaaagttatttttatagacaccccggtggtcatgagatttaaaatgctaaggagaatggcttcctctttaacctcttttctgtttttgatatgtctgggccctgcttctttatcttgttccccaaatccattcacttaggttctgacttggctccctggagagctcctgttttggttcacaccatcatctttattcccaaattaggatccttaacaagaaaagagaaaagaaagaaaacctgtagacatccagatgttgctttttctgaagtaacaactttatttgataatattttgaagccatgggccaccgaattctcaacatgcaagtttatttaaacagtctctagtatcctttcctgaccccaaattactttcaagcattaattgtcctagtggtttcatggccatattatttcatattcattagtgttttcatgaaaaattataacactaattagagtggcttccagttaattcacttggtgattcattactctctccttcttggtgatctgcatgtggtcatcctggagaaagcatccaagggtaattgcagctctattccctgagtgattgcctaatgccattagttctgatccacaggagcatctcgggaagctctgatggggtctggttacagctgcacccttgtcctgccctttggatgcagggagaaagggaagcctgcagtgaggactggtcctccggaggggtctagggaaacagaggggagggacgtcttagggaaaaggaagtaggggcaggggagggagttcagggatttgaacatcactttaacatcttctagaacttgggtaaggacagtatagagtaaaatctgccctgagaacttgcacgtagagtaaggaaggtggtttctcttcagtttcagcagacttgtggccaggcactgagctggagtttggaaacccggttccctctcagagctctgacatccagttcttccaactgaaagtttatttgacctcattcccattaggatggctgctgtaaagcaaaatgaaaacaaaaaataacaaatgttggcaaggatgtggaaaaattggaaccttgtgtgctgttggtgggactgtaagatggtgtagccactgtggaaatagtatggcagttcctcagaaatttaaaatgtgagttatcacatgacccagaaataccacttctgagtatacactccaaaagaactgaaagcagggtctgaaagagatatttgtacacccgtgttcactgcagtgttattcacaacagccaaaaggtggaagcaacccaacagttcatcaacaggtgaatggataaacaaaatatggagttttcatacagtggaatattatttagccttaaaaaggaaggaaaatctgacatatactatggtctgaatgagtcttgaggatattaagctaagctaagtgaaataagccaatcaccaaaagacaaatactatatgatttcacttatatgaagtgtctagaatagtcaaactcatagaaacggaaagtacaatggtgcttgccaggtgcctgagagagggaaatggaaacttgtttaatgagtatagagttttagttctgcaagatataaaagttctggagattgtacaagaatgtgaatatacttaacactatggagctataaccttaaaagtagttaagatggtaaattttgttgtgtatattttaccataatttcaaagaaagattgtttgttatttatattgtattgcttgctcaatttttaaaaaaaattaaaaatagaaaaacaaaaagccaggtgcggtggcatgtacctgcagtcccagctactggggaagctgaggtgggaggattgcttgagcctgagttctggactgtagtgccccaggcccatcaatgtcctcactaagttcaccatcaatacggtgacttcctgggagtggggtatcaccaggttggtgagggaaaaaacaactactgccatgttgctttcagttcttttggagtatatactcataagtggtatttctgggtcatgtgataattcacactttaaatttccgaggaactgccatactatttccatagtggctacatcatcttacagtcccaccaacagcacacaaggttccaatttttccacatccttgccaacatttgttattttttgttttcattttgttttgacagcagccatcctaatgggaatgaggtcaaataaactttcaactggaagaactggatgtcagagctctgagggggaaccaggtttccaaactccagctcagtgcctggccacaagtctgctgaaactgaagagaaaccaccttccctactctatgtgcaagttctcaaggcagattttactctatcctgcccttaccccaggttctagaagatgttaaagtgatgttcaaattcctgaactccctcccctgcccctacttccttttctctaagacgtccctcccctctgcttccctagacccctccggaggaccagtgctcactgcaggcttccctttctctctgcatccaaaggtcagttgtgtttgctcagtagtgggatactgcctgtgaatagccactgtactccagcagcttaaaactccatttcttaaaaacattttttatcaaaagttctgccactccactattcacaatagcaaagacttggaaccaacccaaatgtccatcagtgatagactggattaagaaaatgtgacacatatacaccatggaatactatgcagccataaaaaaggatgagttcatgtcctttgcagtgacatggatgaagctgaaaaccatcattctcagccaactatcgcaaggacagaaaagcaaacgctgcatgctctcactcgtaggtgggagttgaacaatgagaatacatggacacagggcggggaacatcacacactggggcctgttgtggggtagggggctgggggagggatagcattagaagaaatacctaatgtaaaagacgagttgatgggtgcagcaaaccaacatggcacatgtatacgtatgcaacaaacctgcacgttgtgcacatgtaccctagaatttaaagtataataataaaaaaaagttctgccactcaaagagaaccacattaatattttgcttttattaaaattatttttaattatttaagcaatgcattaaaacattctacttataaaaatcaaaacattaatgatcagaataaagtcctctttgcctatctcctttaataccagtcttcttcattacttcccagcagtaaccactcttctggctacaaagagtgggtctgccaatccaggcacttccagtgcatttatttacctacatatgtactcatataaattgtataaataggtagaaagacagatagatagatcgataggtatcttaggtttgcgtattgttttcacataagtggcatcacactgcatgcatcattccaaagctccttctttcctttgatagtatgcctacccagcttctacatataaatgaggttcttgcaacccacatttattgcatagtgtcctatggcatgactattttcatttatttagccatttctgttttgatgggcaattaggctgtttaccatttttggttgtttgcattatttgctaagcagtgatgagtgaacatccttgtacacacctccctgtgtacccatgggaatgtttcctagggtggacaccgagaagcaaaatgagaggtcatggagatgcacatactgtaattttgataggcactaccacactgtcttcgaaattggctccccatcagcagtggaggagagagctcctatttccctgacacttgccagaagttaatatattagccattttacttttttttgcatagttgctggatttaaaaataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatggttaaagaaacaagacccatctatatgttgccttcaggaaacccacttcacccataaagacacacatcgactgaaagtgaaagagtagaaaaaatatttcatgcaattggaaaccaaagaagagtgggagtaactatacttatatcagataaaatagactacaaatcaaagactgtgaacaaagatgaggagggtcactacgtaatgagaaaagggtcaatacagcaaggggatataacaattataaatatctatgtgcccaacactagagctcccaggtatataaagcaaacattaatagatctaaagggagggatagactataatatattgaaaacattttatcccatggtattattttgaaacttaataaggcttcttttaactttgatgtatcaaattcatcttttttattatttattttttatgagacagagtttcactcttgtcgcccaggctgagtccaatggtggtgcaatcttggctcactgcaacctctgcctctgggttcaagcaattctcctgcctcagcctcctgagtagctgggattacaggtgctctccaccatgcctgcctaatttttgtatttttagtagagatggagtttctccatgttggtcaggctggtctcgaacttctgacctcagatgatccacccgcctcagcctcccaaagtgctgggattataggcgtgagccaccatgcccggcccaaataaatatttttgttgctcttcctttactttatgtgttttgcttcttgggtcatttttatttattttatttattttttagaggcaggatctcactctgttgcctaggctgagatgcagagccccaatcatagctcactgcaacctcgaactcttgggctcaagcgatcctcctacaaaagcttcccaagcagctaggactacaggtgcctgccacctcatccagctaattttattttatttttttcatacagatggagtcttgctatgttacccaggctagtctcaaactcctgagctcaagcaatccccccacctcagcctgtgtgctggggttataggcgtgagccaccatgcctggccttgggtcatttttaaacatttgaatctttattctttaatttttctgaagttgctttttataaattatgtgaaattggaatctatttttttaaaatctcaaatggatagccaactaatccaacagtttctgaacaattcatctcttctcactatttgaaatgcaatactttctttataatatattatattcccttatgtacttgggtcagtttctgcactccattctgttccatggatctattaaattctgtgtcaacgtcatactatttaaattatttttgctttatgatatatcttgagctctaataggatatatattttctctcctcatcttctgtttctacatcttcttagccttccttgtattttcacttttccataggaattatagaatcagcttgaatttatatattattttgatcttctcaattatacatagggcacagagttctattcattcaaatcttttttttttttttttttttgagatggggtctcactctgttgctcaggcctgagtgcagtggcacaatcacagctcactgcagccttgacctccctagctcgggtgatcctcctacctcagcctcctgaataactgggactacaggcacacccaccacacctggctaatttttttgtattttttgtagagacagggtgtcactctcttgcccaggctggtctcaaatgcctgagttcaagtgatcctcccacctcagcctccctggcattatggcgtgagccaccacgcctggaccccaaatctttatttatgtcctcagcaagtaaaaataagttttagttttggccttttgatcttttggttagagttatttctagctacttgttactgttgtgaaggtttttttctgttgcgttttggtttcatagttctttatactcaagtatcctaaccactatagtttagtgttgctgttttttttttaacttcatataaacagactcactatatgtgtattcctttgtgtctgatttcttttttccaacattatcttcatgctgttatgtgttgctgcatgtagtagcagtcattccttctttttcataactctataatattccactaaactcatatgccacagttaatcaattctcctgtcaatgagcatttggattgtttccagttttactacagagctgctctgaacattcttgtacatgtacatgcatcctaatgtacttaaccatacatttctgtggggttttcttaatttgagtttcttcagaagcaaaccctaaaacaagaattcaagtatgggtagtttatttgaaaggtgattccagaaaacactagtaaaagagtggagaagcaagacagggaagggaagaagcccaataagagtcacttcatgaagcacattagtagagtgggcaaatggagcttaatcctgctgagtaactctgtgaaactccagagaaaatatgccttagagttgttccagctgaagaacaagggtgctggggtatttatctggcagctccaattattccctaattgaggaaatctcctggacccttccccagcccttctggcctgcactgcatgtgggcagggcaggctctggcagccagacaaagccctcaggcaaagagctgaaggtactggcagttagaagttgggctgtcgtgccccgcagtggtgaaggccaggagagtgtggcagcacatgacagagtctgctacaagagagtctttccatgagcagaatttctgggtcatagggcacatatatattcaaccattgcagatactgccaaacagtcttccaatctgttgtcccagtttgccctcccaccagcagcctaggagaactcccgcaaggctgtgtccttgccagctcttggtattgacttttacatttaagccattttgataggtgtttaatgttgtctaatttgcaattcctggattactgataattttgagcatcttttcatgtaatttttgaaaatttggatttcttctgtgaagtgcctgttcaagtctcttgcctgtttttctattggaatgtttggcatttccttattgatttccagaagattttatatattctggattcaggccctgtggcagacatatgtgtttaagatatctgtggctctcctttttactgtcattcctgtcttttgaaaaacagaagttcttaaatttttttaagagacagggtctcgctctgttacccaggctggagtatagtggtacgatcatagctcactgcagctttcacctcctgggctcaggcagtcctcctgcctcaaccttccaagtagctgggactactataggcatgcaccaccacgctggctaacttcttaaaattgttttttgtagagacagggtctcactttgttgcacaggagaagttcttaattttaacgggccccaatatataactatttctctttgggctagtactttttgagtactaagaaatctttcctgtgattatgaagaattaccctatgttattttctttctttttttttttttttttttttttttgagacagagttttgctcttgttgcccaggctggagtgcaatggcccaatctcggctcactggaacctctgcctcccaggttcaagcgattctcctgcctcagccttccgagtagctgggacaacaggcatctgccaccacgcctggctaatttttgtatttttagtagacacggagttttaccatgttggccaggctggtctcgaactcctgacctcaagtgatctgcccgcctcggcctcccaaagtactgggattacaggcataagccaccgtgctcggcctaccctatgttattttctaaaaactttattgttttgccatccatactaaggtctgtaatccatgcagaacttattttttgtgtatgacatgaggtaggggtcaagaattacattgtgacacaatgcctatccagttattccaactccattacaggagagaacacatgttcctcatgttctgcatatccaaccttgtcattgaatccagtgtccatatgtgtatggatctatttctgggtttctgtccttttccactggtctggagttgtatgtccttgctgcagtattacaccatctattgtagcctcattaaagatcttggtagttgaaacagaaagttgtcctacgttgttcttcttcatctagaatagcttaactgttcttcgatttttttgcattcccagttaaatttcagagtcagcttgtcaaactcaaactttctttcctttcctcttgaaaggaaggaaagaaggaaggaagagagggagagaaatctgctgggattctgattagagattgcattgtacctgtagatcaatatggaaagaattaaaactcttcacaatattgagttttccaatcaatttatttaggtattctttaatttctctaacaaagttttgtagttttccctgtcaatgtcttgtatacctattgctagatctattctatgtacactcttgatgttttgatcctattgtaaatgatatcattttcatttactgtttgatgtgttatggagaaatacaattgattttgtctactgacttgagtcttagaatcttactaaattctcatactaattctaacagttcattgtgtattctcgtggatttttaagtacacacaatcaatattgattttctatgttcatcttgaaactggccaccttactgaacttttttattagttctagtaatttgcctttcaaaatcttgagttttctaggttacaaaaccaaaaaaaaaaaaaagtccctcatattaacttataattatgaggattctgtttctggctgaagacgctgttaagtaaaagaagtatggagtcacactacctgaatttgactcccagcctgttatttactatgtaactttaagtaatttgcttaatcctctgtaccttggtatcattaattataagctgcctcatagggtggttgtaataattaaatgagtttatacacgtagaattctgcctgtcaaataatgagcactcaacttatgtaagcttttgccatttcatcagtttcctaaattcctttataaattttctttctaaattttcacttcttatttattttttcttattttattgtattggctccttttccgatataacattgaatcatagtggtgcttacacacctcatctgaaatttcaacactttgaaacatttctttctagtattttttttgttttttgtttttttgtttttgtttttgtttttttatataggcatgttgttttgttttgcttttcatgtttgacgtatctgaaattgtctttgactggacttccaaatctggtggtaaactatgcaagacagagatacttttccaaaggaatgtcttttgttcaaactatattattcacataaagatgaaaagtaataacgaaacaatttgtttttaaacattgagatttggttgtgaatggagacaccgaccctttttccttcctgcagattcattagtgtagtcttaacaaagaggtgctcttcattcatgtaataaaactttttaggatgtttggaaggagctcagggatattcgtagccacatagggctgttggccaattcttttttaagacaatatcacattcttgagcttttaagtttgattaaattcttagtaagctagagtatgtcttcaagttattttcatagaaaatattttcatagaaaattttcatagaagttattttcatagaaagcctatagttagaatttttgagtcattaaataactaagaatgcctttctacgggaaagaccacctgaaccacataaaattctagcattaccgccacagtgtcagttttgctcttaatttcctccaatgccactactgtatttctcattttcctgcaaattttaaaaatcttactcctctttttttgcggggggcgggggttgtttgtttgttttgagacagggtttcattctgtcacccaggctggagtgcagtggcatgattgtggctcaccacagtctcaaccctctgggctcaattgttctccctgcttcagtctcctgagtagctgggaccacaggtgcacaccacccacgcctggctaatttttgtagtttttgtagagacagggtttcgccatgttgcccaggctggtcacaaattcctgggcttaagcaatccgcccgccttggcctcccaaagtgctgggattacaggcatgagccacctcatccagcccatcttttgtcttactactttttcattacatatggttacttacaaattgctattttcttcttaataattttctgttcctgtttcataaaagccacctctttttgcatcatattgttatatcaaatgattctctaaaatgttctttaagtttctggaagatattatctggtaaattttctctggttttcagatgaggatccctttttgtcttctactattttttcaattgtctctttttcctgtttattcattctcaaatgagaagagacccattctggcttgccatggtcaatagaaagggtgtatgttttgctcatgacctcttttctggatgttagtgcactcattctctaagccctatactaaatcgccagttgatacacctaaccaagcttccatctaatcagcttccttgttgtgtggccctgctgaactgatgtgcactcatctcctgcatccgatcctgggatgctgagaagctgatcaaatggaatacacacgacaacccccggtatactgcacatcgagggctcctcttgtacctgtgctcaccctgagtgctctggaaactacttctccaagggagtgatgtaccagccttggtgtccctcctccaccctgcagttttgttttgttttgttttgtttttttgcctagttgttttctgagagttgcagttcttaattggcaggtggaagggagtggggagtactctggctctttcaaaaggcagcacctaccaagtagatggatggctgctgaatttaaatttctcaacagttggaggactcagatgttattttttcaatcctgatgtcccatttcaacccagttccattggccttggccttgtgtttaggtaaaaaatctccagatcccccaaaacagactgactgcagtcctggtttttggtgtgctaagttttgtgtttcattacaggacttcgagatgattttagcagaaagttgaagaagctgccccatgctctcctagccattttaagccagatgtttgtatctggaattaaatatttgttttagcaactcacgacttcctggatggcttacaggaatgcagcttggcagcagagctaaagatccctctttgccaggcttctgcataggcagaagagatgactgggaattgtgatttcaaaggctgagtgccccaaactatttattctaataggaaggtgggaaataaaagccccactggactagacaggagggaatatgggttctcagggctgtgtcactgcataggtgaccctagctgggagttctgatctcttatttctaaaaacaaggttagaccaagtgctctctaaaatcctgcctttctaggagtctgtggttttagcagctgacctagaccatctgctattagaagcctgttctttgaggctactcatgtttgttagagcctctgctggagagaagcagaagtaagaggtacatctccactcggtgtacaggctccagtgtgcttcctacaggcagcacctgcgggcagctacaggggcctgaaccttcccctgggagatctgcccaccaggggcactctgggcctttttcaggccatgcctccatataagaaagtcgtgagacatccaagagccctcatttcctgagtccccttcagtgactttgtattgaaagtaaaaatagagacaggaaataaaacttgtttttttcagagaatgtctttgaagcttgggaacacagaatggtcgctgtgcggtctgcctccagccgacagtaagtggacactggggagttgctctagcgcttgtcaagaccagcttcgacatccaagtgaaagcagaggcggcggtgtggagaaagagcagagatttgccattgatcatccacatttcctttggtttttttttttgtttgtttttttgttttttttcctaagacagagccttgctctgtcacccaggcgggagcgcaatggcgtgatcttggctcactgcaatctctgcctcccgggttgaagtgattctcctgcctcggcctcccgagtatctgggattacaggcacacgccaccacacttggctaatttttttttatttttagtagagacagggtttcaccatgttatccaggatagcctcgatctcctgacctcgtgatccacccgcctcagcctcccgaagtgctgggattacaggcatgagccacctcacctggcctatcatccacattttctagatgagaggaagaatgtactacaggaaatctccccaggatctgagatttgtcctgtgtcagaggtgaagcccaagacacggctcacaccgacattccagggcagtgccaagccttcccgggctccgggcagctcggaacttggggactttgcccccaccctccagcatctccagaatgaggggagtgtgtatgtgtgcatcgtgcatggcccctcctgccttcttgttccttctccctcctgtctcctttttcctcttgctccgccattctcccgcccacaatatctgctctaataagccaggcggcagtgctccaactagcccataggtggttcacgctggagtaccttgtgcaggataatttgccaaatgggttagaggtctgtcttgcaaggcctgtgcatacatccacaattagaagggagtgaaaggaggaggggaacctaacaaccaagaatggctccacatccatttgcacagtgtccaccctgtctctgcccttggcctcccaaatggatgttggtctggacgtcactggctccgctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctttggtgatgcgtcagaaatcacaatgaagcaaggaaacctgcaaggcatctaactgggaactatttatagtttccaaaatttaggcagcacaaaataatccaataatgattttaagacagaccctccccatccatcaaggcctggctcctcccaggtgggtgatcagtgcttctggcaccagctggccctgagtggccagtggagctgcttagagcctgagccccaagtcttgtgtgttaggccccctgctcccagggtctctgtggcaatgtgctggcacctaattatttgctgaccctgagaagcatgcattgctgagatttaccagcatttatggcttactgaatatcaaatatttattagcagagtgtacagttattctattttctttcttccttgtttgaattcaaggaatcttattatttttactttaaaggctcttgatcatgcagattagttccaaaggaagggttctctactggacaccatcacctctcccatagtcttgtcattctatcagtactgaagggccaccagttcagagcagggaagtgaaggggggttatttccattcttcttacctcaaacacctgtaggtttctcagggaacaagcccagaggtacaaatgtgaacctacttttgtaattgatttttccaacataaccccaattgactgccttagttaatctttccaacagaactgcaggccctatgtcctcccgggagagtgccctccttagtggaaagggtcacgctccccactttgcacaagccttcctaggagggaagctgcgagctcttcagctgaaaagcgaaaaggcctcttctgcaggtgtacttttcaaacctgtatccttggaggttaagtgtctgctgacaaatgcacaccctggatggtctctctccccactccccacccttgccctgacaagatcacattgaactattcagggaaagtatttactgaatgcaaggagaatagagcacttctgcattatttattaggggctaacaatacccatcatatgtagatgatattgatacccatcaatgtatttggacataaattagtatgttaggaaactccagtggtccaaaaccttttaggatctctgacacgtatgtaaaaacacgtcgtagtcttacctcttatatgaggctgggaattggctatgagacaacctcacaaagaaaacaaacatctttaaccttttatttgccattagccctctgggcagttcatctactatcgagtaagacttgaaatcatgaactcttaacctctccttacacaccttctttctgctttctctaaggaaggaagaatgttcacatttcctgagtgtctactctgtgccaagtgttacagcaagccttttgatgtcctggagtgctggacattagcatccccactctataggatcaggaaactaaggctcacagtcctgcagctgataagtggctgacaaggagtaggaaacagggtcttggcttccatctgagcttcttacagtacatttgactcacccctgggcaggaaggcaaaggtcattcttggcttctgtatcagttacctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcaaggactggaagattctgacccggtgttgagttgctcttacttcacaggcttcccagaaactgtggaggctgggaaggggttttccaagatcaaatccaggatccagtgctaattgagtcaccctaaacaaacgtgtttccttctccaagagtaaaatgggaatccatacctctgccccatcttcctttcagagatgttgtgaaaagaaattcccaatgggggatccagactttggcttccactgggactcacctcactgtgccttcagttcctaatgtgaaactgacaaccctggactggacaaaacactgaggttctatggctctgtgaggaggaccaagctaagggagataaaagatgttcaggtgccttgaagagctaacaccactgcacctgcggaactgggtgtcaaggtgacatgcggttccagggtaattccccaacctgtatctgcctccctgaaccaaccagatactgtcccccttaccttaccctccacaccacacacacacaaccacacacacacacacacaaccgaggtcagtctaccctctgttcgggaatgggccctcccccatctctctccttgcttcccctccccaccagcacaaaggccctggcttccaacaccccattactgctcagcatccaaatatccaaagacttttgttactagaaggaaaacgcacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacatacctttgtgctgcccatgggtaggcgatggacagggccagggccggttagtctgggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatccagtggccaccagggagaagcaagttggtgtctgaagatctcagagagggcttgtgcccgaggccagggcttcccttgttttaccctgggaacccagtgttttgaaaaatttatctaccaaggaacctatatttttaggcagtagctgtctgccatccttgttaatcacagattatacacagatgtgtacatgcctgccagtaccaggtcctgggccacaggacacaaccagcatgaccaatctgagtcaatattatttctttcaaaaagtggggaaacgtagccttattgtaggtaaacaaatgacttctcttcgagtctttgaaatggaagcgagcgcttggccttccatgtggtcctacataggacctgcttccctgtgagagggagggagctcaagaatgtctgagggcttttgggatctacacccacctccccatcaggcagtgacacatcagctcctggcatgccctccctgctttcctcctaaaagagagaggagaagaatcagatccaaatggtctagacagggctgggctaaccttgcaccttccgtggcagaactggctttgagcagttggagttcaggagaccctgaccagcatgtgactgtgtcaagactgaatccatcaatgccactggaacacctgctgtttcgttgggtttctatcgcatccttgggttggagggagctattgacactttcctggctgttcaaaaatgggcacatgtggactatagagtgtagtaattgaacagcaccaaagccgtttgcactctgcttgtgcctgcaggcacacctggctccacagcccgggtctgaggatgctgaggtcacagcctcacaccagctcccagacgtcattggatctgtctcctttttcttagactttcaaggcaggtgttctccctcctgtttttattttcctttagctcctgaccaactgcttttgtcaaaatcaacagctggcaattgctagctataaaaaccctgggcaacatatggacatactgcctcattatttagggcatttgggcttgctgtacacttctagactgcaagctacagctttgcatttgttgctgtggcatctggtggcttccaaaggctgttgggaaggcataggcaggatgtattgatctgttctctctgtgcagtttgcttcacgttaagtctttaatatttttatcttaaatatgtgtgtgtatatatatatataattttaaatatatgtatctcacacaaaatataatccgacaagccaatgtggacctgtacccaaactgtctaatcaccctattaaaagcacaaatacagcattatctgaagaataatcaatattggtatgaaaattgagagctatgtggttaatccaaaggagcgtgaattgacagaggacctcagccaatgtttgcagaagatatttgcctggattttgttatcaggagattatcatgcatcactatttattcagaatcctccagatgaaggcttgacaccagttgtcccaggggtagggtcagggacggttgtccagggacctgaagtggcagtaggggcaagcatagtggtttctacatcttaaaaggggctgcagaggtttatagaagcacagattccagaaccttgccccacatggtgaaaatcagaatttctgggggtggagacccagaggctgccctgcaaagagggcccctctgatgtgcagttgggtatgggtgccattccctacaagagaagtgtttattctttctttccctgggtctgcagcaaacctgggatgcggtgtcagtgtcatcacatatactccaaggtctccatgtatttccttttaaaatgaaaatcatttttcctgatttgcctagctcagagttcctggggtaatacaatgagaaggagagtatgaagtgaagaggtacctgttatctcacttaagcctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgcagaatcccaggccctgtccaggctgaactgcatgagaatctgcgttttgatgagccctccagatgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaattagcaaagaagaaatcattaccggtaagctgttggaaggatggcagtgagcagtcttagccctttctgtctgagttcccactgcaggggaagcgctcctcatccaagaaagccaaaaggccccaaaagaatgagttttaagatgaaaacaaattgtttttatgtggatgtgttgtgtgtgtttaattttgaagacaatatgaatacttttagaaatgagagaaggaaaaatcaggaagaaagtttagccaagctgatacagcctagcagctttcccattcaggggctctcctcttcctgccctttgagagtatcagtgcattttgattatttcaggaatgattcatttatattactttatagcacacagcatccagcagggagggcagccagttaggtagaaggaaattcagcttccaagtatctttcccgtaagtgtttgtcttcaggttaaatcctgtcttagtctgttaaggctccagtaacaaccacaacaacaaaataccgtgacttagtgcttataaacaatagaagtttatttctgacagttctggaggctgggaagtctaagattaaggtgccagcggattcagcgtcaggcgatagtctgtgtcctggttcacagagaagactttctcactgtgtcctcccgtggtagaaggggcaagaggtctctctcaggcttattttataagggcactaaccctattcctgagggctccaactttatggcccaatcacctcccaaaggccccacctcttagtaccatcaccttggatgttaggattgtaacatatgaatttttggggggacataaacattcagacaccgtagcagaccgtccacataagatgctgcctgcagaacacattgaacaggaaatgcagtgcccgaaggccaggaaacaaaatatacaagccagtgctttgagaaacataggaaagcatctgagcagcaccctgggtgccagtcttgggggaatgtcagtccactgcaaagggattctcaacctctggccagaatatccagtaggatggattctgagggcgactgccccatctgggcctctgctccttcctggcctttccccagtttttcctgttgaggccacactgtcaccacacccctaggggagctgggacttatttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccatgcccagctatttttttgtatctttagtaaagacagggtttcaccatgttggccaggctggtctcaaactcctgacctcatgatacgcctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcccaaacattcattgtatccatggctccaaaaagaatcagtcaggaatactacagaggcctggttgctgccttctaggaacttgtaggctaagggagaggtcgtgacacataatggccttgactgcatatgtcagcccaggcatggatactcacttctgctaaatcaaagagactctgcatatactaacatgtctacaagcctgaagtcctattgtaacattgggcttcttcccccaccctcatcccctgtcttgtactagcttccaatttcaaactagccaaatgagaattggctaaaccaatttttctagtctttctctcccttggtcttctgtttgttttgttctaatttttcaaaagtctggacgaaaggaatttgggttgggatgataccatcattctgtcacttctaaattcattctgttaacaatttttagagtcacatgggtagaagctttgattttgaaaaactatgcacttttaagttttgactccagaaggtaatttcaactcagctgtaaacaattcgagagggtgaatatgaaagaggaactgcctcaccaggcttcccccaccctggcgtctggagtcctccctgccttcgtggcacctgatttcagagataaagaatttcaaggatatgctagagcagggaggatgtaaaagggaaagacaactgcagttagctcaaaaccagactgtgtgaaacagccctgctgctttgtcctttctcccatcccccactcactcactgatgccttccatcacccggagattacagggaaggctggttattgacagctgggcagtttgcacaataaagtttaacggtttacatctctttgtgcaactttgtcaatgttttccatggatcaccttctcaggtgagcccactgactcctctccttcttctctttcccttcaagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaatgagaatgacctcatttgctttccacatgcttagcctcattataccatgttatgtccaagttcacagccataacataaaaaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttagatcattaatgtgtccttggttgatcagtcatctggtccctcctactgtgtgttatgaccaccacgtaatccattctcactctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatgattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagttgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatacta

SEQ ID NO: 13655 - DNA, 87648 bp, Human
  misc_feature (1)...(87648): n = A,T,C or G
caaaatatatcataaaccatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatttagcactccagtgttttgatttttctcctctgctgggtaggaataacaataatactgttattcaccatggtggtgtgggaagtttcaaagagcacatgtctataaagtgcttagtgcaaggcttggcatgcagttaacacaaaataaatgcgagctgctgtcattaacaatactgactacacggcactgtgatgcttatgtaaatgccaggctgtgtgtctgtaacctgaggtatttgtgtaaatattttcctaaaataaatctaactaaggttgttcttctcacttgtatggggtcatcttatgcggtagatgctcaaacacaaattccagatacagagtgggcagtggtagttaggaagatagaaaggctagggagtgttcctgggaagtcagtaaacttggaagatctaaggttatattaaaaatgttgtatcagaacaaaggctcaggacgttagtgttagcagaaaccagatatcttagagcagtggtttgtcaactttgccagcaatccacagtaagaaattcaactccggccgggcgcggtggctcacgcctgtaatcccagcactttgggaagccgaggcgggtggatgacttgaggtcaggagttcgagaccatcctggctaacacagtgaaaccccgtctctactaaaaatacaaaaattagccgggcgtggtggtgtgtgcctgtaatcccagctacttgggaggttgaggcaggagaatcacttgaacacaggaggcggaggtgacagtgagccgagatcatgccattgcactccagcctgggtgacagagggagactctatctcaaaaaaagaaaaaaaagaaattcaactccactaacacccacaatgcaaataaacgtgtgaatgtatacaactattttatcaagcagtacttattatatgtgctgtaatctgatattttatagcctgtttcattttattttaatgttgattgttacccactaaatttatttcattgagaccccctaatttgaaatattgccttgaatatatatatacatatatatacacatatatatacatatatacacatatatacacatatatacatatatacacatatatacatatatacacatatatatacatatatacacatatatacatatatacacatatatacatatatacacatatatacatatatacatatatacacatatatacatatatacatatatatacatatatacatatatacacatatatacatatatacacatatatatacatatatacatatatatacacatatatatacatatatacatatatatatacacatacatatatatatatacccttgtttaaaaataaaaggtttgcagctccatattttttaaaaaaatcttacccaagcatttaatcagtactgaatggttttgttcttgttttcatgtcaagttgaatttgggggtactattccagaatatttacatgttagacaatgttctgtaaaaggggcattgtagcagcatgcaggcagtattcaaccaaaaactgggcaagagtcataattcactctggtttctctttccttttaagcaggtagttccaatttgccagcagaatgagtacagaaagagactcagaaacgacatttgacgaggattctcagcctaatgacgaagtggttccctacagtgatgatgaaacagaagatgaacttgatgaccaggggtctgctgttgaaccagaacaaaaccgagtcaacagggaagcagaggagaaccgggagccattcagaaaaggtaaccacatgaagtcccggtgactaggtcgcttataaatcctcatgtgggtcatggccacacgtgccaaagatgatcggtctattttgcgtggtctaggagagaatcttctctgatctcttcttaggatgcgactgacagaatggtggatgggcttggacaagtacccattgtccttagtaagaagggctgggagagcatatctgacaagttctgcagagaaaatacattaaggtctttgttagtgtgtgtgtgtatatatatatatatatatatatttagaggcagggtctcactgtgtctccccagctggagtccagtggtgtgaactcggctcactgcagccttgacctcctggactcaagtgatcctcctacctcagcctcctgagtagctggactacaggcatgcaccagtatgtccaactaatttttgtatttgtgtgtgtgtttgtgtgtgtagatggtatttcactatgttgcccaggctggtctcaaactcctgagctcaagggatctgcccacctcaacctctcaaactcctggaattacaggcatgagctacgatgcgtagccagtgtatatattcttaaaatggagttatgcgggcaagaatctgcatgttactgcacccagaaatttttaaaggatacatatcaatcagtcttagatgttaactattagtattgttaaattggcggtatgagttatataaataaccatccttgtgtatgtgtgtgtgtgtgtatatatatatatgtatatggtctgcccagggtcaggccagcatcagaggcagggtctagaccaaggccagcaaactttttctgtaaagggccagcaagtaaacattttaggctttgtggaccacgtggtctctgccaatgttgagtgtaagtgaccgcagacagtacatcactgagggcagtagaacatggcttgcttttaccatgatgccttttcttttgtggcttttctatttcatctcctgctggttctcccaccctggcaaacagatgtgggcttctcttgtagctcttctccatgagcaagctgagacttttctctctggaccccagatttgatatcaggctgaaaatatttcctccatggtgttccgtaaaattctagccgaacaaccttagcatcacattcacagaaatcatcatagtgttctggtttcagcgctccagacacgcctccctgcagccttagtcagagaagcctcggattttagctggttttcccgaggtctctgttactgccattctgcccttgcaggctttctagaagcctctttttcccccatgccaaaccccccctctagtttctctttcttgggttctgctatctggatgagctatttttttctaataattttaacctgtagaagatgtgatatgcatgaaatcccgtttctgcaatgattcttcctgttctggtcacagaatctgcctgtggggagattctcagtgtggggagtgcatgcaccccgggagccccatctcacccaaatgtggggaggccattgactcctgtatgttgtgtgtccgctacctttccatagcaaacatttagatggattacctcttagagtgggtttctggttttgatttcaagctgttgaggattgagcttaagtgccttctgccttgaatcagaaggtactaaactcatgatacttgaccaaaattaaagtgaaattcctgccgggcacagtggctcatgcctgcaatcccagcactttgggagactgaggtgggtggatcacctgaggtcaggagttcgagaccagccagaccaacatggtgaaaccccctctctactaaaaatacaaaaattagccaggcgtggtggcaagtgcctgtagtcccagctacttgggaggctgaggcaggagaatcactagaacccggcaggcagaggtggcagtgagctgagatggtgccattgcactccagcctgggcaacaagagtgaaactccaactcaaaaaaaaaaaaaaaaaagaaagaaagaaaatggaattcccaccaatctgaacaggaaggtggcctctgtcataacaggtccagactggatattggtgaactagctaaagctgaagcagccagacaagttacaaggaagttctagttgattgcccaaacagtgaataaaacatgcttcttcctcattcctttccccgctaattgcactgcttagtctcctatcacaattttggaatctctaccaaatgtagatatctgatggggtggcaggagaattggctccatggggtccagggtcaactttgctcttggtgcttggtggcacgccatcagatgtgtagtccgagacacagcaaagggaccgggattgggtgcctgcagaaatgtcagagacgcatgtagtgggtggaaactctcatcccctgtttttttacaactctgcctgcccattctggtggttaggatcctttcctgatcattcagtttgcaggtcatatgttttgtagatttctaccctcggtatatgggcattaaaagagctcagtcttggccgggtgcggtgactcatgcctgtaatcccagcactttgggaggccaaggaagttgaatcacctgaggtcaggagttcgagaccagcctggccaacatagtgaaaccccatctctattaaaaatacaaaaattagcccggcatggtggtgcacacctataatcccagctactcgggaggctgaggcaggagaatcgcttgaacctgggaaatggaggttgcagtgaaccaagatcccaccactacacgccatcctgggtgacaaagtgagactccatctcaaaaaaaaaaaaaaaatgctcagtcttgaatcttagtcatgttttccaagggtgatttatattcctaggggatttgggtggttctcgcttctcaaaacccatatcaaatgactttgcctgtgactttttacaaaaattcttattctaatacctctctgtgcccttcccaagcacacagatgatgttcagtaaatgccagacctctttcctcccatttcccatgtgccctgcctccctcacagccagtctgctctccttctttcctcccttcctctctttgccctcttcatccctctttcctttcccactatattctcatttgtgcaatttcccagttaaggtcagtgtcaccctgacttctctttctttttttaatcatcatctgtctttcttgacatttcacatcctgaataatttccttcagagaatcagttctttaagacatcagaacatgagtcaccctgcgaggtaccaccagactaacaccagggaccagcacccattctagcaaaacactgcctaagcagcctgaactgcgctagtttctttaatgagggttgtagcacagaaagttgctttcttttttttttaaagaaaggaaatcctctagcccaactaagctttcctgttaaacaagtgctttgagagacccattcagagtacttttcactagaaggacctttattgtgttttgtgagaaggaaggacaggcacaaacatgctgttagaatgtgccatggagaaagataagcccacaggttcgagtggagtaactttaccctttgtgtaaagattcagcaaagattctcagaaatgagcgggaatgttttcagtgctatgggatgagctctgtcgtttcctgatgaacacacttctcagcatgtgttctgggaaacactagtttttgtatttttggagttttcttgttgtttgtttgtttgtttttgttttgagatggagtctctctctgtcgcccagactggagagcagaggcgcgatatcggctcactgcaaccccgctcctgggttcaagcgattctcctgcctcagcctcccaagtagctgggattacaggcgtatgctaccacgcctggctaatttttgtatttttagtagagacagagtttcaccatgttggccaggatggtctcgatctcctgaacttgtgatccaccagcctcagcctcccaaagtgctgggattataggcgtgagctaccacacccggccttaaagtgatatcttcataaaataatctggaattaagaatgtggggtctttagcgcatctatgaattaatatttagttggaaccaaaacacagataaagatggctcattgaaacgtatcaatcgtaggatatcctagggaatctgtgaaaagtgctgagggagctgttccacttaataagatgaattttccattttcggcacataccacatatgggagtctactctggctacttattttctttctttctctgatcggttgtaaattaccatccacctccacagcctaaaaacaccagagtaattgatgcttgtaaagccgcagggtgaggggtattcctgcactgagtgattactgatggggaagggtggtgatactgtgccatctcattttattttattctttttatttatttgtttatttatttatttgacagaatctcgctcttgttgcccaggctggagtgaagtggcgtgatctcagctcactgcaacctccgcctcccgggttcaagtgattctcctgcctcagcctcccgagtagctgggattaccggcgcccgccatcacgcccagctaatttttgtatttttagtaaggacggaattttgccatgttggccaggcttgtcttgaactcctgacctaaggtgattcgcccaccctggcctcccaaagtgctgggattacaggcatgaaccactgtgcccggcctattctatttatttttaagatcttgggcaacatgctcattttagagaatttgctttcaagtcatgtaatttatgattgaaccttgggtaagaatctcttgctcatggaaacctaactcagctggtggttttcttcctgctactttgcagcccaagttcagaagtagatttttaatgatagaagtcaccataggaagacactctcctttgcactaactgggggttctcagtcctgcctgtacatcagaacctcttgtggaatttttacaaactctctaggtgcctggacccagcccctgaagatacagagtggttctgggatgaggcaaggggaagaatctatcatttaaaatgaattcagtggcctgaatattttctcccattctgttgtctctttactttgttgattgtttcctttgctttacagaagctttttaacttgtgatctcatttgtccgtttttgctttggttgcctgtgcttgtgaagtattactcaagaaatctttgcccagtttagtgtcctggagagtttcccaagtggtttttttgttgttgttgtttgtttttgtttgaggcagagtcttgctctgtcaccaggctgaagtgcagtggcacaatcttggctcactgcaacctcaacttcttgagttcaagcaattcccttgcctcagcctcccgagtagctgggactacaggtatgtaccaccatgctcggctaactttttgtattttagtagagacagggtttcaccatgttggccaggatggtctccatctcttgaccttgtgatccacccaccttggcttcccaaagtgctggaattacaggcgtgagccaccatgctcagacttccccagggttttcttggagtagtttcatagtttgaggtcttagatttaagtctgtaatccattttgattcaatttttgcatatgacaagagatggggtctactttcattcatctacatataaatatgcagtttttccttgcatcatttattgaagagactgcctttccccaatgtatgttcttggcacctttgttgaaaacaagtttactaaggatgtatgaatttatctctgagttctcttttctgttccattgatctgtgtgtctgtttttatgccaataccacgttgttttggttattatagctctgtcatataatttgaagtcaggtagtgtgattcctacagttctgttcttttggcttagattagctgtggcttttctgggtcttctgtggttcccatacaaattttaggattttttttctatttctgtgaagacagtcattggtattttcatagagattgcattgaatctgtagattgctttgggcagtgtggacattttaacaatattccaatccatgagcatggaatatcattccatttttctggtgtcctctttagtttcttgcatcattgcaatcaatttatagttttgattgcagagatcttttacttctttggtaaacttaattcttagctattttattcatagctattataaatgggattattttttttcttttttttttattatactttaagttttagggtacatgtgcacattgtgcaggttagttacatatgtatacatgtgccatgctggtgcgctgcacccactaactcatcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtgtatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctggctttttaatgattgccattctaactggtgtgagatggtatctcacagtggttttgatttgcatttctctgatggccagtgatgatgagcattttttcatgtgttttttggctgcataaatgtcttcttttgattagtgtctgttcatgtgcttcgcccactttttgatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtagggaagggatccagtttcagtttcctacatatggctagccagttttcccagcaccatttattaaatagggaatcctttccccattgcttgtttttctcaggtttgtcaaagatcagatagttctaggtatgcggcattatttctgagggctctgttctgttccattgatctatatttctgttttggtaccagtaccatgctgttttggttactgtagccttgtagtatagtttgaagtcaggtagtgtgatgcctccagctttgttcttttggcttaggattgacttggcaatccgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagagacaatttgacttcctcttttcctaactgaataccctttatttccttctcctgcctaattgccctggccagaacttccaacactatgttgaataggagtggtgagagagggcatccctgacttgtgccagttttcaaagggaatgcttccagtttttccccattcagtatgatattggctgtgggtttgtcatagatagctcttattattttgaaatacgtcccatcaatacctaatttactgagagtttttagcatgaagggttgttgaattttgtcaaaggctttttctgcatctattgagataatcatgtggtttttgtctttggctctgtttatatgctggattacatttatcgatttgcgtatattgaaccagccttgcatcccagggatgaagcccacttgatcatggtggataagctttttgatgtgttgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtccaggaatttatccatttcttctacattttctagtttatttgcgtagaggtgtttgtagtattctctgatggtagtttgtatttctgtgggattggtggtgatatcccctttatcattttttattgtgtctatttgattcttctctctttttttctttattaatcttgctagcggtctatcaattttgttgatcctttcaaaaaaccagctcctggattcactgatttttttgaagggttttttgtgtctctatttccttcagttctgctctgattttagttatttcttgccttctgctaacttttgaatgtgtttgctcttgcttttctacttcttttaattgtgatgttagggtgtcaattttggatctttcctgctttctcttgtgggcatttagtgctataaatttccctctacacactgctttgaatgcgtcccagagattctggtatgttgtgtctttgctctcgttggtttcaaagaacatctttatttctgccttcatttcgttatgtacccagtagtcattcaggagcaggttgttcagtttccacgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggatttgctttatgaatctgggtgctcctgtattgggtgcatatatatttaggagagttagctcttcttgtcgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgatgggtcttgactctttatccaatttgccagtctgtgtcttttaattggagaatttagtccatttacatttaaagtgaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatactggcccccactctcttctggcttgtagggtttctgccgagagatccgctgttagtctgatgggcttccctttgagggtaacccaacctttctctctgggtgcccttaacattttttctttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaagttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaagtcattctccatccagctttgttctgttgctggtgaggaactgcgttcctttggaggaggagagacgctctgcgttttagagtttccagtttttctgttctgttttttccccatctttgtggttttatctacttttggtctttgatgatggtgatgtacagatgggttttctgtgtggatgtcctttctgtttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaagaggcagtctgttggttctcagatctccagctgcgtgctgggagaaccactgctctcttcaaagctgtcagacagggacatttaagtctgcagaggttactgctgtctgtaccctgcccccagaggtggagcctacagtggcaggcaggcctctgagctgtggtgggctccacccagttcgagcttcccggctgctttgtttacctaagcaagcctgggcaatggcgggcacctctcccccagcctcgctgccgccttgcagtttgatctcagactgctgtgctagcaatcagtgagattccgtgggcgtaggaccctccgagccaggtgtgggatatagtctctaggtgcgccgtttttcaagccggtctgaaaagcgcaatattcgggtgggagtgacccgattttccaggtgcgtccgtcacccctttctttgactcggaaagggaactccctgaccccttgcgcttcccaggtgaggcaatgcctcgccttgcttcggctcgcgcacagtgcgcgcacccactggcctgcgcccactgtctggcactccctagtgagatgaacccggtacctcagatggaaatggagaaatcaccggtcttctgtgtctctcacgctgggagctgtagaccggagctgttcctattcggccatcttggctcctcccaatgggattattttcttgatttctttttcagattgtttgctgttggcatacagaaaggctactgatttctgtatgttgattttgtatcttgcaaccttacagaatttgtttaccagttctgatagttttttggtggagtctttaggtttttccaaatatgagatcatatcatccgcaaacaaggataatttgacttattcctttccaatttggatgccgtttatttctttctcttgtccgattgctctagctaggacttctggtgaaagtaggcatccttgacatgttccagatctaagaggaaaggcttttagtttttccccattcagtttgatactagctatgggtctgtcatatatggcttttattatactgaggtatgttgttctgtacccagttttttgaggattttttttatcatgaagtgatgttgaattgtatcaaattctttttcagcatcaattgaaatgatcatatggtttttgcccttcattctgttgacatgacatatcacattaattgatttgtgtatgttgaacaatctttgcatttctgggataaatcccacttgatcatgatgaatgatctttttaatgtgttgttgaattcaattttctagtattttgttgaggatttttgcatcaacattcatcaatgatattggcctataggtctttttgtttttgtttttgttttttgatgtgtctttgtctggttttggcatcagggtaatactggccttgtagaatgagtttggaagtatttcctcctgtttattttagaatagattgagtaggattggtattagttcttctttaaatgcttggtagtattcagtagtgaagccattgggtcctgggattttctttgctgagagactttttattatggctttgatctcattacttgttattcatctgtttgggttttggatttctttatgattcaatcttggtaggttttatgtatctaggaatttatccatttttttctacattttccaatttattggcaaatagttgctcatagtagccactaatgatctttgaatttctgtggtaacagttgtaatgtcttctttttcagctctgattttatttatttgggtctctctttttttgcttttttttttttttttttttttagttagtccagctaaaggtttgtcaattttgtttatcttttcaagaaactaacttcttggccaggcacagtggctcacacctgtaatcccagcactttgggaggctgaggtaggtggatcacttgagggcaggagtttgagaccagcctggccaacacagtggaaccctgtctctactaaaactacaaaaattagccaggtgtggtggcacatgcctatagtcctggctactcctagctactcaggagactgaggcacaagaattgcttgaacctgggaggcggaggttgcagtgagccaagatcgcaccactgcactccagcctgggcaacagagtgagactctgtctccaaaaaaaaaccaaaccaaaccaaaccaaaacaaaaaaccgtttttgtttcattgatcttttgtattgttttctttgtttcaatgtcatttatctctgctttgatctttattatttcttttcttctagtaactttgggtttggtttgctcttgcttttctagttcttttttttttttttttttttttttttttttttttttgaaacaaaatcttgctttgttacccaagttggagtgcaagggggtgatctcggtttactgcaagctccccctcccgggttcatgccattttcctgccttaacctccccaacaattgggactacaggggccccccactgggcccacctaaattttttgtatttttttagtagcaatggggtttcagtgtgttagccaggatggtctcgatctcctgacctcatgatctgcccacctcggcctcccaaagtgttgggattacaggcgtgagccactgcacctggctctagttcttttagatgcatcatcaggttgtttgaagtttttcttattttttgatgtaggcacgtatagctataaacttccctcctagtactgctttcactgtgtcccacaggttttggtttatcatgtttccattatcatttgtttgaagaaatttttcagtttcctgtttaatttcttcattgacccactggtcatttaggaacatattgtttaatttccatgtttttgtatagtttccaaaattcctcttattattgatttctagttttactcattgtggtcagtcagagatgtttgatattatttcaatttatttgaatgttttaagactcattctgtgacttaatatacgttctgtctttgagaatgatccacgtgctgaggaaaagaatgtgtattctacagctgttgtatgaaatattttataaatatctatttggtctatagtgcagattaagtcccatgtttctttgttgattttctgtctggaagatctgtccagtgctgaaagtgtagtgttgatgtctccagctattattttactggggtctatcactctctttagctctagtaatatttgctttatatatctgggtgctccagtgtaaggtggataaatatttaaaactattatatcctcttgctgaactgacctctttatcattatatagtgactttgtctcttcttatagttttgtcttgaaatctattttgtctgatataaatataggtatcctgttcttttttgctttccattggcatggaatatcttcttcaatcccttcattttcagtccaggtggagtgtctgttgtaggcaacagatcactgggtcttttttttttttaaatctattcagccactctatatcttttgattgacagtttagcccatttacattcgatgttatattgataagtaaggacttactcttgccattttgttatgttttccggtggctttgtggtcttctcttccttctttcctcccttcccttctgccttttagtgaaggtggttttctcttgtggtgtgctttaatttcctgctttttattttgtatatatccattgtatgttttttgatttgaggttaccatgaggcttgtaagtactgtctaataactcattattttaagctaaaagaaaactaataaactctacactttaacttcctccctctgctttttaactttttattgtttctatttatatcttattgtactatgtcttgaaaagttgttctagtcactattttttatcagttaatcttttagtcattttactgaagagtagtttacatgtcacagtcacagtgttatactattctgggtttttctgtatacttaactgttaccagtgagttttgtgccttcaggtgatttcttattgctcactaacatcgtttactttctgattaatgtactctgtttagcatttcctgtaggacaggtctagtgttgatgaaatccctcagcttttgtttgtctgggaaggtcttcatttctcctttatgcttgaatatattttccttcagcactttaaatatgtcatgccactctctcctggcctataaggtttccactgaaaagtctgctgccagacgtattggagtgccattgtattttatttgtttcttttcttttgctgcttttaggatccttccttttatccttgacttttaggaatttgattactaaatgcctgaggtagtcttctttgggttaatctgcttggtgttctacaaccttcttgttcttggatattgatatcttcctctaggtttgggaagttctctgttattatcctttgaataaactttctacccctgtctctttctctacctccactttaatgccaataactcttagatttgcttttttaagtctattttctagatcttgtaggtgtacttctttcttttttattcttttttcttctgtctcctctgaccatattttccaatagcttaccttccagctcactaattctttgttccacttaatcaatcctggtattaaaagtctctgatgcattcttcagtatgtcggttgcatttttcaactccggaatttcagcttgactctttttaattatttcaatctctgttacatttatctgatagaattctaaactttttctgtgttgtcttgaatttctttgagtttcctctttgttaagtttatctgatagagttctgaatgtcttctctgtgctatcttgaatttctttgagtttcctcaaaatggcaattttgaattttctgtctgaaaggtcatatagttttgtttctgcaggtttggcccctggtgtcttatttagtttgtttggtgaagtcatgttttcctggatgttcttgatgcttgtggatgttcatcaatgtctgggcattgaagagttagatatttattgtagctctcacagtctgggcttgtttatacccatccttcttgggaaggatttccaggtattcaaaagaacttggatattatgattgaacccatatctgcattagggggcatcccaagctcaataacgctgcatttcttgcagactatctggaagaattatctggattatcaagcccacactcttgttcttgttgcttactttctcccaaacagaatcaatctctctctctctctttttttgctctttctctctcccccttccccccctccctcctctccctttctccttctctctctccctctgttctgggccacccagagctaggggggtggagatacaagcaccaatatggccatcaccactgagaatgtactgggtcagacatgaagctggcaccacactgggtctcgccatggcccactgtaaccatgatctggctgcctatgttccctcaatgccctgttgtgaagccagccaggctagcttcaagccagtgagttcccccaggctgcagccagatccagagatgccatctgggagccatggactggagtccaaaaccttagaaatctgcttggtgtcctatctattctactgtggctgagctggcactcaaaccattagccagtcctttccactattctgccctttccacaggctcaggggcctctccccatgtccaccaccaccacaggcctatgaggagtgctgccaggttactgctgatgtttggtaaaggcctatggcctcttcagtcagcttgtggtaaatcctttcagtcacccttcagggcagtgagctcccctctggcaaaaagcaagtccagagatgtcatccaagaacctaaggcctagactcagggaccccaagaggggtctctatttgttgctttaccccactgtggccaaggtggtagcaagtgcaaggcaggctgggcgcagtgtctcatgcctgtaatcccagcactttgggaggctgaggcgggcagatcacttgaggccaggagttagagaccagcctggccaacatggcgaaaccctgtctctactaaaaataaaaaaaattaggccgggagcggtggctcactcctgtaatcccaacactttgggaggccaaagtgtacggatcatgaggtcaggagtttgagatcagcctgaccaatatcgtgaaaccctgtctgtacaaaaaatacaaaaattagcctggcacagctgggtacggtggctcacacctataatcccagcatgttgggaggtcaaggtgggtggaacacttgaggtcaggagttcaagactggcctgaccaacatggtgcaaccccatctctactaaaaatacaaaattagccaagcatggtggcacacacctctaatcccagctactcgggaggctgaggcaggagaattgcttgaacccagtaggtggaggttgcagtgagctgagatcgcaccactgcactccatcctgggtgacagagtgagaaaccatctcaaataaaataaaataaaataaaataaaataaaaaatttttaaaaattagctgggcatggtggtacatgcctgtaatcccagctactcaggaggctgaggcatgagaattgcttgaacccaggaggcacaggttgcagtgagctgagatgacaccattgcactccagcctgggcaaaatagcaagactctatctctgaaaagaaagaaagagagagagagaaagaaaaaagaaagaaagaaagagaaagaaagaaagaaagaaagaaagaaagaaggaaggaaggaaggaaggaaggaaggaaggaaggaaggaaggaaggaaggaaggaaggaaggaaggaaggaaagaaagaaagaaagaaagagaaagatcaagagcaagacaaagcaccctttaattttccttctgcttttctcaagcggaaggaatctctcaccatggccaccacagctgggaatgtgctgggtcacaactaaagccagaatatcttagcctcaattaaggcccacagccttggatattaactgggtatcactactgtttattcagggctcaagggctctttcatcagcaggtgatggatcctgccagagctgggtccttgccctgcaaggcagcaggctcccttctgatccaggattgtctagaaatgttgtctgggaactagggcctgaaacagcctcatgaccctgcctggtgccctatcctactgtggctgagctggtatccaagatgcaagacaaagttctctttactcctccctctcatctcctcaagcagaaggaagaggtctcttttggagcagtgaggttggcggggaggggccgagcaagcattccactagctgctctggctggtgtctcagtaggtcatgtgcctgctaagtcaactggctccaagtccagctcagcactaggacttgcctaagagttgtagttcatggggcctacactgcctttcaattttatttagagccccagggcactttggccctcggtgacgaggtttgccagaattcaagttctgaccaaggtacaggagattcccctctggctagggctggtctaaatgctccctctatggtctggcatcagctgagttcagcctgcttttgctttctactgtctgtaacagggcagcactgagttcagtgcaaagcctcacaatcgctgcactgtccctctcccaagcgtacagattttctctccatgccacacatctggtgctggggctgggggaggggtggcattggcaattcaagactatttttcctaccctcttcagtcctttttcagcaatataaagttaaaaccaggtactgtgagtgcctgattttttggtttttataaaggtgcttttttgtttgtagatagttgttaaatttgatgttcctatgggaattacaattcgtgcgagcttctatttggccaccttgctcctctccatattcgccatatatatatatatatatatatatgccaatagagggaaggagaggaatcacaaacattgctttaaaacagtaatacatgtaaatgatccaattagaaaagggtccagaatgaaaatgaagttttccttcctgcctctcctgtccctcagtcatgcagtttcctttccaaaaaaaatactgctggtctgggcacggtggctcacacctgtaatcccggcactctgggaggccaaggcaggaggatagcttgtgggcagcagttcaagaccagcctggtctgcaaagcaagacctcatctttacaaaaaaatttaaaaattaggtacgatggcgtgcactttagtctcagctactccagaagttgaggtgggaggatcacttgagcccaggagttcagaggctgcagtgagctatgagcatgccactgcactccagcccaggtgccacagtgagactttgtcttttaaaaaaatgacaaaaagaaattacggttaccagtttctcaaaatatgtccttccagagagatacacgtttgtatgcgcaaagaatgcttgcaaacttgcttcctcatatacccatacacatatgcagaaacagatgtgcacgtgtgtgtacatatatgcattcatattgtgtatgaattctatgcatcacacagctgaaagcacaagatggtagatacccttctgcttttgtctcttaacagtgtaatttggaggtcattcctaccatatttatggggtcacctcattctttttttgctgactgcataggctatcattgtaatcgtgtttaactggctgttcccagtaggcatttgggttgtttctagtcgttctgataaatagggctgcattgaaaatccctgcagtaggtacatgggggatatttcctagaagtgtgattatttggtcagtgcatgtgtgtgttaaattttgagatctggccaaattactctccataaaggctacctcagagtgtctgtttctctgctctcttttgaacctagaatgtcatcccaagcattaccatgtgccaatgttttgctattataggataaaaactactatctcagtgaagaattgcatttctcttttaggaacccaaatatcttctcacaggtttaagagccatttgaggccaggtacagtggctcatgcccattatcccggcactttgggaggccgaggtgggcagatcacctgaggtcaggagttcaagaccagtctggccaacatgatgaaacccggtctctactaaaaatacaaaaattagccgggcatgatggtgggcgcctgtaaccccagctactcaggagagtgaggcaggagaatctcttgaacccaggagacggaagttgcagtgagctgagatcgcatcactggactccagcctcagcgagaacagcattgaatttccctttgtatgaactgtcttttcatgtcctttagccattctctcttcaattgtttctatggtttttttttctttttgatgttggactttttatctacttgttttccttgtttgctgcagtgtgtaccaaccagtgcagcttcttggttgttggtgggtctgtaagcaagcgttcggagccagcacagagaggatgagaggagggctgcactcatctgctcttccagatggcactgatcaaaggacgtggtgatcatgggaacactctggagagcacgtagccatatttagatatattgacaacacaaccatttagtagactcagggtgactttaagccacatgtcacatggcagctgttaaaatcatctctgtacatgtacatggatagttctgatggcacacccttgttagctttgtagcttttagctaaagggccatatggtgaaggtgcattttttgcatttcttatttcttctcttttctttgtcaatatatccattctagaaaatgagatgagccaggcacagtgtggtgcatgcctgtaatcccagctactctgaaggctgaggcaggaggatcacttgagcccaggaatttgaggccagcctaggcactgggcaacatagtgagactccgtctcttaaaaaaaaaaaaaaagaaaagaaaagaaaaagtggccaggcatggtgactcaagcctgtaatcccagcactttgggaggtcgaggcaggtggaccacctgaggttaggagtttgagaacagcctgatcaatatggtgaaaccctgtctctactaaaaatacaaaaattagccgggcgtggtggtgtgcacctgtagtcccagctactcgggaggctgagataggagaactgcttgaacctgggaggcagaggctgcagtgagctgagatcgcaccactgcactccaccctggatgacagaacaagactgtctcaaacaaaaaaaaaaatgaaaaaagaaagaaaaaaggacaaaaaaagaaaatggggcaagatgcttactctttctgtaaattatctttgtagttcaagtgtccagtaaagttctctgttccaagcagacacttaaaataaatatttgctcaaaaaggtcaattcctccacgtgctgttttgctgcccttcctaaaggcatgtgtatcagtgcagcacttcttaactgatgttaataagtgttctgtgattttttaaaaagtgcctatgattatattaattttggaaaagctattttaaatattaaagcattttaaacatttaacttataaaataaaatcagtttatttactacaggacttctcacagcctttaatgtacaagcaaatccaccgaacttccaagagagggttgcaaggtgctgtcttctgcaagtgtgtctgtccatggagctctgttttcatattttcatggtatctcattgaaatacagctcaagcaattagcctaaactcatagatgaataaagagtagacatcaatttgtttgtcccctgatttgtctgaattaggccaaacaaggatctttaactggaaatagggttattgattacttgactgcagtcagatttctaaaattgagtaaaaacgtgtttgcggttcaattgcagacaaagacatactggttactttctccaggctccccacagtattggcagaagtgtaaaattaagagatcaaggtcatttctggtaacccctcactgcacctactcgaggtctgatgccaccctctctgtctgaatcatccaaatcaaaattggccagggatgagggtatagtgctgggaccagacagagccaccaccagctggtggcttaattatgaagcaaatttatagagccacaagggggatggaccagaagtggactgggaaagatcattatgtccagctccttaacagggcagtttcttctttccacttgagttatttctaaaattgactttttaaaaatcccttattggccttttctgtcttcttgagaaatcttgtctgtttttcttctcagccttcctgaaatgcgtaacagtggttctgaacagtgttctagaaccctggtggcggggatgtgtcacaagtcatctgtgtgctaaagtaaaccattaaaagcacatgcatttgcaaattaccaccaaatagaatggattcaagagtaccttatgtaaggtcttatctacctactttgagaacgcctttttgagtggaatgagctgttctgattgcatatgtgattacagtgcttatgagtggctttatatttccatttttattttcccttttgataagattgcacttgagctacaaagataccaggaacattttcatttgtaataacacaactgttatgattacccgatgaaaggcagccaaaatgatgcgagaaaaatgttcaatagtgatattgtggctttaaaaaagcaatcaggttaattatttgcattcctcaatagtnnnnnnnnnnnnnnnnnnnnaattgactttttaaaaatcccttattggccttttctgtcttccttgagaaatcttgtctgtttttcttctcagccttcctgaaatgcgtaacagtggttctgaacagtgttctagaaccctggtggtggggatgtgtcacaagtcatctgtgtgctaaagtaaaccattaaaagcacatgcatttgcaaattaccaccaaatagaatggattcaagagtaccttatgtaaggtcttatctacctactttgagaacgcctttttgagtggaatgagctgttctgattgcctatgtgattacagtgcttatgagtggctttatatttccatttttattttcccttttgataagattgcacttgagctacaaagataccaggaacattttcatttgtaataacacaactgttatgattacccgatgaaaggcagccaaaatgatgcgagaaaaatgttcaatagtgatattgtggctttaaaaaagcaatcaggttaattatttgcattcctcaatagtctacacttgttactttttttttttttttttttttttgagacagagtttccgtctgtcgcccaggctggagtgcagtggcactatctcggctcactgcaacctctgcctcccaggttcaagagattctcctgcctcagcctcctgagtagctgggattacaggcatgcaccaccatgccccattacgccgagatcacacaatctttattattatagttgttaagactgatatttttgtaattttttactttcaagtgtcttttaatatattcccatctccaaaaatagttgtgccacactcattgttaatttctcttctctgccaatttggtggggattcatcaacacctagttctctccattatgtgcgtcactcaagggagnnnnnnnnnnnnnnnnnnnnttagccaggcgtgttggcaggctacacttgttaatctctttttctcatgagttttttgaggcagaagtatcagtctgaacgcgggaggctggaggttgcagtgagccgagatcacacaatctttattattatagttgttaagactgatatttttgtaattttttactttcaagtgtcttttaatatattcccatctccaaaaatagttgtgccacactcattgttaatttctcttctctgccaatttggtggggattcatcaacacctagttctctccattatgtgcgtcactcaagggagcttcatccagcatgcatgttcatggagaacttggtgccaaagaggtgcttcctcattctcttttcttttcttttctgtttgtttttttgagatggagtcttgctctgtcgcccaggctagagtgcagtggcgcaatctcagctcactgcaacctccacctcccgggttcaaacaattttcctgcctcagcctcctgagaagctgggattacaggtgcccgccactgcacctggctatttttagtagagacggggtttcaccaccttggccaggctggtcttgaactcctgacctcgtgattcacccgccttggcctcccaaagtgctgggattacaggcgtgagccaccgcgcccggcctgcttcctcattttcttcctgatttatagcatgcttgcctccagctttcatagcagcagcatgcttatgccttcctcgaggcatcaagatgtcagcaggatcgattccttctgagagctacaagggagagatctgttctaggcttctctccttggcttgcagatggccattttctccctgtgacttcgcatcgtcttccatctatctctgtgtccaaatttccctttttgtaaaggtatcagtcatgttgaattagggtcctctctaatgacttcactttaatttgattacatctgcaatgagcagtttccaaataaggtcacattctgagggatggaggtttaggacttcaacatttgaatctggggaagacacaattcaactcataacaacatgttaatttgctacttacgaacttttctcccttttttttaaagaatgtacatggcaagtcaaagcaaacgatcgcaagtaccacgaacaacctcactttatgaacacaaaattcttgtgtattaaggagagtaaatatgcggtgagttgttaactttctgaattgttttcattaaaatgcagttttttccagtagctggcatgcttactaccttcatgctacacctgccttccacgtaaccacctgcctggggctactgataatcatcattgtttctatagaatgtcatttttattgatgtttacctttggggtgggtagcgggtgacttgaaacaaaacagaattatgtagattgaaattttctctctcttttttaaattttaagctctcttagaaatgttttatgaaagaatatacaatgatggcacagaagcctcctgtttgaaagtaatgagtttgaaaggaatctcttaagaacttatcttccccttctctgcctggaatggatttagagattttaaacatatttttgactcaaaaatgcttattacctttggaatgtgataaagaatgcttaaagattaaatgcgaaatacaaaaattagcctggagtggtggcatgtgcccacagtctcagctacttgggaggctgagccaagagaatcgcttgagcccaggaggcagaggtttcagtgagctgaaattgtgccattgcactccagcttgggtgacaggagtgagactctgtctcaataataataataataataaatattaagtgtgggcttaaatgttgtaagatgtgtgttttaatgccaagggcttccatagcagagtaccacaactggatggcttaaaacaacagaagtttactctctcctgatgcagggatcagaagtctgaaatcttggtgttggcagggttggctccttctggagcctctgcaggagaatctgttccctgcctctcccctggcttctggtggccactggcaatccttggagttccttggcttacagatgaagtcaccccaatctctgcttccatcttcaaggggcactcttcctgtgtgtgtctgtgtgcaactttcctcttatagggaccccagtccgaataagcacctcattaaattagagcctgtcctaatcacgtatgacttcatcttgattatctctgcgaagatcctatttccaaataagatcccattcatagatattagtgttaagacctgaacatatcttttgcaggacacaatgcaacccactacagtaccttttgctctttcttacatagtaggctctgtctcctcacttaaataaaagcctcacttttcctggctttggccatgttgttgtctacctttaccctgttttctaacagtctctaatgggtcaaggaatctgacagcaggatttatttggtcacagtctgatgtctgtttcttgttactgcctctgtcataagactccaagtagtcattttgaggcttggctgcttggctagaattaaaagcttaaaagaaatatcagtatctttctttcttcttttcttttttaaggcagagtctcactctgtcactcaggctggagtgcagtggggcgatctgcaacttctgcctccctggttcaagcgattctcctgcctcagcctcccaagtatctgggattacaggtgcaggccaccacgcctggctaatttttgtatttttagtagaggtggggtttcaccatgttggccaggctggtctcaaactcctaggctcaggtgatccacccacctcggtctcccaaagcgctgggattgcaggcataagccaccgcacccagacaaaatcctcaatatctttctgacagatgatgttcctttgtcactgtaagctgtgggacttgtgacttttgcagatgtgtatacattgtgataaatacagcatcatttagaatgactcttattttttccaacagaataatgcaattaaaacatacaagtacaacgcatttacctttataccaatgaatctgtttgagcagtttaagagagcagccaatttatatttcctggctcttcttatcttacaggtaatgccctttgctatcttaaatctgtttgaattatagtgactcgataacatttaagctgtagacacatataatgtgaataatcttgaaagtgttttatattagcatcagggttctgtacataaaggaacagtgcctcatacacagaaccagctcaatcagtgttatatgaacagggaaagggagcaaatggaaatattattctaattctgtattttaaaaaatttcatgttatactgatatgggtgttaaaattggtatccctgaagtgaataaaactaaaatccagccaggctcagtggcccacgcctataatcccagcactttgggaggctgaggcaggaggattgcctgaggtgaggagttcgagaccagcctggccaacatggtgaaaacccgtttctactaaaaatacaaaaaattagccaggcgtgatggtgcatgcctataatcccagctactcgggagactgaggcaagagaatcgcttgaacccaggaggcggaggttgcagtgagccgagatcacaccattgcactccagcttggacaacaagagctaaactccatcttaaaaaaaaataaaataaaatccttactttgtaaaattatttgcaccttaaaattaaagctattttgtgcttgtcttttatcattgtagttagatgctgaatttcccccccaaaaagatcattgattttttattaaaattttggtcataaatttcagtaagttatttttgtgaactgtttttacattttaaaaggcctacttaaaaattttttttcctaattgtggcaaagcatccagttatccagagagcatgagttttgctgtgcaagaactgttgctgtaaccgagggaactctacacacactagttagcgccagaatcaacctttagtgtctgccgtgcggattacatagcttaagctcagaatatccacctggttttttcagattcttttttttttttttttttgagaccgtgtttcgctcttgtcgtccaggctggagtgcagtggcaccatcttggctcactgcaacctcctcctccttctcttgggttcaagcgattctcctgcctcagccccctgagtagctgggatcacagttaccagccaccacgcccagctaatttttgtatttttagtagagacagggtttcaccatgttgaccaggctggtctcaaactcctgaattcaggtgatccacccgcctcagcctccccaagtgctgggattacaagcatgagccactgcgcccggcactttatcagattctttacggcaagcattggatttggaaaagttatacctgctgggattgaccctttaaggttttatgaaaatggggtagaatgtgtgtctaggtggggatggaggatgcgtggagaggagagaaaaagaagagacgatggtaaggagaaatggataggcaatgatttaggaaactgtaagaccttcaagtcagatagtaaaggatggccctgttatcaaaggagatgcttagaaaggtgtgtgtagaggttagcactgcaaactccaaggtgctgctctgtaggaagtagaccattttcccttacttccttctagcagggaagaggagtttcacatattcactgtgatgtgggaagaaggatctttttgtcttctaactgcaccccagttatcttctctctctcttttttttttttttttgagatggagtttcgctcctgttatcaaggctggagtgcaatggcgtgatctcagctcaccaaaacctctgcctcccaggttcaagctattctcctgcctcagcctcctgagtagctgggattacaggcatgcgccaccacacctggctaattttgtatttttagtagagacggcatttctctatgttggtcaggctggtctcgaacttccaacctcaggtgatccgcccacctcggcctcccaaagtgttgggattacaagcatgagctaccgtgcctggcgcagttatcttctcttaaggtcagcaatccaaattagggtaacagtaatagccgtaggcagcttcttaacttgtgttgtcactacacttaattcttctagtctagaaggtcaggcctggcatgacctccattttgcagagaaaagctgaggcctagtaagctaaagtaacttgctcaaagtcccataagccataaatgatagagctgaccaagacttggatctaggagttgactccaaagcctgtcattttaaccactacattatacagcccagtgatcaggaggatggttatgaaataactttattaaacttgcatcccaatctttgttcaaacttagaggctgtcttgatggaggaaggccagctcactttcttggataggccaatagtgatgatcatgaaggaagcactttcttctaatgccctcagagatgctctccctaatccctcactttcagaggcagctagtacctcttgccatcattgccttcagcatgggatcctcagaaaccactgactgagaaacctgcagtatagaacctactatgcatgcattccttaaaagttaagatgactttggccaggcacagtggctcacgcctataatcccagtactttgggaggccaaggcaggaggatcacctgaggtcaggagtttgagaccagcctggccaacatggtgaaaccctgtctctactaaaagtacaaaaattagccgggcatggtggcacacacctgtaattccagctactcagaggctgaggcaggagaattgcttgaatctgggaggcggaggttgcagtgagccgagattgggccattgcactccagcctgggcgacaagaacaaaactccatctcaaaaaaaaaaaaagaaaaaaaaagttaagacgagacttctcccttgccactcctaccccctcacccccagttaaatatgactttcacaaaagatttagagcaactcttttttaggtatcataatacaaaacttccttggtgtccagttaagtttgcaatgagataatttcaggagccactgccctctaggctctgttccaggtatccagaagctagagagaaccactagaaggaggttgtccaaatgcttgaagagcctttcctatatactctgcaggatgtagacttatgtgatgacggtgatgagacttggaattagcaagcttagaattagcaataagttacctgtaagcttgatatgccttcatggacacacacataagcccttttattcttttaggcagttcctcaaatctctaccctggcttggtacaccacactagtgcccctgcttgtggtgctgggcgtcactgcaatcaaagacctggtggacgatgtggtgaggatttctcatacaacgttctactcattgctttgagttgactttaagttctcgtgccttccttctctattgagatgtttaaaacagcatttccccatcttccttctcaaggctcgccataaaatggataaggaaatcaacaataggacgtgtgaagtcattaaggatggcaggtactgtgtctaattagtaactgagtttcaaggatgtaatgcataactctgcctagaaacacattcagagataattattacaatgtagaaggctattagtacattaactgtttatttttttcgagatagagtctcgctctgtcgcccaggctggagtgcagtagcgttatctcggctcactgcaacttccacctcccaggttcaagcaattttcctgcctcagcctccgagtagatgggattacaggcgtgcaccaccatgctcagctaattttgtacttttagtagagatggggtttcaccatgttggccaggctggtctcaaactcctgacctcaagttatcctccttgatctcccaaagtgttgggattacaggtgtaagccaccatgcctggccttaaattatctttttaatgagtatgtacccctgttgtaataaatctaataaggatagtgataaaaatagataaaaagatgactattttgagtactaaattccataggaaatattcattaaaatttttaacatatcaacacttttaaaagttttaaactataatattgttttaaagattttcacatatacaaatgatatacccagtggacgtaatgaacctgctataaataataaacttaatttcactggaggcagtcgtctaatcactatgtgtttatctgccattcatttatggccaaaaatgacttggagatttaaaatactttttaaatatatgtttatgccccagttcccctaatgaatttagtatacaattcttaactccagcattaaaaaaaaaatttggcttatctttcaattaacgaaattgtagatgttttacatttcagtatttctgaaattttaaaatagaaatttgcatgtaagtccgaaatgacaaatggataggccagcaccttcttagcagggctactggaaggcaattctgaatactgaaatattggaggcaattctgttagattcttctatccgatgttccagtttcctctgaggaggccccctgtgctctaccctgctaatgctcaagttcctataggtgtgaccccactgcaggggctgctcaggccatggccctgccagacatgcaccctagacttccaaattcaaggcaacccagagctcctctttaccagtgtaggtaggtatggtacaggctaaacatatgggttggccaggcacggtggctcacgcctgtaatctcagcactttgggaggccgaggcaggaggatcacttgaggccaggagttcgaggccagcctggaaaacttagtgagactcctgtcttttttttttatttttttgagacggagtctcgctctgtcgcccaggctggagtgcagtggcgcgatctccgctcactgcaagctccgcctcccgggttcacagcatcctgcctcagcttcccgagtagctgggactacaggcgcccgccactgcacctggctaattttttgtatttttagtagagatggggtttcaccgtggtcttaatctcctgacctcatgatccactcacctcggcctcccaaagtgctgggattacaggcgtgagccaccgggcccggccgagactcctgtcttaacaacaacaacctcctctgctaggctcattgggacacttattctattttactgaatgaagtgtttcctaatcctagaattgtaaataaagccaattaagatctttaaattgttgtgattttgtcttttgacacttgaaaggtaactttggaacataattttcttatttgcaaaggaaaaaaagccatctaaacatatttatagcttggtatagtctatatttgcattagagtggaagtacggctgtaagtcaggttactttcctcagtgttgacacataaaaagtcttggaatgaggccttagttactatttttagcacttgaatttgcagttctgcctgaagcctcctgctcaaaaaacaactcattactgatccctgagttggtgctttcgtcacagttgactacgttaatttaacaaacacttatggagtactttctgcatgttggaggcaggacagtatccttgagaaatttatagttcaagacagaagatgagacacctacacacatcattctaataaaatccatatcagaataaaaaagataaaaacaaaatgctctgacagtacagggaagggaaaattcactttagcgagggaatgtggggaaagatgtcaagacgtgagcaaagccctgaaaatgatgccctagggaggctgaaggggctgtgtaaacacaagttgtggtgacaacacaaagctccatcagacaactgaccataatccaatttgagtgtagcctcagggccttaaagggaatacagtgtctttgtcagttaagcctttacaattaagaagttaaccggccaggtgaggtggctcatgcctataatcccagcactttgggaggccgaggtgggtggatcacctgaggtcaggagttcgagaccagcctggccaatatggtaaaaactcatctctaaaaaattagtcaggcgtgaaggcacgtgcctgtagtcccagctactcgggaggctgaggcaggaggatctcttgaaccccaggaggcagaagttgcagtgagctgagatcgtgccactgcactccagcctgggcaacagagcaagactctgtctcaatgaaaaaaaaaattaataaataaataataaagataatttaaacagcagagagtaggcaagctctgaagccccacgaagactctgggaggcccaggtgggtgccataatgtaggtgcttctgtcctgggaccagcatggagcaagtgatgggtcactgagaaggaacacagcagggaggcaagttggacataagcaaaaacaaaagggggtggcaagtatttccctgccatgcacataagtggcccccataaactcttccttacatgacctagatgaaaagaatgtatcaaagtcattcatcattgcttccttcagaggtcaatacgattttcatgcccccctttaatatgtttacatccattaaagagcaaaattttagcattttctctgtgacttgcatattttccagaatctataacatccagaaagaatagtaattcccttgcctgtaacttaaaatgtcaataaatcctcattatttttaatccttaggttcaaagttgctaagtggaaagaaattcaagttggagacgtcattcgtctgaaaaaaaatgattttgttccagtaagtgaacaaattctgcttctcttgttccttgttctcccccagcccctgtgctcggcttttccctcagggtctcggtgttatttgtgtgttttgttttggacaggctgacattctcctgctgtctagctctgagcctaacagcctctgctatgtggaaacagcagaactggacgggtaagtgtgtctcgatgggtctgatttaaagctggcctttgaaggcacattcattccactgaaatcggggcattgtggaccagacggcttgatatctggccttgcctctgccacctgctgctgtccctactgatctcacctttgcgcctctgtgaagtggagctcttactacctgcgtttctccacctctcagggaaggtaaaaggatcagacaggagcatatgtgtctgagccctttatcaactgctgagcagcgtccagacagatatgaataatatcgaggttattatctgtgtcagagaaaggaacagatttttaaggtctttaccaataggcaatttatttatttatttttgagacagagtctcactctgtcgcccaggctggagtgtagtggtgctatctcagctcactgcaacctccacaccccctgggttcaaacaattctcctgcctcagcctcttgagtaactgagattacaggctccagcccccacacccagctaatttttgcatttttagtagagatggggtttcaccatgttagccaggctggtctcgaactcctgatctcaagtgatctgcccaccttggcctgccaaattgctgggattacaggggtgagccacagcagctggccccaggaggcaattttgaattctccttgtgttggttttggttactatgctatcatttaaaagagaatgaagttctgtttttgaccagttttctgaccagttttcaaggcatttattgagtgctcacgaggttgccggcactttacatattagctcatttaatcctctaaacgaccatgtgagacgaatattattcgtctgtattacccatgaggaatcggaggcccagggaggtgcagcagcccgcccaaggtcacacagtaagtggtagagtcgggacattgctccctctgctcctcgcgcctcacgctccagatgtgcatacactgctttacagagagcggaaatcatgagactgaaaactagggctgtcattgcttcatagatcaggcaattgactgttggaaatctatcacactttttttttttttttttggcggaaaaaaatacttaaagccaattaaccacttcttaattgtacaggctaattggttaaaaaccaattaaccacttcttaattgtaaaggcttaactgacaaagacactgcattctctttaaggccccgaggctatacccaaattggattatgggcagttgcctgatagagctttctgttgtcaggttggtctcaaactcctgacctcaagtgatctgcctgcctctgcctcccaaagtgctgccattacatgcgtgagccgcggcgcccgactgtttattctcaactataaaactgctattatttccatgagagattctaaagctttacaaagacataagatcctaacatgccctgccagaacagaatggtgaggttgagaatgaacttccctagggaaaattcctgagtattcgtgaatcctatataaagccgtcagtcgtgagacggcagcctcacccttgagagcacctgccccggcctgcccttgtgcccacccacgaccttaccttgcactatggtggggcagttgggagtaaagctaagacttccttttccaaataaaattgtctttcaaaaacatgtgatccagttattcactctggaaaagaatttgacagaggcgaaacagaatttctgtaacaaatatgtgttatagaatcattttaatgtgattaaatattagacactacattttcaaacagcactttggtagtcctagctgatggtaaagttaaagttaatgagaaggatgtttgtgggtacctctgtcctaaccttcacaacaacaaacagtgaagggaaccaacatttcccaaggtcagaaattttctcgacttcaggggataaccttttccaaacctgaagttccaaggtgaacagagtttgaaaatagaaacagctaattatttaggcttcatgtccaggtatggctaatgtaactttggatgattaacttccattttgaactcaaaaatttgttcatttaattcattttttccccattcctttagagaaaccaatttaaaatttaagatgtcacttgaaatcacagaccagtacctccaaagagaagatacattggctacatttgatggtttgtaccaaacatgtcttactttgctttaaattttagttgcttggttcaattcctattgattaaaaccagaaagacttttgtatgtgattaattatgtgaatcttatatttttaaaaggttttattgaatgtgaagaacccaataaccgactagataagtttacaggaacactattttggagaaacacaagttttcctttggatgctgataaaattttgttacgtggctgtgtaattaggaacaccgatttctgccacggcttagtcatttttgcaggtacgttcagagtttcttgggaaattaatcagctatgatctttaaagacttagaggggattgcttttctgtcctttgtccatcaaaaccaaaagaagagtaatagcatcatgagcttttttttttttttttttttttttttgagacagagtctcactctgtagcccaggctggagtgcagtggcataatctcagctcactgcaacctctgtctcctgggttcaagtgattctcctgtctcaggctccagagtagttgggattataggcatgtgccaccatgcccagataatttttgtatttttagtagagacagggttttgccatgttggccaggctggcctcgaacccctgacctcaggtgatccgcccaactcagcctccaaaactgctgggattacaggcgtaagccaccatgcctggccaagaagagtaattttattggtgagctagtgaattgatttttcccaactgatgactacattgaattttccattttcaggtgctgacactaaaataatgaagaatagtgggaaaaccagatttaaaagaactaaaattgattacttgatgaactacatggtttacacggtatttatttttcatctcagtagatctctcatctaaattgctgtcttttgcactaatattatcgtatgtttttctaatacaaaatcttacctctttaggtggaatagaaaaattattgggcactccaagcttcaaatgcaggaagaagggatttttttttccagaaatgccttactttttctcagaaatgccacacttttaacaggagaattcccttgggaagggaaatttcggttgtagggtgccctgagtgctttgatgacgggaactggaaaaccaggaagccctagataaattagtgaagctggactcctgaagtcaatgtagggttgatttcattgctgttactttcccatagaggcagttctcttagaagcaagcctcccccagcacccccaacatatactgtatagctccaaatacaaggcaaggctaaaaataaagtatgtcgaggacactcaagaccactcccaggtttgatgattcactggaaggactcataggcctcagcacatagtcgtattcacagctgtgagtcattacaacaaaaggacacagagcaagatcaccaaagactcatggagcaaagtgcaaaggaaaccaggcacaagcttccaaaagtcggccgtcctgcccccactccccaccaaaccacacacacaataggcacttaattctcccagcagcaattaatgacaccacatgtgaaatgttgtctataccagggaagctcatgagagactcagtgtcaaaggtttttaacaaaaaaactctagactccccaaaagaatgcagatggtcagcataaaccatgctgtttgcacagttaggcatcatgagtttttttattattattattatttgtttttttttgagattgagtttcactcttgttgcccaggctggagtacaatggcatgatcttggctcactgcaatctccgtctcccaggttcaagtgattctcctgcctcagcctcccaagtagctgggattacaggcacctgccaccacacctggctaatttttgtatttttagtagagacggggtttcaccatgttggccaggctggtctcgaacccctgacctcaagtgatctgcctgcctcggcctcccaaagtgcttggattacaagcatgagccactgcacccggcccatgagctattcttatcagagaataaaaaataactgggaaatcctccaaacatctaagttaccagataccagcccagggcgaaccttgcaagccggccttcggaggaagcagtctcagacctgctatgtttgcccttttctgcccacgtggtgaccccaaatattaagcactccttctatttcccaatgaaaaattttttcaagtatttagttcaatttgaatgcatacttctaatacttattctttgattgcatatacatgtttaaaatcacataaaaataataatttaagaaacattttcccctgctttctcatttcatgaaaattgtatttgaacttttcacattcatctttggtgtcatggttgtggttatccactctcaaagagcctgtttggcactctgctctttccacgacaaagttgtgagatatagcacttttggactccatgtccagaaatttaaatttgtctctggaaattttattcccacttgcgaatctccaagtatcactaggatggttgactttttattccttccataaatatatgctcataacttctacgacataatacttatcatattgcttcttaagtgatcttattttacaatgtcatgcaatacttatgacattacaccttaaggaataatcgcccaaatataggtgaaattttcttgccctgaaaaaataattctggctgggcgagggccacctgtaatcccagcagtttgggagactgaggcatgcagatcacttgaggacaagagttcgagaccagcctggccaacatggtgaaactcgtctctactaaaaagacaaaaattagccggccttggtggcgcgtgcctgtaatcccagctactcaggaggctgaagcataagaattgtttgaaccagggaggtggaggttgtagtgagccacaatggcaccactgcactccagcctgggtgatacagtgagacgctgtctaaaaaaaaaaaaaaaaaaaaaaaaaaatctgttgaatatcttctataagcattccagttttccagttcagccttgttggaagttgtttcatgctaagtaagatatcttccccaaacagtatgttattgttcaaagtaaacgtaattgagagaatgccctgtaatataagattcttcaaggatttgaatataagacaccaccttctctttggagagataattttgggaacaaaaccttaccttctatgggagatgtaggatacatcagtcaatcgcagcaatcaaatagactttcaaagcgttatgatagtgctgtttttatttgacatatattatttttcagactactaaattctcaatcatatgaagtattgagtaaggttaattagcatctaggaaatgcaagaggttggaaatccatcttcagaatgcatttaaatgttttctgtcttctagatctttgttgttcttattctgctttctgctggtcttgccatcggccatgcttattgggaagcacaggtgggcaattcctcttggtacctctatgatggagaagacgatacaccctcctaccgtggattcctcattttctggggctatatcattgttctcaacaccatggtacccatctctctctatgtcaggtaaggctgtcctctctggcattttgctttaatggaagaatgttgtaccttctcccaacatagtgccttcatttctagtgatcactgtttcaaaggtcacaaagaacaggtaagaaaatcatgttcatttcagaattgagggtaagagaggaaaaggaaattaacatttgagtatccactctgtgccaggcaccttttatctcatcctgtttgcagataagggtagggaatttcaaagatcgattgctactcctgtagtcattgtcttattagtaaggttcccttctcaccgggttccaaagcccagacttcagaaagggactgggaggaggggaagatttagcaggtgatggaaaaacttagttttcccttttggaagtggtcctcacctcttatctgagcctttattatcatctgccacacccaaggtggagaacttgtgctttccggccactacctcctagtaggaaagaaactccctgtccttcatcaacctctcaaaatgttctctttttcatctcaaatctcaaccacaacaacaaagtcaggggcatatctccgataagtggtaagcagctgatttggtgatacttcttcattttttacttttactttttttttttttttttttgagatggagtttcactcttgttgcccaggcaggaatgcaatggcatgatctaggctcactgcaacctctgcctcctggatccaagcagttctcctgcctcagcctcctgagtagctgggatcacgggtgcccatcaccatgtctggctacttttttgtatttttagtagagacaggtttcaccaagttggccaggctggtcttcaactcctgacctcaggtgatctgcccacctcacctcccaaagtgctgggattacaggcatgagccaccacacccggcctttttctctttttaatatgaaagttcactgcccttggccaaactgactttgagacctttttgggagggatagtgctttggaataaacccagcagccagagttcattcttagttctgataaagaatagcccagagacataggaatcacatacacacctataattagaggcatttattttattttagtgtcattatatgtgcatttgctttatttttaatttgattacatgtagttactgttgttcttttaacatgaaggaaagccctggggcagccatctgttccacagctactttgagaaaaaccgagttgagtgttacctttgtcaagggaactattacatagataattttgcctaaaaccatcaatgtgtattataaaagaaactgtatacataattttatataaaggtatgtcatgtgacaaatacgatttcttttttcttggagataaaggtcctttgaaaacatgctggagcaagttcttccagatagtatctctgctttgacttcaaacctcattcagaataaacccaaccccagggccccaagtgtgatctggtgctcagccttccactccgcccgtaccttctgcacctcagcccacctccctgggcttctgccactctggccccttgatattcttcctgcacagggcctttgtccctgctcttttctctgccaggggcattccttacgtaggtatctatctgctcccctttcactacaaaggcctttactcagacaacaccttattaccctgacctttcctgactcattctgtttctgaccacttctccttcctggagatcttcatatctccttaccttgctttgctttgatttttgtttgtttgtttgttgtttgtttgttttgttttgagacagagtcttgctctgtttcccaggctggagtgcagtagcgcgatctcagctcactgcaacctccacctgctgggttcaagtgagtcccctgcctcagcctccttagtggctggaattacaagtacatgccactatgcctggctaatttttgtatttttagtagagacggggtttcaccatgttggtcaggctggtcttgaactcctgacctcatgatccgcccacctcggcctcccaaagtgttggaattacaggcgtgagccaccacacctggccccctgctttgattttctgcagagaactttcacctctgatagagcctctctttattaatttatttgtctgtctctactagaaagtaacctccttaagagaaaggactttgttttgtttacagacatgtcccctgcacctagaatggtatctggtacatagtaggcacttaggaaatacttacggaagggagagaagtggggagagcatcatttttccatctgtttaacttgttaaggacttccttggcccacctaacaattgctggctatgtaaacagcttccttataactgagataggtaatgtcccttatagttttaaaattcagatgatccttttataatatcttattttggatattctataaccttatcataatttagggatcatgatttggggtatttgccaaaagccttttgccctgtttgagagcacagtggagtctgtaccctagggtactctcactccctctgccctaccacttagggcaaaggtgaacatggccattccagtgcccctgggtgctatggggaatgggggaagagtcaagcttgctgtgtccactgctctgtctgcagtgttgctgtgtcttccattctgctgggctgtgtattctgaacatgggtgccttggctaaatgtgcccaggagtgagtgggaaatctcactgagcaattttgagtggaaattacttgtctaaaatcagcttgaccctgaagcctgagaatgatgcatgtggttaggagaaaccagaggctgagtgcatgggcttgtctccttgtagagggcttagtttgggctgatataacaaaagaccttcgaaatttattgctcagagttctggaggctgggaagtctcaaatcaaagcatcggcagattcagggtctggcaaaggctcactttctgctttataggcacagccggtgccttctagctatgtcctcgcatggcagaaggggcaagcaagctcctttgagccactttaataagggcactaatcccattcataagggtggagccctcatgacctaatgaccttctaaaggccccacctcaatactgttgaattggggattgggtttcaacatatgaatttggagggggattctaacattcagaccatagcagtaaataagcagcttgctctcgtctgtacaatgagaataaaatctctactacttgccactcgtatccgagctctctacggaaaataatcttctgtcttcctagcgtggaagtgattcgtcttggacagagtcacttcatcaactgggacctgcaaatgtactatgctgagaaggacacacccgcaaaagctagaaccaccacactcaatgaacagctcgggcagatccattatatcttctctgataagacggggacactcacacaaaatatcatgacctttaaaaagtgctgtatcaacgggcagatatatggtaagtggaagccgtcactcattttctgggtgagtggggctgcctgccgtgtgcaggtcattacttggactatagcctgtctcctggcattgctggtgccctctcgatgcagagtcctgctgctagggccattctccagctaagcaccagaggagcaccatggacagcactggggacacatgcgtgggagaggacagtggccagaagtgggctcacagccaggcgtggtggctcaggcctgtaatcccagcactttgggagggtgaagtgggcagatcccaagaggtcagggatttgagaccagccttgccaacatggcaaaaccccgtctctactaataatacaaaaattaaccaggtgtggtggtggcgcacagctataatcccagctactcgggagactgaggcaggagaattgcttgaacccgggaggcagaggttgcagtgagctgagatcacaccactgcactccagcctggtgagagagcaagactctgtctaaaaaaaaaaaaaaaaaaaaaaaaaaattagaagtctcattactatatgatctagcaattccacttcaggttatatactcaaaagaactgaaacaggggctcaaagagatatttgtacacctatgttcatagcagcattattcacaatagccaaaagatagaagcaacccaagcgttcatcaatggatgaatggataaataaaatgtggatacgcacaatgaaatattattcagtctaagaaaggaaggaaaatttgacacatgctacaacacagatgaacctgaactcgtttatgccagaggttgcaattttttgaatttttgcaatcagaacttggtgatgaccttgagcagtaggatataaataactcccacatgcttagcgttccaataatggaacactaggcataaatgggttaaggacattatgctaagtgaagtaagccagtcacaaaaggacaaatgttgtataattctacttatatgaagtacttagaataatcagatttatagagacaaagcagaatgatggttaccaggggctggagtcaggggaattgggagttactgtttaatgggtacagagtttcaattttgcaagatgaaacagctgcacaacagtgtgaatatacttgatgccactgaactgtatgcttaaaagtggttaaaatgggctgggtgcagtgtctcatgcctataataacaacactttgggaggtcaaggtgggaggattgcttgaggcccagaattctagaccagcttgggtaacaaagcaaaaatttttaaaaattagcagagtatggtgctgcatgcctatagttccagctacttgggagactgaggcaggaagatcccttaagcctgggagttgaaggctacagtgagccaagatcacaccacagcactccagcatggctaacagagcaagaccctgtctcaaaatagcaacaacaaaaattggttgactggtgtgcagtggctcacgcctgcaatcccagcaccttgggaggctgagtcaggcacatcccttgagcccaggactttgagaccagcctgggcaacatgacaaaaccccatctctggccgggcacagtggctcatgcctgtaatcccagcactctgggaggcctacgtgggtggatcacaagctcaggagttcgagaccagcctggccaatatgatgaaaccccatctctactaaaagtacaaaaattacctgggcgtggtggtggatgcctctagtcccagctattcaggaggctgaggcaggagaatcgcttgaacccgggaggtggaggttgcagtgagcaaaattgcgtgtgcctgtagttccagttacttgagaggctgaggtaggatcacctgagcctgggtacgtcgaggctgttgtgggctgggtttgcaccactgcactccagcctgggtgacagagtgaaaccctgactcaaaaaaatcaaacaaaaaatcggttaatatggtaaattttattatgtgtatttcactacaattgtttgttttctttgttgtttttgtttttgagacagtgtctcactctgtcaccaggctggagtgcagtggtgcgatctcagctcactgcaacccctccgcctcccaggttcacatgattctcctccctcagcttcctgggtagctgggattacaggcacacaccaccatgcctggctaattgttgttgttgttgttgttgcttttttgtagagatggggtttcaccatgttgaccagactggtatcgaacccctgacctcaagtgatccatctgcctcagcctcccaaagtgctggggttacaggcgtgagccaccacacccggcctacaattgtgtttttggttttgtttttgtttttttgagacagagtctcactctgtcgcccaggctggagtgcagtggcacgatcttggctcactgaaacctccaccttccgggttcaagtgattcttctgcctcagcctcccgagtagctgggactacaggtatgaaccaccattcccagctaattttgtatttttaatagagatggagtttcaccatgctagccaagctggtcttgaactcctgacctcaggtgatcagcccatctcagcctcccaaagtgctgggattacaggtgtgagccaccacacccagccaattgttttaaaagttgatttcagttctaattttctgaaacatttagaaatttaattttatgtaaatttagagataatattaaggctaatactagattcaaatagagtgctattttaaatatacttaatagcacaattgtttaaaatgatatagggacatgcatatatacttcctacttgtaggcaccgtgagtgccttttctcataagaagtatcagtgaagatggtagggcactgaggggctgaggacgtggctcacatatgtgagtccttctgacttgggagaggtaaagcatttcaaaggatatgattcaggcccctaggagaaggtagtggagagggacagccactggtatttgaatatctagaccaggggtcatctaacgttttctgtaaagtgccagataaatattttagcctgtccaggccgtatatggtcttatcaccatcactatataagcaaagccaggtaaggaggggcctctggacataggtgtagaatcaatttgttttgtcctgtttgtttctcaggggaccatcgggatgcctctcaacacaaccacaacaaaatagaggtaagacctttaagccgaagaatcgtttgggatgctggggatgtcagggtcccagcagggccatgcttcctttgaaggtctagggaagactctttcgttgcctcttccctgctcctggtggttgcccacagtccttggtgttccttggcttggagacttggaaacacaactctgtgtctctgcctttgttgtcacgtggtgtcccccgtgtgtctgtgtgtctctgtccacatttccccttctaataaggataccaatcattggattaggacctaccctaattgagtatgacctcattttatcttgattacatctgtaaagaccctgtttctaaataaggtcacattcataggtaccagaggttagaatttcaacatatcttttgggggaacatagtttagtccaccacaaagtaccttttgactaggcatggtggctcatgcctgtaatcccagcactttgggaggctaagtttggcagatcaattgagtcaaggagtttgagaccagagaaaccccatctctacaaaaaaatacaaaaattagccaggtatggtggtgcatgcccgtaggcccatctactcagaaggattgcttgagcccaggaggtggaggttgcagagaactgagatcaagccactgcactccagcccgggtgacagagtgagacccatatatggtcatatatgtttccaaaaaaaaaaagggggggagctttttatttaagacagttgtgagcctcttgacatttaagaatgtgctaaaatcctaaggtggtttttgcataattgaaaccttgcctttgaagaaaagttcatgtcatttgttaagtcaaaaatattttataaaatcatattttgtttttctccatttctttcagcaagttgattttagctggaatacatatgctgatgggaagcttgcattttatgaccactatcttattgagcaaatccagtcagggaaagagccagaagtacgacagttcttcttcttgctcgcagtttgccacacagtcatggtggataggactgatggtgagtgtttctctggcatctcaggcattagagaccaggttttttgtttccaggtaactcctgcttatggctcaaatgcatgtcaagtagtacacaaatctgtctcatattagaatgcagtgaatatttctcagcacttaccactagatggtttatggaagagcaaagtaggaaacaagcttcttgtccctgaaaatttacacttattcatagctatagctccaggtgtatttttttcactttgcaaatgaaatcttgttgaaagaaatgattggtacttgaactatgatagaagaaactaacttttcttagcacatttattactgagcattgactgagagtgaaaagtcaagctttatctgtatcagaaatggactttgaacttgactaatcttttctaccaaataatttcagatatatgctcttatttactagattctgttatagtttgggtttgaaataatatgagcctcagcctggatctctttaaggtgcctttttccatttaaaggagcataattaatgtgaatttcatgggaacaagccagaatggcttgtaggttcctttgcagaatcctttgatgcagtttgtgccagctttgtcacagcaagtttgtcctgtatcaaggaaagctagtcattttatcacaaatggtcataatgataaattatatagacacacatgcactttatagaaagagcaaaaggagttcttttggtgtttctgtaataaagcgtagtctgccttcacttcattccctcacttcatccacttcactacatcttccactttttacttcagtcagtgcggcatacataagtccctctcttttctcaaccttaatgtttcatatgtagcaggtatgaaatttccagagaaggaatatgcataaaaactaaatgtgtaggccaacgcttggtggctcacacctgtaatcccagcatttggaaggtcgaggtgaatggattgcttgagctcaagagttcaagaccagcctgagcaacatggcaaaactccatctcaccaaaaaatacaaaaaattagccaggtgtgatgggacatgcctgtagtcccagctactcaggtggggatcgcttgagcccaggaggtcaaggctgcagtgagccatagtctcaccattaccctccagcttcggtgatggagtgagaccctatctcaaaaaaaaacaaaaaacacctaaatgtatagaagctgtacatgatacctttcagcaagtttcaaagaaacccattttccaaggatgaatctaatattgcaatgaagcaaggtaacagagttcagattagggtggatacatggaagggtttatcagcagatgatgtggggaaggatagaaaggggcgataccaggtcctgaatcatggaagcagaggtctaagtctatttgactcaccaagccaattttacccaggcaataagcataaagtatgatattacaaagtcacctggttctctttggttttgactcataagcacaattattgtactcttctctgggtacgtgataggattttaagggctaactggccaacttaggcaaatgtaaattcatcctgtggtccctattctatctttccccagtgggatattatgggaagagccctggactacatgctagagatgagtcagcccagtctgggtccctctctgagaaccaccttcctcggtgttgtagtaagaaggttggatgtacaaagttccttccagcagggctgggcgcggtggcttacacctgtaatcccagcactttgggaggccgaggcgggcagatcatgaggtcaggagttcaaaaccagcctggccaacatggtgaaaccccatctctactaaaaatacaaaacattagccaagcatggtggcatgtgcctataatcccagctacttgggaggctgagacaggagaatcgcttgaacctggcaggcagaggttgcagtgagccaagatcacgccactgcactacagcctgggcaacagtgcaagactccatctcaaaaaaaaaaaaataacacaaagtccctccagcctgacataccgcagctctttgtccactgtcagctgaggtcaagggttgtacgaatagagacatgttggcttctagtgcaggagcttagagaagaaattgctttcggcttttaaccataaagtaccaggaaaggatcccttgaaagggaccctggggactacaccttcaagttttgttttttgtttttgagacagtcttgctcttgtcacccaggctggagtgcaatggcatgatctcggctcactgcaacctccacctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgcctcagcctcccaaagtgctgggattacaggtgtgagccaccatgcctggccaggtagtttattgtcacttaattagagtgagccgggtgcagtgattcacgcctgtaatcccagcactttgggagtctgaggtaggcggatcacctgaggtcaggagttcaagaccagcctgaccaatattgtgaaaccccacctctactaaacatacaaaaattagctgggcgtggtggcgggcacctgtagtcccagctacttgggaggctgagacaggagaattgcttgaacccgcgaggcggaggttgctgtgagccgagattttgccactgcgctccagcctgggcgacaaagtgagactccatctcaaaaagaaattagagtgaatcagctgaggcagttgtgaaggagagaagaaaggtgcatttagctttctctgccaccattaccctgaagctagggaatcaggttgatgagaactgagaggtgggatttgtggtttgagcatctttctttgattacatcaatttcatgagccacaaattagtgtgtgaaagaaaaagaaggactttctggttgcctctaaatgtgccataaataaagagttttcttaggaaggttgctttgtttttgtttgtttttttagtttgtttttacaccttcaatttttattttaggttcaggggatacatgtgcatgtttgttacatgggtatattgcatgatcctgaagtttggggtacaattgatcccatcatccaggtagtgaacacagaacttaatagttagtttttcttttcttttttattcttttttttttttgagacagagtcttgctctgttgcccaggctggagagcagtggcgcgatctcggctcactgcaagctctgcctcccgggttcatgcattctcctgcctcagcctcccaagtagctgggactacaggcacccgccaccatgcctggctaattttttttgtatttttagtagagacggggtttcaccatgttagccaggacgaaaggtcagcctgctgcgttggctgggaatcgaagtcgggtcaattgcttggaaggcagctatgctcaccactataccatcaacaccacactcttttcttttctcttctttttttttttttgagatagaatctcgaactatcgcctgggctggagtgcaatggtgtgatctcggttcactgcaacctctgcctcccgggtttatgcgattctcctgcctcagcctcccaagtagctgggattacaggtgcataccaccacacgtggctaattttttatatttttagtagagacggggtttcactatgttggccaggccggtctcaaactcctgaccttgtgatccacccgcctcagcctcccaaagtgctgggattacaggtgtgagccaccgtgccctgccctaatagtaagtttttcaacacttgttgccctccctccctcctttctcttgaagtccccactatctatttttgcagtctttatgtccatgagtacccaatgttaagtgagaacatgtggtaggtatgtggtcttctgttcctgagttaatttgcttaggataatggcctaatctctattgtgacaaaggacatgattttgttcctttttatggctgcatagttttttagtccaagtgtcttccagcagtcataaggttggaatttggaccaagtcactgacgttcttcccatctctgttagtctgcaattctgtgattccattatcagaaggtaatggaaaacatttttttttctttaatgataaaaatatcaaggtgtttgctctagatatgagtgtcttacttgtgggaactttaccactttttattattttgttccttttctctgctggaaatgcgtttgctgtcaatattatgccatatatcgctgtgccaacttaagttgccgaagggaaaggctttgttctcaccgctgctgatttgtctctggttaaatagtttgccctctagcatttgtatatgattgctagatggccggatttaggaagtgcgtttatagcttctagtgaatgactttctgagtgaacaaatacagagagaccctaagtgtcatctttaattattaattaggaagtgattaatattgacttaaaaagtgaatcctctgagccaattgtgaaggaaggaaggtgtgtttagctctctctgccaccgttaccccagagcaccaaccattccaagtgaggctggcggataaacagctgctcatgcatctgtggccttcatcctggtcaaagtattttggaaaactaaatgctctttctgtccaaagtcatctggccacggaaatgcttttccttctattttgagacaaaataactagagtagaaaaatagaagatcttgggtagggagagtattttttaaactttttattgaagtacaacatgtgtatacagagatatgtacgtatcataagtatataactcaatgaattttcacaaaccaatactcttgtaatgagcacccagatttttaaaaaagaacattatcaatccccctagaattccctttacattcctttccagtgattacaagaaaagtactttcctgactacgaataacacaggttagctctgtcagttttttggcttatttcagtggaatcatgtagcatatgtactcttttgtgtatctggctgtgagatttattcctcttcttattggttttttcttttttcctaaaagagactgcatcttgctctgtcagccaggctggagtgcagtggaatatcaaagctcactgtaacctcacactcctgggctcaagtgatcctcctgcctcagcctcctgaatagttgcaattataggcacgtgccactgaacctagcttattcttattgttgaaatgtagttgtgaatagaagacaattttccattatttaacttttaaacattaagatatcggatagtgatcaaactaaggttggttggtttgtttcaacttttctttctttcttttttttttttttttttttgaaatggagtctcggtctgtcaccagggtggagtgcagtggcgagatctcggctcactgcaacctccaccttctgggttcaagtgattctcctgcctcagcctcccgagtagctggaactataggcacgtgccaccatgcctggctaattttctgtgtttttagtagagacagagtttcactgtgttagccaggatggtctccatctcctgacctcatgatctacctgcctcagcctcccaaattgctgggattacaggcgtgagccactgcacccagcctgtgtggtttttttttctttttttttttaataaggagaatatagctatggtaaagaaaaaatagcctgggcaacatggtgagatcctgtctctacaaaaaatacaaacattagctgggcgtggtgatgtgcgcctatagtcccagctactcaggaagctgaggtgggaggatcacttgcgcctgaagcgatcaaggctgcagtgagctgagatggtgccactgcactccagccttggtgccagagtaagactgtctcaaaaaaacaaaaaagaaagaaagaaagaaaacatacttttttagagggaagataaactggtacaaccttcttggaaaacaaattagtattgtataccaatgagttttaaaattatcagtgttctctggctcagtattttcctaataggaatctgctcttagaaaataagccaggggcccaggggcagtggctcatgcctgtaatccgaacactttagggactgaggcaggcgaatcacttgagtccaggagtttgagaccagcctgagcaacatggtgaaaccccgtctctacaaaaaatacaaaaaattagccaggtgtggtggcgtgtaccagtaatcccagctacatgggaagatgaggtaggaggatcactgagcctggggagattgaggcttcagtgagccatgatcgtgccactgcactgcaacctgggcaacacggtgagaccctgtttcagaaaaacaagaaagaaagagaataagccaggtgaggtgacatgagcctgtagccctagcgactcattaggctgaggcagaaggatcacttgggccccggagatcaagagcagcctggacaacatagggagacctctgtctctaaaaagaaaaaagaaacagaaaaatctttacacacatacaaaagggttattaaagtgtgactttttgagagtaaaaaaatttggaaattaagtgtctgtaatgggaaaatgataacatatttacatttgttcaaatgtttataaagaatttaaaaagggatggcaatatgctcagatacagcattaaaataatcaggatgtaaatgtatattcagcttgatagaaacaatttcagatacagacattttaaaaggcactggagggaatgataaaatgtcaacacctgttgtttctcctgtggatggtgggattatgggaattttccctcattctccaccaatgtttcttttttagtttatattactgtttataagtcaagataaaacaaagaagttttaatcttggcataacccttccaagtcaatgactcgttttcctggggatgttttgggctttgcagcccatctgacccccacaggagcctcagcagaggcctcaacaatgagctctgcatttgtttttacagcttttctgggatttctctcgcttccttgttaggtcagctcaactaccaggcagcctctcccgatgaaggtgccctggtaaacgctgccaggaactttggctttgccttcctcgccaggacccagaacaccatcaccatcagtgaactgggcactgaaaggacttacaatgttcttgccattttggacttcaacagtgaccggaagcgaatgtctatcattggtaagtccccctcagagtctgtctatgaatcgctcatttagatgttgcttgtgcccattgtattgagtggcatcaggataaagcagccagtgaaagagctacttggctcctgggagatttctgcagctttactgaaactggtattgttggctgggcgtggtggctcacgcctgtaatcccagcactttgggaggccgaggcgggtggatcacgaggtcaggagatcgagaccatcctggctaacacggtgaaaccccgtctctactaaaaatacaaaaaaaattagccgggcgtggtggctggcacctgtagtcccagccactcgggaggctgagacaggagaatggcgtgaacccgggaggcagagcttgcagtgagccgacatcgcgccactgcattccagcctgggcgatagagcaagactccgtctcaaaaaaaaaaaaaaaaaaagaaactggtattgttttcttcattcttcactgtgttccctactcaaaggggtagccacagtatctctgaatcttgcaaatgctgctgacgttcttttttaatccctctcttttttttcttttcttttcttttttttttttttttttttgagatggagtcttgctccgtcacccaagagtgcagtggtgcgatctcaggtcactgcaacctccgcctcccaggttcaagcgagtctcctgcctcagcctcctgagtagctgggattacagctgctgacattctttaaccacgtgggctgccagatgctgaatctggggcagcaggtggaacatttctgaagcagcaggtagacatttgtagcagtcttttattttaaacaacacatgctcttttattttttgagcacctctgagtgctctcttctgtacttgatggcagggaagggaggactcagcaggaaaagatttctgagaaaagcaaagctatgcttatgaatcaaaatcatatctgcaatgcaggcacataacagaccaccaagtgaagatgaaaatcacttcctaccactgaactgctttaaattcgtaatttgaaataatctcaaacttatagaaaagttacaagaatggtttaaagagccctcatactcttccatatccaccaattgttaacataatgaaatttcatttacatatctctatatatagatctaatatatatctaattatatatatgtaatttcattatatatacctatatatatacacacatatatatgtacacacacatacatacaggttattgttttctgaaccatttgagagtaaattgcattagaaggagcaagattacatgataaaaaaagaaaataaaaatataaaaaagagaataaattgcaggcctaatgtccctttcccctaaatactgtactatataccatagtaggtatttcctaagaacagaaacactcacttatatatacagtgcaatgttcagaaccagaaaatttaacacagtacaatattatctaatcaatagactttatcagattttaccagggaggttcattctttgtttttctggtccaggatccaatctaagatcacaggttatattaggtgatcatgactctgagtcaaggacggttcaatctctttttgatctttcatccattgatatttttaaaaagcacaggctggttattttataggctatccctccatttgcgtttgtctgatgttccctcatgattagagctaggttacacattgttggcaggaagagtccgtaagtgatgctgtgcttttctttaagtatcacatcagaaggtgtatacacacacacacatttatatttatatatatatacatatatttatatatttatatttatatatatacatatatttatatatttatatttatatatatacatatatttatatatgtgtgtatatatgtagatacatgtatatatgtgtatatacatgttttatatatatatatatatatatatatatatatatatatatatatatatatactttttttttttttttttgagacagagtttcactcttgctgcccaggctgaagtgcaatggtgctatctcggctcactgcaacctctacctccctggttcaagtgattctcctgcctcagccttctgagtagctgggattacaggcatgtgccaccatgcctggttaattttgtatttttagtagaaacaaggtttctccatgttggtcaggctggtctccaactgccgacctcaggtgactggcccgccttggcctcccagagtgctgggattacaggcgtgagccaccctgcctagccagaagttatatattattggtttgtctcattaatggggatgttaactttgatcacttggttaaggtggtatctacaagccttctccactatgattgaatttttaaccaataaaaatatacaggtttaactattacaccctccttaggcacacttactgaacgctttctgtgtcccttacacagatctagactgattatcatgcttgccatctaccttgatttaaaatctggttaacagtgagggatgtattacaattattgcattaatcaaaaaacccaaaaaaaatggtcattaggagtggtgttgtggtcgaagtattaaaagcagtaagtgttgtgagttcataggtgagaaactacctgttggttggatggagaaaaagtctacaaaagaaagtaactagaacatggcatagcacatggtagggagtcagtaaatatttgttggaagaataactgaggttataaaaaacagagctgactgtgaaggaatctttttatatttatttcactattacattcaatgtagataatgacttaccagttttgttgaaggcaacacttttctagaggaactgatggttttaagctaatagtgaattatgagatagtaacatttcaaattaactttataaatgtagttttctattaaaaaatcaaacttagctgggtgtggtaactcacatctgtaatcccagcattttgggaggctgaggcaggaggattgcttgagcccaggagttcaagaccagcctgggtaacatagtgagacctccaatgtctataaaaataaaaattagccaggcatggtggcatgcacctgtagtcccagctactcgggaggctgagatgggaggattgcttgagcctggggggtcgaggctacagtgagccgatactgaactgctgcactccagcctggacaacagagcaagaccctgtctcaaaaaatatatatataaaaaatcaaactttgttgtgtttatttccttcttttactaccagtaagaaccccagaaggcaatatcaagctttactgtaaaggtgctgacactgttatttatgaacggttacatcgaatgaatcctactaagcaagaaacacaggatgccctggatgtaagtttcacttttattctttctgcaagggattctgaacttattctctgatgctgtctgttaagtttgcatgaaagctgtatgttaactgctgaccctccctttgctttgcaatagttggggtggaaagagcagtaaagtaggaatacagccacctgggtcccagttctgcccctgccactgacttcctgggatatcaccatggtgccctctcccagcatgtgggtcttcaaggtctataggactgaggcaggggaatggcttagctctcttccagtggccttgagcaagctacataaccatactaggttgtagtcttactatgtgtgtggtccccaagacctccactaacttcaagttgtagtgcaaaggaaggaaagcattcatatgtgacaggatgacagagctgactataggtcacatcttgtctagccaagatggcagaagcggttcaactgattgagtatttggtgtctcatgcctgtaatcccagcactttgggaggccaaggcgggtgtatcacctgaggtcaggagttcaagaccagcctggccaacgtggtgaaaccccgtctccactaaaaatacaaaaaaattaactgggtgtggtggtgggcacctgtaatcccagctacttgggaagctgaggcaggagaatcgcttgaaccccagagggagggggtagagtgagccgagatcgtaccattgcactccagcctgggcgacaagagcaaaacttggtcaaaataaaaaagatgtgactataaagtaatgagatgtttactggttcatgttgaaactgtttaaaatgtttaaatcaggctgggtgcagtagctcacgcctgtaatcccagtactttgggagggtgaggtggcagatcacgaggttaacagatcgagaccatcctggccaacatggtgaaaccccgtctctaccaaaaatacaaagattagccaggtgcagtggcacccgcctgtaatcccagctactcaggaggctgaggcaggagaatggcgtgaaccagggaggcagaggttgcagtgaaccgagatcgcaccactgcactcaagcctgggcgatagagtgagacttcatctcaaaaaaaaaaaaaagaaaaagaaaaagaaaaaaaaagaaaatgtttgaatcgttcatcatgggaaaattgccagatactcttttccattaaaagctttgacctcagctttaacaatggcttgtgtattttagaattggtttgagggaataatgctcagtggagagttcataggtgattggacttgtatcacagtttgttggaacaagttataaagttgtcaggttcgtgcttatgtcattacaccccaaggcagctcccttggtctgatattttcctagtcatgaagagaaaaagagaaaatgagaaaatgagaaaggtaatagaagatttagaagaaaggtaagcttttccctttggaaactggaagtgcagtcctggaccctatagaagtttagaaaagcaaagtctattataaagtgatgtttaggctgggtgcagtggctcatgcctgtaatcccagcacgctgggaggctgagttgggcagatcacatgagctcgtgagttcaagaccagcatgatgaaaccccatctctacaaaaaaaagtacaaaaattaccaggcgtggtggtgcacacctgtagtcccagctacttgggaggctgaggtgagaggatggcttcagcctggaaggcagaggttgcagtgagccgggattgcatcactgcatcccagcctggatgataaagccagaccttgtctcaaaaaaaaaaaagtgacatttaatcccctctctaaagtgtatttgtacagaatctgtcatgtttaatgatctctttttaaattctgttagtatattacttcaaagtaaaatttcagacttgatcctgaattacataaattaactattctttgcattggtggatttatttttttaaataaaacagatctttgcaaatgaaactcttagaaccctatgcctttgctacaaggaaattgaagaaaaagaatttacagaatggaataaaaagtttatggctgccagtgtggcctccaccaaccgggacgaagctctggataaagtatatgaggagattgaaaaagacttaattgtgagttttagccttaataactttttctttgatattctaagcagaattgaaatttttattaagttttattgaatatttgatctcatgcttaagagataattgtaacttcagcatttgacactggcacaatggaagaaggttatttcttttattcaccaaaataggagcagaacagaagttgccattatgagaaaccaaaagacaaaatacattaggagaagttctaatttaattccataatttgtatatcacttattaaaatttattataatttttaaacaataacaaacctgcatctaatacttattacattgggggaattaccgaaacaattcatattctgcaaaatcttgaaataagaaaaatatattgtttctaaaagttttccaaatttaatacatagtttttgtagggtttagataagtggaaaatattcaacaaatagctagtattgcaactggtttacggtttatgtcagtataaagccacaaatacacaagaaaagtgtatttttaacatccttgattttgtacttgcatttttgtcttggtaaattaaatagttcatcctttagggaaaaagtttttagctgtgttggtttgcagtaattgtgaaacatggcagccttccctgttaacactggccattggccccaggagagcagcaaccaggatgtataattagcccttctttttacaggttggcaacctgtaattacagaaaacttttggtttgtttgctaattcctttttttttttttttttttttaatatacattctagctcctgggagctacagctattgaagacaagctacaggatggagttccagaaaccatttcaaaacttgcaaaagctgacattaagatctgggtgcttactggagacaaaaagggtaattcattgtgcagggaagcatatctgttaattcacaaatatttatagctgccgtttcctttgcccaagatgacctcctcagacttttcatcctgtacaaacactgtttctttggacggaagatgctttttctgagaaaccctcctctgtttttccagcacatccttctgcatcctttcctgatccccctcagtagcagtttcttccttataatttagctcctggccatgtcttgctgattataatcggtcttatctctccagccagacgtgggttcccgtcctgaaagggccatccctcttgtccctctgtccttccagtgctttgacatttggtgggcacagagtagaacaatacaaagtactgaacaataactttggttttcttgccaattttattgcttggcaataaaattgtatacctaaggaaagaacgattttaattttttaactttagaactcaacaagcacttgtttggtattgatactttactttgtaagccttccacaagaaatcaaataatgtctcttgcgctgaaatcgtcaacgggttacacactctgcaaagttatgggaagcacagccctgaccttaaataaatgccaaattgggtggtaatttaaaaggaaaaaaaatcttcacgtaagggttggtggaaattattatgcttccctctgcccccgccccccgccaataacagagtaattgaaccaggaactgagagtgtttagtaatttaatgaacattggtttactaaataaccagtttatatgtttgataatatagcacattttattattgaaaacatttcaaattagactttgactttcacttgttttattatggagaaaaggatttttcttctgcatgtgattcctacagattgctatagaaaaatagtgtgtttgtgtgaatctggttatgttcatgaactaaaaaatatcattactaggtaaaatcaattattcagttcaacagtaagaatgagcctggcaaacatgacaaaaccccatctctagaaaaaacacaaattgtttggtggcttggcagcgagttgcgtagtcccagctacttgggggctgtgggtggtgctgagatgggcagatcacttgaatcctggaggttgaggctgcagtgagcagagattgtgccactgcactccagcctaggcagtgggagtgagatgctgtctcaaaaaacaaaataaaataaaataaaaacagcaggaatgacatttgacttaattttattctattgtagaaactgctgaaaatataggatttgcttgtgaacttctgactgaagacaccaccatctgctatggggaggatattaagtgagtaaaagcctgcagtatgaaattacgtaatagctcatctttgcaaatgcaagactgtctgtagaagatagcagatatgaagaaataggggttacgatgtgtcacttggggcagtttcctcatgtttaaatgaggcaagacaacaacaggcagttccaagtaatcaaggtgcagcctaaatttgagcagattttacttttagggaaacttggggcccttcagaggccatttttctccattccttctcagctcaggccaggcgcagtggctcatgcctgtaatcccagccctttgggaggccgaggcgggtggatcacctgaagtcaggagttctagagcagcctggccaacatggtgaaaccccgtctctactaaaactacaaaaattagctgggtgtggtgcccggtgcctgttatctcagctactcgggaggctgaggcaggagaatcacttgaacccaggaggcagaggttgcagtgagccaagatcacgccactgtactccagcctaggtgacaagagtgaaactctgtctcattaaaaaaaaaaaaaaactcggttcacctactaaaaaatccgtaaaaagcctgtaatatcgctagcaaattaatatgaattatagtcctattttgctttttctaggaacttttacttttgaaagggaaatagaagaaaggaaaaaaaaaacccaaaacttttgcgggaaggaaatgtgtgggtgggttacatcatgtaggtcccctgtaatctagtctaggtggggcaggcctgataattcaaatgttagcatatgctgaaacgtttgttagctttgaatcagagtcgcagcagacctggaaatgtatgatgaaaaagccctgtcttgttctgaagctataaatatgctgcacacagttactgtgatgtgtttactgatggcctgacagttcctcaagatttttccctacagagcttctctcaggccagcatgaggtcagattaaactgttaacatacacatttgccaggtgtgataaagtgatgagggaattgatggtcaatattagtcttatttctaatgatggtgataaagcattttctagttgttctagtatattaggtattccgtcaaattagacaaaatcagtagccttatgatctaaatcagttccatttagaactgatttagtttatgtgcccaaatagaggtacataagccatgcccctttgtgcttttaggttttaaaaaagtagcaacaggctgggcacggtggctcatgcttgtaataccagcacattgggaggccgaggcgggtggatcacgaggtcaggattttgagaacagcctgactgatatgatgaaaccccgtctctactaaaaatacaaaaattagccaggcatggtggcatgtgcctggaatcccagctactcgggagactgaggcaggagaattgcttgaacctgggaggcagaggttgcagtgagccaagatagtgctactacactcctgcctgggtgacagagcaagactccgtctcaaaaaaaaaaagtagcaacagacaaataaatgcttaatgcttaatgagtttactttagtagttttgggcttcaagtaatctgattaattactatatggctttgtttattttttgtagatggggctgtaaaaaaatttctggtctctcttttgaaagtcttaaaaattggtcccgaagctaaagtaaaagataaaatgtatgcaagtagcaaatgttgtgaccatgcccttagctgagtttacctttatagagagaggaatcatcttcccaggtggctcttaaattgatgattcctataaaatgatttgaatagaaggtatcttcattttttttctcttaacggcctttcaatgatttgtcttagtcactcacttttaacttgaaaatgagaattaaattgatgtggaaaagggatactagatacttaatcctctagtgcagtgattctccgtggggagtgagtttgccttccagggaccctttggcactgtccagagacacttgcttgtttcagctgcagagaagtgctcctggcttctagtgggtagaggccagggatgttgctaaacatcctccagtgcaagggatggccacacaaaataaaggattattaggcccaagacatcaagagtgcaaaggctgagaagccttctttggaaggagaagaacaatggctttttgtatgtaatagtaagagtcctgagccagaagttacaagataactgagtcctcattctagttttcctatcaacctgcagcaggcaaatcacatcaccttcctctggcttgatttccttatttgtaacatgaagagattggacaagatatttaaggtcccttccactccaaaatttcatgactcatttttctatcacatgaaagtgttacacgtagccttgtcacatatatcattttaacacaaacatttaatttgttgatataaagcactgagaatttctcaaacacagatatagttttgtttatatgaaaataagtttattcctaacaaacaatagccagtattctaattcagatcaagattgcctttcctttttttttttttttttttttcttagaaagactctgtcacccaggctggagtgcagtggtgcaatcttggctcattgcaacctccgcctcctgggttcaagtgatcctcatgcctcagcctcccaagtaactgggattacaggcaccgccaccacgcctgggtaatttttgtatttttagtagagacagagtttcactatgttggccagtctggctgcgaactcctgacctcgactgatctgcccgtctcagcctcccaaagtgctgggattacaggtgtgagccacagtgcctggcctaagattgcctttcttctgttgctgtgtatacattttcaactgtatcttcctttgactgtctttgaaaaatgatgaattacatggtacccccatggtggacgaatcgagacatagtaaaattacatgtcgctcagttaaaaaaaaaaaaaaagggctggccaggcgtggtggctcatgcctgtaatcccagcactgtggggggctgaggcgggtggatcatgaagtcaagagattgagaccatcctggccaacatggtgaaaccccgtctctactaaaaatacaaaaattagctgggcatggtggtgcccgtctgtagtcccagctacttgggaggctgaggtggaagaatagcttgaacctaggaggtggatgttgcagtgagctgagataacaccactgcactccagcctggtgacagagcgagactctgcctcaaaaaaaaaaaaaaaaaaaaaatgggcaaagcactttgagtagacatttttccaaagaggacatgcaaatggctgataaacatgtgaaaggaggctcatcatcactaatcattaggggaagataaatcaaaaccaaagcaagataacacctcacaccctttaggatggctactatcaaaaacaaaacacaatagaaaataacaatcattgttgaaggaacctttgtgtgttgttgatgaaatatataaaatggtgcagccactatgcaaaacagtatggtgatgtttcaaaaaatttcaaaaaggattaccatatgattcaacaatcccacttctgggtatatccacaaaataattgaaagcaggatctcaaagagatacatgcacacccatgttcacagcaacactgttcacagcagccaagagatggacgcaacccaggtgcccatcagtgagtgaatggataaacagaatgtggtgcttccacataatggaatatattcaactttaaaaaggaaggaaattatgacatatattatatagatgaaccttgaagacattaagctaagtgaaataaaccagtcacagaaagacaaatactgtttgatttcacatatatgaggtatctagagtgctcaaattcattcaaacagaaagttaactggaagttaccagggactggagggcgagtgaggtgaggtgttattgtttaataggtatagagtttccgttttgcaagatgaaaaagttctagagattggttggataacaatgtgactatagttaacactactaagttgtacacttaaaaatggtcaaagcccgggatatggcaaaaccctattgctacaaaaaatacaaaaattagccaggcgtgatagcgtgtgcctatagtcccagcaactcaggaggctgaggcaggagaatcacttgaggctgggaggtcaaggctgcagtgatccatgatcatgccactgctctccagcctgggtgacagagtgagaccctctctcaaaaaaattataatgaaaataaaataaagaaacaaaaataggtaagatggtaaactttgtttttttgtcacaattttttttaagtcaaagttatctcagagtcaagggcctatttagggtcttacactttaaacactgaaatttggtttcccctagttctcttcttcatgcaaggatggaaaaccagaggaatagaggtggcgtctacgcaaagtttgcacctcctgtgcaggaatctttttttccacccggtggaaaccgtgccttaatcatcactggttcttggttggtacgtatcattagtgtatctgtgcctttaactcaaaagaaagaagttcatttggagccacttttagatgctttcacatgttaactgccaacctaaaagtctcttagcctatacatgaaagtgtggtttttccaagtttgagacttaataatatatgatatatgaaaggatgtataccaaagaggtaaaagtggttatcttggtttactaattaatgggttttttcattttcttctttatagattgttagattttctaaatttttgttgcatatatattttataagctggatgtggtggcatgcgcctgtagtcccagctcctctggaggttgaagcaggagggtggtttgagcttaggtgttcgaggctgcagcatgcaatgatcacacttgtgaatgaatagccactgcacttcaacccaggctatacagcaagaccccatctccattgaaaaatatatatatagctgagcacagtggctcacgcctgtgctcccagcactttgggaggccaaggcgggcagatcacaaggtcaggagatggagaccatcctggccaatatggtgaaaccccgtctctactaaaatacaaaaaaaataattagccaggcgtggtggtgcacacctgtagtcccggctactcgggaggctgaggcagggaaattgcttgaacctggaaggcagaggttacagtgagccgagatcgtgccactgcattccagcctggcaacagagtgagactccatctcaaaaaaaaaaaaaaatatatatatatatatatatgtgtgtgtgtgtgtgtgtgtgtgtatatacatacacacatacatatatgtgtgcgtgtgtatatacatacacacgcacacatatatatacatgttttggttataaaatcaaatttatttgtcaaatataatcagtgacataatccaaaaattatccttcacataatttaaatcttgggaatggtactcctggggtaaaactaaagtgaatgtaaccttttccctctctgatttcacagaatgaaattcttctcgagaaaaagaccaagagaaataagattctgaagctgaagttcccaagaacagaagaagaaagacggatgcggacccaaagtaaaaggaggctagaagctaagaaagagcagcggcagaaaaactttgtggacctggcctgcgagtgcagcgcagtcatctgctgccgcgtcacccccaagcagaaggccatggtggtggacctggtgaagaggtacaagaaagccatcacgctggccatcggagatggggccaatgacgtgaacatgatcaaaagtgagtcatgcacccacggccagtgaggcccaacgtgctagagaggagaaatggctggaatgtgtagggggtggattttctttttttagattttacagcttaggttttcatagagcagatgtttcataaagtcacttaaccatgacaacgcctgtgaccctacccccagaaagcccacagcccatcaggaggaaagagtatcactgacagggcttctgaaggatgcgaagaggaaaataaggtctatggggggaaatttatccttatatttttattcttttatatagatgttgtgtatttttttctctcttactggttctcttcccatattttgggtttattaaaagccctgatattggctgggcacagtggctcacgcctataatcccagcattttgggaagccgaggcaggtggatcacaaggtcaggagttcgagaccagcctgatcaagatgctgaaaccccgtctctattaaaaatacaaaaattagccaggtgtggtggtgcacacctgtaatcccagctactcgggaggctgaggcaggaaaatcacttgaacccaggaggcggaggttacagtgagctgagatcgtgccactgcactccagcctggacgacagagtgagactccatctcaaaaaaacaaaacaaaacaaaaaaccctgatatttaataagttttgtaagacataaattattgaactctggctggtgcttgctttgacaatatcattctccttcatctaagcatttctttctgggactttcttcctacctttggtaaatctgtgggaacttcatcattgggtcacctggtgtgagtttagagtaacatgtttagcactgaagaaaagcttccacgtgctctcatcatcctcctcacctccctagaaggctgcctttttctggatgctagaatttaagtccacacaattaaaatattgagtcctgccatgcagaaatacagttgtgctggtattaaagcctgcagaagcacacccacagccctcatctctatgtctgaattctgttcctttttcctccctctgtcactataagggagtatcttgtattaaaaatactcaaactaatgacctggatattcatcctcatcctattgccaaaatccggtgtcaccttgggcttatgctcaggtttcagttttctcatcggaaaagaaaataatccctaatgtcacctccagctctgtcgtattattatcactgagctgaagtattacctgactgtacataggtaattgcatgttcctgtgatgctgggttgcttaaatgcattatatataactagacttttcagtctattttgtgactcatgagtctgtctctttcttttcttagtctcctcctcctccttgatgtatactaagaatattccaactttatcttcctcaacaggagtcagctgtatgacgtatgtcatcttgccttctttatcagtgcgtatgtctgtggtcactagcagtttaattcatccacactgttttttttttttttgcatgtgcttgccctaccatgcgaatggtattgcttgctcggagttagatctatctctttcctccatagccagccagctctagtttattttccattacgtacctttaacgtaactagccgtgccaaaaggacaagtcaaacatgatttttattcagttataaagtagccttctagataatgggaggggacgggtttgctttggagatttatcaactgattatgtgacttagacttgaaacattttgttcctctgagttcaccaatacataatgagagggattgcacgaagtcaatgtagataatcttagaggggcttgtttttcttaagttgtcttaaaatttttattaagcactgttatatgccaggtgcatttaaaaaaaaaacaaggtctccctctgtggcccaggctggggtgcagtggcatgaccttggcttactgcaacctccacctcctggcctcaaacaatcctcccacctcagcctcccaagtagctgggactacaggcatgagccaccatgcccagctaatttttgtattttttgtagagttgggaatttgccatgttgctcagcctggtcttgaactcctgggctcaatcagtctgcctgcctcagtctcccaaagtgctaggattacaggcatgagccacctcacctggccccaggtacttttatatataagttatagagcatccctttgggataaaaatataggaaactttaggggtctccttagaagttatacaagtagtattagtgcctttatgtactttgtaaaagctgtcatttcttccaaccacatcaataacaatatacagaaagtttagccaagtatggggcacacaccggtagtcccagctacgtgggaggctgagacggaaggattacttgagcctgagaagtttgagactacagtgagccatgtttgtgccactgcactccaccctgggtgacagagcaagaccctttctccaacaacaaaaaagaacacacacacacacacacacacacacacacacacacacacacacaaagaaattgttggtcataaagtagtcgagtaaaattattcaagtgtcaaaaaataatctgagcatttgctaacattcacgtttagcagtgtagtctggaagaagtgaaggaatcatgacccaccatgtttctgcccctagcaaggatccaaggactatcataggctgccttctccctctatcctacctgaagatatctcataccagctgggtggatgttgtctcttcttggtcttagaccctgagaatgtacgtgaagcaggagagagataaaggcaaggtggggcatggtggctcatgcctgtaatcccagcactttgggaggccaaggcaggcagatcacctgaggttgggagttcgagaccagcctggccaacatgatgaaaccccatctccactaaaagtacaaaaattagccgggcatgggggtggcgggcacctgtaatcccagccactcgggagcctgaggcaggagagtcactggaacccaggaggcagaggttgcattgagccaagatcgcaccactgcactccagcctgggcgacagaaaaagactccatctcaaaaaaaaaaaggcaagagggattattgctgtagcgaggaaatattctttttgttaaggaatgataaaagaatgtctaccagtgaggcacctaacaccgcatttgagatttcaggaaactctaaatgcctgtacttaaattttacaaaaaagaccaatgttaccttatagtgtatctgttcagtgcttttggttgccctgggaactatgacagtgttcatttcacatttgtccttggtctgctcagcgggaaggttgaggactggataccagggcctggggcagggcttcctcttcctcagccacataagccaagagaatctcagcattttcctcagtggcttgttcaggaaagaaaaggccatggtttggcaggaaagagcaagtttggcaaccatgctggtcataggaaatatttgtgtgttttcaaagagaacataaatattatatgagatgcagtttgttctgtttttttagaagtgttactgaaaacgtaggtttggatacatcactacagttatgttttgaatttgccagaccttgtgttctgtaactagggcaggatttttgaagcttctttttagttggaacgccgcagcattgcagccacttttcagggtctgagcaatgataggttgtgttctccaacatatcttttctaaatgatcttgtctatcttcacattcgttacttttaagacccagacaaaactaatcattctctaatttgaaagtgttatttatgactattggaagcataaataaaattgtgactttaattttatatattctggaaaccttcccccgtaaagaaaaaaaaaatgtcttaaggtcccagagggccatgaataagactttgaaagtttaatagtttcttggttaaaactcttttgattacaagtattggagaacaaccaaagctagcttaagaaaaaattaaatttgaggagtgggagacgaggggagggaacctagaggatgggtcaataggtgcagcaaaccaccatggcacacgtatacccatgtaacaaacctgcacgttctgcacaggtatcctgtaacttaaaagaaaaaaaagaaaaaagtaaatttatttaaacacctcctgttgtccaagaagaagccaggcctcaggaagatactggaacaaggacatagatttgcaccaggaaccccgtgtctgtctgtctctctccccttctctctccctttcctccttcttcccctccttctctctctcccctccctcccttctctccccactcttctctccccactcttctctccccccattctctccctccattctctccctcctccccacccctctctccccactactttatttctctgccccttagaaatcttcaggaagaaatatatctatttcggccaggcacagttgttcatgtgtgtaatcctagcactttgggaggccaaggcaggtggatcacctgagttcaggagttcaaggcctgcctggacaacatggtgaaaccccgtctctacaaaaattagctgggtgtggtggcgcacatctgtaatcccagctactcgagaggctgaggcaagagtatcgcttgaacccaggaggcagaggttgcagtgagccaagactgcgccattgcactgcagcctgggtgacagagtgagacttcatctcaaaaaaaaaaaaaaaagagagagaaagaaatataactatttcttacctcaagaatttagaccttaaaattctagacacaaaataactgacttctaattccagaatatcaagagagagactggctcagcttgggttttctgtcagtcagggtttagcacaggaaacagaccccagttggtatttaagcaagaaaagattcatacaggggactaggtactttcaaaagctctggatggtctacagaagcagggtctaggctgggtcacttaccagaagagcttctactcttctggtaagtgataagaggttcctctaaagagcttccaaattaagaagcctttatagttgcctgtcaacatccaggtagctggaaagtagatatgagctctgctgcagaaatcccaaaagaggaagcgatgctgggctctgattcacttctgcttccaagtcataagtggatctaaacagtggaacctaattcacaaagagcctagctgcaagggagtctgggaaatgtagggtttttatttcctttcccacctctctaattagaacaaggatggaatgaagttgggggagccgatttgtagtatctaccacaaattacatatctgcccatgactgacacagctgttgccaaagaggcaaggacacagtgtacacatgggtgcctggggctcaccctgtggatggaagggatggctgtgatcttggcagataatccaaatggaattcgtcacccacatgagatcctttcccagatatttatggaggccctactgtgtgctctgtttagcaacttgtaactcagactttgagttgagttcaagagctgggggtgagggatggtgagcaagagcttctgtattattgttccatcaatgtctgtctttgttttttgtttgctatggaaccatttttatcaactgatgttttgcctcacaatcggtttatgatccacagtgttttctccctctgccccatagctgcccacattggcgttggaataagtggacaagaaggaatgcaagctgtcatgtcgagtgactattcctttgctcagttccgatatctgcagaggctactgctggtgcatggccgatggtcttacataaggatgtgcaagttcctacgatacttcttttacaaaaactttgcctttactttggttcatttctggtactccttcttcaatggctactctgcgcaggtaatgtaatgttgttattattgttatttactaagtagagctcttaaatgaataaaaatctagttctgaaaagacaatttatttcttctatatttgtagttttggggctgtgtctccttacagttggggcataattaagaatgatcatgacttctctaaatgtttctggtgctgtaaaaacattttaccttagaaaggaggggatttggccaggcatggtggctcacgcctgtaatcccagcactttgggaggctgaggcaggtggatcgcctgaagtcgggagtttgagatcagtctggccgacatggtgaaacctggtctctactaaaaatacaaaaattttccgggtgtggtggcaggcacctgtaatcccagctactcgggaggctgaggcaggagaatcgcttgaacctgggaggcagaggttgtggtgagccgagactgcgctattgcactccaacctgggcaagactttgtctcaaaaaaaaaaaaaaaaaggaggggatttgcttgtatgtttttatctttatctttggttattttttcatgttgacattaagagtagcgataacagggctgggtgcagtggctcacgcctataatcccagcactttgggaggccgaggtgggcgggtcacctgaggtcaagagttggagaccaacctggccaacatggtgaaaccccatctcaacaaaatacacaaaaattagccagacatggtggcgtgtgcctgtaatcccagctacttgggaggctgaggcagaagaatcacttgaacctgggaggcagaaggtacagtgagccaagatcacgccactgtactccagcctgggcgacagagtgagactctgtctcagaagaaaaaaaaaaagaatattgataacaggccaggtgcatagagttttgcctataatcccaacactttgggaggctgagatggggagatcgcttaaggccaggagttcgaggccagcctaggcaacatagcaagacccccatctctattaaaacaaacaaacaaacaaaatgttaaataaaggaagcagatgagtatgtgctaactaggctggcatgtgtctttgttggtgacatggagcctctgtcatcccctcacagactgcatacgaggattggttcatcaccctctacaacgtgctgtacaccagcctgcccgtgctcctcatggggctgctcgaccaggtaggagcctcgcacaagcagggacacttctggacagatgagaatgcgttagagaagtcccaagcaaacgtttcaatgcattcttctggtgtttacttctttctgatcaaaccctattataattctgttgtcaggcatcaagggtcatggctgtgcttcttgttttgtaataaggaaagaggatttctctgtagtcccagctactcgggaggctgatgcaggagtatgacttgagcccaggtgttcaagtctagcctgggcaataaagtgagaccccatctctaagacaaaaaaaaaaaaaaaaaaaaagagaaaagaggatttctgtgactgggttgaattcattggcacacatatttgttatgttccttttagacagtaagagcttactatgaagatacctgaaggcagggcatggtggatcatgcctgtaatcccagcactttaggaggctgaggcaggcaaattgcttcaggtcaggagtttgagaccagccctggcaacatagggagaccccatctctacagaaaaatttaaaaattgtgggcatggtagtgcacacctgtgaagtcccagctacttggcaggatgaggtgggaggatcgcttgagcctggaaggttgaagctgcagtgagttgtgtttgtgccactgcactccgggctgggcaacaaagtgagaccctgtctccaaaaaaaaaaaaaaaaaaagaaaagaaaaggaaaaaaaggcacccgagagtccaatatgtctccacaataataatttactcattttaaagtcagtttaaatcctttccaaaatttatgtagctagtgcatatttttatctaataccaattcttaaaaagaaagaagcactataaagactaaaaagtaataatttataattaactcatcaacttgtatgagaaaattttttcccaaaggatttgcaacaatatatattcactcaggaggtaaaaacagtagcctccctacatatttttggacattactaatttgttttctttccataagtagcaaagtaataaacttatacctagcccttctctgaattaaatattaagtaatggtggtctaagcaatgaggttgagctctgcacaccacaaatattgcaggattgatcgattatcttgttcagtttttgccttcctaaaatttaacagcaggctgcaactttttgtgagatattaattataacatatctctgactgctttgacctgatgaataaaataccatcattttgttttctccttaaggatgtgagtgacaaactgagcctccgattccctgggttatacatagtgggacaaagagacttactattcaactataagagattctttgtaagcttgttgcatggggtcctaacatcgatgatcctcttcttcatacctcttggagcttatctgcaaaccgtagggcaggatggagaggcaccttccgactaccagtcttttgccgtcaccattgcctctgctcttgtaataacagtcaatttccaggtacgtggctttcattggccgtattcagtgtctattggtacctacttatatttctgtatatagggtggcatgcacatccacctgactcccactgcacctgtgccacttacaaaatataaatgctattttcatctcttataccaagcacattttctatttcttgcctgagtcaaggatggtttagtttctggtccagtattcaagccacatcatgcctaacttgctgaattctgttttcaggattgttagatcctttatttcttgctaactccccaaaatgagtgctctgtttttctctggtttcccaacagattggcttggatacttcttattggacttttgtgaatgctttttcaatttttggaagcattgcactttattttggcatcatgtttgactttcatagtgctggaatacatgttctctttccatctgcatttcaatttacaggttggtatttccaaattccaaaaataaatgtacagacaaatgtcattagtttagattttgacataacttctgttaagtaataaaatatacaaggtggaatggctgggcacagtggctcacacctgtaatcccagcattttgggaggccgaggcaagtggattgcttgagcccagcagttcaagaccagcctggacaacatggctaaaccccatctctacaaaaaatacaaaaaaattagccaggcatggtggcacatgcctgtagttctagctactggagaggctgaagtgggaggattgcttgacctgggacgttgaggctacagtgagtcgtgatggcactgctgtactctagcccaggtgacagagcgggaccctgtctcaaaaaaaaaacaaaaaaaacaaagcacaacaaaacaaatatatacaaattattattgctagtgaaaattaatgtcttgtctggaaattaaatggtgatggtgggttgaaagggcataacatgatgggaggaagacaaattaaaatagctttacaatagcgctgtacgtgtgttgaattagataacttaagacttaaaaggctggataaaagcctattctttctttcccataaaacctaatactggggctagatgtggtagctcacgcctgtaatcccagcactttgggaggccaatatgggtggatcacttgagctcaggagtttgagaccagcctgggcaacatggtgaaaccccatctctacaaaaaatacaaaaattagccaagcgtggtggcgcacacctgtagtcccagctattcaggaggctaaggtaggaggacacctgagcccaggaggttgaggctgcagtgagccatgatcacgccactgcactccaacgtgggtaacagagtgagaccctatctcaaaaaaaagtcagaagtcttgatcacctaactttgcatttttaatcaatgcaatgtcaacaaatgtgctttttttccttatttgctcacttatgtaaatttgccttgtttcaaataatttaccttcccaattttgctttgcttagtctgattttaaaatgtctgttctttgagccataatggatattttggggaggccaatccagttgtaaaactttaccataaatgatctatttatagattatgaaatattaactatgttcttttttttattttattttttatttttgagacagagttttgctttatcacccaggctggagtgcggtggcacaatttcggctcactgcaacttccgccttccgggttcaagcaattctgctgtctcctgagtagctgggactacaggtgcacaccaccatgcccggctgattttttgtattttagtagagacggggtttcaccatgttgcccaggctggtctcgaactcctgagctctggcaatccacccaccttggcctctcaaagtgttaggattacaggcatgagccaccacacctggcgaaatattaactatgttcttaggaaaaaagaaccacagtgatgcatttgccatgttctttacaggcacagcttcaaacgctctgagacagccatacatttggttaactatcatcctgactgttgctgtgtgcttactacccgtcgttgccattcgattcctgtcaatgaccatctggccatcagaaagtgataaggtataaagaatatagtcctttcccaactctgtccctcacagaaaccaaagcgtttcccaacagcacgtttcctgcaaaattctaagctcatgggaagtttggtaagaatgatttttcatgattgcttctctttaactctatctcacaaataagtcttttggaattgggagtttagtgtgcttgctttttaatacaaaaattaccaaacataaacaaaaaagggagaacagaatgagccccatatatctatctcctcagtttaacaattacagtattaacattttgtcatacaaatcagattgggttttttttctttatttaagaaaaatgtcaccttctgtagcaggatcctttgagctacaaggaacagaaagctgtgactcaaaacatctctacagtagtgcgtcatcattaatcattagtaggcttcaggcccagttgattgagcaatttaatgttgtcaagaaaggattgggctggttcttgccatctcttctctcagaaaccttcattattagcttcatatggatgctggaagatggccagagcagttctgggtatcacttcctgacctatcagtgtcggggggagataagagcctattctgtagctccttaggggccgtggaacttctcacccaagggccccagtacagtgccctcaggtctcacgtgccaaaattaggtcacttgcccattctggactagtttagcaagggaaatcaacctgcccaccgcccatgagaaatgtggctgtgaggggttggggggggcaatctgaatacaatcaatttccattagaaagaaggagagagtagaggctactgaggcaaccttcagtatccctcgggtctcccttttgcagtgccaacagtatgcagtaacaacccaggaaagaggccctactgaattttctctttgactgtacccatctggtctgaactagaaaagggcactagcttcagaggagtgggaatcttggctttgcattttctagctgtgtgaccttggaaaagttaaataaccttcccttggcttcaatatatatctccaggtaggtaggtaggtagatcgattgatcaatcaatctatgtatagatatagagagatggatatagatttatatcatcatatatatatgtcgatatagatagatagatagatagatagatagatagatatagccaagcactgtggttcatgcctgtaatcccagaacttttggaggccgaggcaggcagatcacttgaggtcaggaccagcctggccaacatggtgaaattctgtctccactaaaaatacaaaaattagacgggtgtggcagtgcgtgcctgtaaccccagttactcaggaggctgaggcaggaggatcgcttgaacctgggaggcagaggttgcagtgagccaagatcgtgccattgcactcaagtctgggtgacagagcgagactgtctcaaaaacaaaaaaaaagatatagacacacatacacatacacacacacacacacacacacacacacacacacacacacaagtggggacagaactgcctgcatcaaaatggggcaggtgtcaggggagttcatcagtgttcatttctgtcaaccgtctggccaggcctcctccctggtgtggatcttattttcatccctccccatctctcccccttgcagatccagaagcatcgcaagcggttgaaggcggaggagcagtggcagcgacggcagcaggtgttccgccggggcgtgtcaacgcggcgctcggcctacgccttctcgcaccagcggggctacgcggacctcatctcctccgggcgcagcatccgcaagaagcgctcgccgcttgatgccatcgtggcggatggcaccgcggagtacaggcgcaccggggacagctgatcccttacccccaggctgggatgcggccacaaagcacgtctatttttttatgaaagactctcaggactttgtgtgtgtgtgtgaattgcattcatcacaaagatattgaagacaataaataatctttataacaaactccttgggttggactattaaacaatagcagagccaagaaataggacttttaaaagtcctattattcggccgggcgtggtggctcaggtctgtaatcccagcactttaggaggctgaggaggggagatcacctgaggccaggagttcgagaccagcccagccaacatggtgaaaccctgtctctaccataaattaaaaattagccgggcttggtggtgggcacccgtaatcccacctatttgagaagctgaagcagaagaatcgcttgaacctgggagatggaggttacagtgagccgagattgcgccactgcactccagcctgggtgacagagcaagactctgtcttaagaaaaatttaaaaataggccgggcatggtggctcatgcctgtcatcctagcactttgggaggccaaggcaggtggatcacttgaggtcaggagaccagcccggccaacatggtgaaaccccatctctactaaaaatacaaaaattagctggaaatcgcttgaacctgggaggtggaggttccagtgagccgagatcgtggcactgcactccaacctgagcaacagagtgagacaccagctcaaaaaaaattttttaataataataaaagtcctattattcaactggttatgtacattatggttgaaagggaacgttttaatccagtctcaatccagggcaatagaattacaaagcatgttgtatttcagttcaaatggtattgtattataaaattacagttacattttcctttctgtgatcttcagcataatttcccagaggcccctttttcctccctataggccatcttattaacagattttaaaatttatagtaatgacaaatgacttatcagtgttcatcatctgaaagctaagtggttcgttcaatcactttttcaaagttgatagtagattgcatggtttcatgtttcctcatattggtttattaattctatttaatcaaggaaaataacttcagattccataaagtttcagtttatttttagtttactactaggtgagatagcacattacatacttttactatcaaatattattttagcagcttcccatagtaccaaatgatttgattccctactctcattttttaaagcatataaatatttatgggcttaaaaagggggtttttaaaaactgaggatatcagtaataaattgcagaatattttgcaaagctttcttttggaaagcaaacttttgtgcctgcctatatgcaaagtattttatcagggacttgaacaaagacctcactctttttcacttgtcttatgtcgagagaaaaggttattggcagccacattcctaagactggggaatggtgtgtccttttaaatttgaagataactttaggtaattatggaaactcctcaaagaggagaaagtaatttttttccagacatttttctcattctgtgtctttcacacactagtttccatagttcgagaattctgttttttaccattgggctgtgaatgttcacaatatcagtcctgttgaattcctatgaggtaatcacaatgtgtatatgttcattttctaggtatgataaaagaatgtatggctttttattctgtggaagtaaaatcctgaacgtttacaacttttccttaacttgtaaataaaaaattgtaagttttttctttttttacagaaaacttagcttgtgtaattctgttagtttcagatttctctcctgtttttgcaaattgtgggaaagattgacaatgcaaatgtgtcaaagacatactgttgggtgcaatattaacaattttaaatgcaaatttctttggataaattatttctatattctgtaaatctgagatttaatgtata

SEQ ID NO: 13656 - DNA, 89844 bp, Human
  misc_feature (1)...(89844): n = A,T,C or G
gctgcagtgagctgtgattgtgccactatacgccagcctgggtaatggagccagagcctgtctcaaaaaagaaaaagaagaaaaggttttctgaagtttatgttaagtgtttgtacatgtgggaaaacagggaagaacagatcatctggggttttggacttttgaagatgggatgtttgaaagctcttttggttatgttattcgctattttttaaactttagatttagcctgaagcctaaaacttttagccaaggaaacaatgttttagtaaatggtgctgtaataaacaatagttggtaagtagtttacatgttaattttataatgatacattggaaatatctggcagaattagaatcaggctgtgtgtgtgtgtgtgtgtctgtgtgtgtgtgtgtgtgtgtgtgtgtgtaatcaggctggtctcgaactcctgacctcaagtgatccacccacctcagcctcccaaagtgctgggattacaggcatgagccactgcacctggccaggccatatatttttgaaacagacactttgatggactgtttttacttttatggggataaattcatttgaactttgtttaatacagtgattgcctgctctctctcccacacccttagggaagaatggtgtagttggcaaagaatggctttggaggaaaatctctttatgccatttctaaaatggaaatagtgcatttcttttcttgattagtaaaagggaaattaaagattatgagcatctcagaagaacactgaacaccaactctttatttttgccttccctcatttctctgagcgacagcctgagagttttatagtcatatgaggactctgaaaaatgttagagacctggctaagttgtaggtaactagtgcattgagaagactgaaaggctcctgaatgcagacaaagcattactaattgcattcagggtcaggctgtctttagccggaccatgaaagatacagcagcctgtctgctgagcggagactcttgtctttaagaaagactgctacctgatatgctagaccgtttcaggttgccctagtttacatgaatttagtcattatcgccaagactgctaaacctcagtgtgatacttctaaatggacttgaagacaaggtatttgaccttgcaatggggcataggcaacgttcatacagtttttaaaacacgaaacagaatactttgctatttgaagtttccgttaaaagattgaatgatttttaagatcgcaaagtaaacagcagacatacctttagaaatttttttatgacttgaacccaggaggcggaagttgcagtgatccgagatggcactactgcactccagcctgggcgacagagcaagaccttgtctcaaaaataataataataataatttaagctttaatagttctatcttttagatttatgaatgcttgccccttaaagggtaaggtgttaatagcagtactaatatacggtagtttagacctattccacaggcatagaccaaccagtgcaattaattcttcaacctcacaagtcctaatgttctaggtagaagtgtggctgaaattaaaactggttattagactttgtaatacaaaagtagaaaaaagtgatattagctaggtggtccaatatatttttgtctaagtaggaatctgaatattgtagaattgtacatttcggtgctgcttctagctattcctgttcttttttttttttcaaattgagatgagtttttttttttccatcaaagcttaagataacataggaattttatatggaagtactgttcccacagaactaactttacaaatgtaaagcttgggcagaggttgaggaaaatggtaaagtgatagatttcgtaaaaactgtagaaattttcattgactttactttgaaaatgtatagttgtacatgcgaaacgcttctagtattgcttctagatgtattattctgacaaagttccctaagtcttaaataagttctttttttttctaaacagacttatgaaaatatgcatcagtttaatactgtcttggaattcatgagatggaagcataggtcaaagctgtttggagaaaatcagaagtacagttttatctagccacatcttggaggtaaggaaaagaacataatttagaataatatgaaatttctcattttttaatagttgaaaataatccttctacactgcaactttatttgagccttcttcagtttctttgtaacaccacaactttatagtagcttctttagtttccttaatcatcttcctgacgagttcataagtaattctaatatatattcctcataaatgttgaacctcttcaggagtgaaaggtatttatttcttactaatcactttcataaatctccttttagaagataagcattaaatggtttatatgtttatttcttccccctaagtttgcaaagcagagttcagcatgcaagattaggccaggtgtgcctgtaatcccagcactttgggaggctgaggcaggtgggtcacatgaggccaggagttcgagaccagcctggccaacatggcgaaatctcgtctctactaaaaatgcagaaattagctgagcatgatggcctaagcctgtgatcccagccacctgggaggctgaggcatgagaattgcttgaacccagaatgcagaggttgtagtgagctgagatcatgccgctgtactccattctgggcaacagagtgagactctgtctcaaaaaaaaaaaaaaaaaaaaagattatattgaaaaatgaatgtttatgttattctgaaatttttacgctttttagaattcagaattttttttttttttaagacaggatcttgctttgtcacccaggctggactgcagtgagcatagtttcaactccctgggctcaagcgatccttctgcctcagtctcccacatagctgggactacaggcacacatcaccatgcccagctaatttattttttgtagaaacagggtctcattatccctctgagttgctcaggctggtcttgaacccctggactcaagtgatcctcccacctcaacctcccaaagtgctgggattacaggcatgagctaccagacccagcccaggataagattttttaacatgttagaataatagatctttggaaatagaatttaaagaggtaggagctgccatcatgccagaaataggaggaaagaagccatcctaagacagtatgtacaggaaaatcaggcttactgttttaaaatccatttagagactaatgatcaggtaaaaggtttgaattatgtggggaatctacattttaagaaatagatagaatgtatggttttatgaagtggtctacgcttacacttctggaagtggcaggctttgcttgctgctactgttaatacttgcagcattcactcgcccttctcctgcccctgccaaaccgctggattagatcttctaaaaaataacgtaactctcgaattcttttgttaggtttcatattgtttgattggtagagttgtgatcgtttttttctttctcagttcttttggtttctatgattgtgtgctcttctgattctacttatttaattactccttgaccttttttccttcccctcctactcttaaataataatgaccttccccaaggttttatcttagaaattatcctgtttttttcttatgtctttcctagtctcatgatttccgcaattatctctaaaatgatctctctcaacttcctatctcagttgtggcattttctctaagcttcaggcccatattttcatctgtttacagatggctcagcttagtgcctcagacttcccattatctagcacatcattcatcatgagctctgcacccgctatttctccttctgttaatggacctctttgtcacccaggctcagagtctcagtgctgtttcggattcctcatcatttgcttcctacccttaggcacaagtgaagtcctgtcagttttacctctctaatgtatcacaaatgtttgaatcctctctttccgaatcccccttcaccatccaagtttaggtctttatgttacatctcactgaaaatattgcagggatctcccagcttgtgctgcttctcgctcctacttcattttacatgttgctgccagcttaaattatcttaagagataattttgcttgtattgtcggtgacactttgcctgtctgccagagtaaggacagattcctctaattttaaagatagtgtagctttgccttcatctgtccatttctttcaccctttaaacatttattaaacacctactgtatgccaggcactgtgttaggtcagaatgcaaaacattaaataaaaacaggttcctagctatactcaaaaaatagtctttctagggttggatgagcatgaaaacaattattgaagtgcaatctgagaagtgctatattataattgaaaagatatatttgattattccacactgtgtacatagatgataactataacatcactgatatgcccataattacatacagctataattttcaaaagaatttgaaaatacaggtgaccatgtcagaaaacaaaggtgtattggcatcacctggaaagactacaccaatgttatgagaggagagaattgtcaggcaggcttcacagaagagataatatttgagcagagtcttgatggatgaatagaagattgctgaatagaaattggaaagtgtaatactgtaaaatacatatgtgtttttgatgccatttcctggcattcaactcttaaaatccttgaaacctctgaagtgatgtctttttgtatgctaatgagttaactggtagatgacagccccctaggtagctttaggatgggggctggtcagcagaaagactaaggcaggattagagtcagaactttcagttcccgcccccaccaacccccaacatttagggaggggagaagggcgaaggttaagttgatcaccagtgacccgtggtttaattagttgtgcctacagaatgaacgttccataaaaatccaaaagaactgggttcagagagcttctggatagctgaacatgtgcaggctctggtgccctgtacatctctttatctgtcctttgtaacatcccctataataaacctgtaaacataaatgtttccttgaattctgtcagccgctctaagcaaactaatagaacctgaaaaaggggttgtgggtacctggatttatggctggttggtcagaagcacaggtaaaataacctgggcttgccattggcattggaagtgggggccgtcttgaggatggatccctcaacctgtgggatctgatgctgtctccaggtgggtagtgtcggaatttaattggaggttccagctggtgtctgatgcagaattgtctgcttgcttgttgatggggagaaaccctcacacatttggtaagaaaagtcttccctgttgattgttttggtgagagggcagaggaaaaatagtttgagtgttttccatactcacagaaggcaagggaattaatttcatgcagagcccagagcggggtggaggcagagcttgaaagtgtatagaatgtacagaagatagaataatttttgtatggcttgaatttagaataggagagagagtttgagggacaaggctggaaaggaccttatgaagaattttgaatgccatggcaaggagtctagactttattttgtgaaaaatgggcagtcattgaaaaattttaacatttaaagatattttggatcgtaattttttgttaaaattaatatgatggttgtgttagtcagttttcatgctgctgacaaagacatacccaagactgggcaatttgtaaaggaaagaggtttaatggactcatagttccatgtggctagagaggccttacaatcatggcagaaggtgaaaggcacatcttaggtggcagcaggcagagagaatgagagccaagtgaaaggggaaacctcttacaaaatcatcagatcttgtgagacgtattcactaccaagagaacagtataggggaaactgcccccatgattcaattatttcccactgggtccctcccacaacatgggggaattatgggagctacaattcaagaggagatttgggtggggacacagccaaaccatatcgttggtgatatgaatggtagtttggaaaaaggaaaaactaaaactagagagacaagttaggctattcttaactgtttcaagcaagaaataatgaagctgtcaacttaagatggaggtcaacttacccgtttaagcattggttgtttagaaaatgtttaattttcttctattcccctatgtactatactcttcagctggtgatttgaaatcgtccttccttttctctactctcttctcttggcatatttttggccctttctctcttgtggagtgcctgtgaactttaaaaaccccatctcaaatgccaattcatccctaaagttctttctaatctgtattgctttgactctaaatatatgtcttttcctagtctaaagcccccaaagcacttatttttattctacaggatattacttttttggtccctattaaactatgtggcagcaagtcacaaaggaggaatcagaaagtaacctgctccccacccttggtgtgtagtccagttagcaaggtatgtatataagtaatataagtaatgataaccaacattgccatgcaaaagtgaggaatgccacaggagtaaattgttgcttctagtcagagtcctgtaactgagaagcacaggtagaacataggaggttatgtgagctgagctttgaaagatgagtaaaatttagatgggtaaaggatatttctggaaaagtgcatggatagaaaatgaatgtttttgtaggaatgtggtgaaggtcttagaaagggcaggaagtatgatgtgaagaaagctcttttagtgaaattactctagcagtgacatataaactatacatcattagagaaatgaagtgaggaggtagggagccgagtgaggagattgtggcactagttaggcataagctgatcagaattcaatcagggtggtgattgtggaaatagaaaagaaagactcaatgataaaggtattgcggcagaagaagggacaccgatgtgtgactagatgttggaaagagatgatgccgcctgaattttgagcctggatggtggggataatgttggcctcattagtagccaaggtaagttggatcctacttttctaaatgtagagaaacattaaaatttatgttttactgtactgttggtctcttaatttgtttatgtgcaacaagtttttttggcattatttttccagccttaacatattcaaagggagattttatgaaaaaagcaaagtatgacctcttttacaaaagcagtttttaaggaaataaactgtattctgttcatagttacctcttttgctatcatgttaaatgctatgtaagatttagtaaaacttaagaatgtttaaagtatttctacaggtataattcagacaccattaccaaaggatggtatcttgttttaatagaattaccgcttaaggaatggggacctgtgaaaaattcattcagtagaattcgatggttccatattaacagataggcattattatggtactgtccattagagaaatattgtacagtaaggcagtaagttaattatataaaactggcttttaaaatgcatttattaaaattcttatcaactgttaactgatgactgatttagaactttgcaatatttagaaacagtctaatactctctgttgaaaataatcactaattgttttataattataattatacatgtgtaaaactggaagacattacattattgaggaaggaaggcatttgtgttttgtttgttttttaagtcaggctttgtgttgaactattattttttatttatttatttatttagatggagtttcactcttgttgcccaggctggagtgcaatggcacaatcttggctcactgcaacttctgtctcctgggttcaagtggttctcctgcctcagcctcccgagaggctgggattacaggcacccgccaccacgctcagctaattttgtatttttagtagagatgaggtttcgccatgttggccaggctggtcttgaacacctgacctcaggtgatctgcccacctcagcctcccaaagtgagccactgtgcccagtgcagcatactctgtttacaagcacaagcagtgtagccagaggacttcagtttgaatcttgactttaccacttagtttgtgttcccttgaaagaagagcctgagaaaaagacttactggctgataggttatttgggagatgaaccaaaaagcagaagtgagagaatgggaaaagtgagacagagaagggagtgaagtttcattaagtgggtgatccagttccccctgcgggcagctgggcttcagccctgtgggtgtcttctgaatgtacctcactgttgtcccaccaaaggacagggagcctgagacatgcatgcaccaactttcacctgttgttaattgaaggttgctccgtgagctttaactccggcaggtctgtgcttgtgcctccatgctgttgagcagtctcccttaggtttgcaaagtctccgaggaacaaaacagagcagtgcctccactcccacttgagtcaggtgctgtgcatgccacatagacctgcccaccagagccacagtgcggagaggggtgagctgcagagcaccacgaaggtctgctgtggtctgccccttttaccagtgagactccctcatgccccattagatctactctgtcactgaccctgcagattggtggctgattatgatcactaaaagaaatatctaacaggtgcagtggctcacgcctgtaatcccagcactttgggaggctgaggcgagtggatcatgaggtcaggagatcgagaccatcctggctaacatggtgaaaccccgtctctactaaaaatacaaaaaattagccgggtgtgatggcgggcgcctgtagtcccagctactcgggaggctgaggcaggagaatggcgtggactcgggaggtggagcttgcagtgagccaagatcgtgccactgcactccagcctgggtgacagagcgagactccgtctcaaaaaaaaaaaaattatatatatatagatatatgtatatatctctgaaacaagagggttaaaatccctaccactgcagctggtcctgagctcttatttccatccttgacattcatatgagaatgctctaagagccctcagttgtgctggcagtagggtgttctctgggtagggaaggcaagcccgcatctggagtgttggttctgcaccctccttgttagctggcatttggcagtggcagtagttaggtcacccttcataagaaggagcccatgctgttgggcctatgtagagccttcctctctgtcactccacaggctccattgacgggcctggtactccagccttgggaagaagctggctgacagcactgacaagccatcctgtctgtccttggggtgtagttgaatgcctcttctgtgggaggtgccttgtgttgggcattcacataagataaagattggcactttgtgttccctgccttagggccgtcagcgtgcctcttctccaggcttctggtctcttatttcctttttggacccttttaatacaaaaattagccgggcatggtggtacatgcctgtaatcccagctactcgggaggctgaggcaggagaatggcatgaaccctggaggtggaggttgcagtgagccaagattgcgccactgcacttcagcctgggcgacgaagcaagactctgtcccccgccgcccacacacacacaaaaaaaattaaccacacacccacttgcttctgtagagaaacctagaactcctggtctcagaaatgtcatccaggtctcgctttcaggctttttgattattctgcaactccagaaaaagaggctgtttagtcccactctcttccattcagactgtctcctcttaagttttaaagatactattattttttcttaatttaagcttagcggatttacttctggttttgatccctctccagtttgggtgctttaattttatttatttatttatttagaggtggagtctcgctctgctctctgctaatttttgtatttttagtagagatggggtttcacaatgttggccaggctggtcttgaattcctgacctcaagtgatctacccaccttgtcctcccaaagtgctgggattacagacgtgagcccctgcgcctggcccatttggggtacttttagatgcagacggtggtttgggaacttgcagctccatatggtatagtggggagagcatgccacaaggttttcaggtaatatgaggttttctcctcatattctcttactacacttcaattcctaactttatcttccagcctaataatttctctcttgcactactgtcttatggtttcaactgtgaaaggtaatttccagtctcggtgtcacagatactccagtttaacctctgattatatcttatgtattctttcttccttccttttgtttctcccttccctgctctgtcttttatagggcaggggttagggaacgtctcattgccccttttgtttttctttttcctcattgcctctttttaaaatgatcttttttttatttttaaaagattatatattggccaggcacggtggctcatgcctgtaatgccaacactctgggaggccaaggtgggaggattgcttgaggccaggagttcgagaccccatctctatttaaaaatacacacacacgtgtgtatgtgtgtgtataaagattatgtaagcagcctattaataagttcctatataaaattttaaacactatgcaccaaagccttttagtccctcttccccacccttcaccccattgccctcctcaccaccctccttgccctccatcccactgccatcttggggacctctgtttcttaggttattggtctgtttgtgtattccattccctgttgagttaatttttgtattaatatctttatagaaaatgatacttttttttttttttgagatagagtctccatctgtcgcccaagttggagtacagtggtgccatcttggctcactgcacccttcgccccccgggttcaagcaattctcctgcctcagcctcccaagtagctgggactacaggcgcctgccaccacacctggctaaagttttgtagttttagtagagatggggcttcatcatgttggtcaggctggtcttgaactcccgacctcaaggccgaactgccttggcctcccaaagtgctgggattacaggcgtgagccaccacgcctggtccatacagttattcttgattttcagatttattcttataaaattatgcctaatgagaatatccctctcataaagttagtgtgaagattaaggaatttaacatatgaagtatgtagaacagtgcctggcctatagagctctaagtgttaactattatttaatattattatgcttgaatatttataattatttttggtaggcctccttgtacttcgtattatttatttgttctttatttttgtgcttagacttcctagggatattgaactttctagataatttcatgggtcttttcaaagagccagcattttggttttataaattaactccacttttttgttatatatttaataatttttgcttttaacatactaccttttcttcctgcctttggtacccattcttccatctcggttacacataatattcttctatttttaaacatttttctgttgtttctgaggatttaggagcagtaggaacacatttgtttattctcccagccttagttagagctgcttgtatattttcaaaagcttcttgcacctctgtctcctgatggtctgtaatttttccagcaacccaggatttaaatctgggaaccacctatgacaactgcatctctgctttctatcagatctagaagttgctaaattttatcagcgccccctctataatagttttcttccacttccctattctcattgcctcttggttgggatggttacttcttgtgtgaactactgtaattaccctttggcttatctacctcaccctgtccctttcatcccatgtaatgcttcaagagtgatttttctaaaccatggtgcactcacttctttgctctgaaacctccagtgatttctccttgtctgctgagtaaagttcaggctactttacactagcatttgagaatcttatgaattaattcctgcctacacttaatcattctttattcctttgttctttaggaaaaatcgtaattggtaagataaaccaaatataaaactatatagtaatgctgtttttcagtcttactgatctcactctattccttatctttaccatgcttttctgactttgtgcttttgcctctggatttcccagtctggaatgcctctctcacatcctagtatgttgaaatctgtccattattcaagtgtgagcttagatgccaacactttgatgaaggcttatctgatcccattgcctagaattaatcttctcttcccatgtctttggatttgaactgcagcttctgtgctctgttactagtcattccattttcgatagtctaccagtaacttctgtgccttagatccacatttacactggcttgtcaggattggtcagtgaatcaaataggtagtaagtataagcttctagaactacactctccgatatggttgtcattagccacttgtattttgactactgagtagccacatatggttagtggctactttattgagtaacatagagactttcatgattgcagaaagttattttgagcagtatctagaacaatgcctggcaaataatagacaccagggaatgttgttcctaggtatcacatcctcatagtagacactcagtaaatattagtttaactttcctttcctcatctgaattttattagcgtttacctgtgccatttaaaaagtaacagtttatggcagctaacacagtgtatgaacaataaatatattttgggtgagtaagtaaatactacgaagcatccagaaagcatcttgctctcttttggggtggggagagtaggggagtggaagttaaaaaaaattcactactcaggccgggtgcagtggctcatgcctgtaatcccagcactttggaaggccgaggtgggtggatcacttgaggtcaggagtttgagaccagcctggccaatatggtgaaaccccatctctactaaaaatacaaaaattagccaggcatggtggtgcatgccagtaattccagctccttgggaggctgaggcaggagaatggcttgaacctgggaagcggaggttgcagtgagctgagatagcgccaccgcactccagcctgggtgacagagcggactccatttcaaaaaaaaaaaaacagttcattgctcaataagtgaatatttccaggatgcttaaattaaacagggtagactaagcagctaaataaaggtggtcttatctactgcttttcaaatttagtgtacgcgcatgtcacctgggggtcttgttagaagattctaattcagcacggtctgggattctgcatttctagccagcttgcaagctagccagctctgcccagtgagggtgtaattcactagattggctacttaaacccattttaacatttcctagtctttagaactagtcctttaatttagctcaaagttttgttgttgttgttgttgttttgagacagggtcttgctctgttgcccaggctggagtgcagtggcatgatcatgactcaccacagccttgaactcctgggctcaagtgatcctcctgcctcagcctcctaaagtgctgagatggattacaggcatgagccaccacacctggcctaaagttctcctttttgaggtgataatttttaaagacagcccttatatgttcaggaaatataagcctgtttttacataaagtaggtgcattgttcagtaccaatatgagaaagaattatgaatacagctttatattattagatttcttatgtcataatataaaaaaccggtaaacttagcgctgaactattcatgatagttgaaagttttaagctaattcaaaatatgaaataaaccagaaatattttggaaagaagaggttttaagtatattcaggtcctccattttatgatgtgagtctaaatttctgttctctgatgtctagaaatcacaaaaggatggtgattttgggaacgaagttcttgagctagcactgtcagtagtaactggccgttactgtaagatctagagatatatttttagatgccattatacttacaaagaactgttagagtgcattttatggttttatggttggtttaattccccaaatatattgcccttagcaagttattactattttttatttcttaaatttatttattgaacatttttattcctttgtttagaaatgtgctagacagtggcaattacattgctgcaagataagtaaaaaaatcagctgactaagctttataagaggaggaatcatgtctcttttatttaccgttggatagtcactacatggcacataaccaagtcatcattaagtcatttttgagtgaacattgctcaagatctgcaaagcagctgtgatgtgtgcggggtgtactggaagttgaacgggactcctcaagcagcctaatgagttgggattgaggattgcatacacaagggaactcgcagatcaagtcctgaagagaacattgtagttactctggcaaagaacaacgaagacacaaaagctgtgcagagtaatggaagcctggaaggagtgcctgtgaagggagagcggctgcactgactttggtagagttggagcatcgtaagggtatggaggagaggggaggagagtagtagaggtctcagcagttgtcagatgacaaaaagtcttgcgttactaattttatcgtatgaaatgaggatattttttaggtttttaagcagagagaatggcaaggtcatttggttttagaagttagtccgagctaggcatggtgacagatgcctgtactggacaagctgaggcaggaggatggcttgagcccaggagctggaagctgcagtgagcagtgatcacatcactgcagtccagcctgggcaacagagcaagaccttgcctttaaaaaagaaaagtctgaaatacccctcacaactgttaaaaaaaaaaaaaagttctttcaagcacacgtggagtgttttatgaaagtgaccatttactaggctatacagcaagttcttatacatttcaaataaaatcaaccatgttttctggcgagaaagcatgtaggaagtgaataacaaactgtacacattgggaaatttaaaaacacacttctgtaaatcccacagattaaatataaaataatcaatttagtgaacacctagaacaaaacaatagagaaaataacagcctgagcaaaatagtgagaccctgcgtctacaaaaaaaaataaaaattagcccggcacagtggtgtccccctgtagcccctactcagaaagctgagatgggaggattacttgagcctgcaaagttgagtctgcagtgagccatgataacaccattacactctagcctggactacagagcgcaagaccttatttcaaagaaaaagaaacttaggacatattaaaacgtgtgtgaaaccctgaagccttaaatattcatatttgaaaagaagattttaatactaataagctaatctaagttagggaaagagcatggcagtaaattcaagtgaagtaaaatagagaatacagataaaagctaacaattctagagttcttactctattccaagcaccgttccatgttctttacaaaggttatctcatttaatcttcacaaagccatatgaggagggtattgttattatgtgcactttacacaagaggaaacttaggcacagagagaaacttatccaagcctctagctaataaatgtgatagaattggggcttgaaatgatgaattttttaaaaaaagatacattgaagaggattaacagagctgaaagttgttttttatgaaaggctaataaactatttgaaagattgatcaagaaaaaatataaagtacaaataatactgaggatataaaaggaagatacagaagaaagtcttaaaaataaaatatcttgaatcactttataccaataaattttacaatttaaacgtcaattttctagaaaattataacaatgaaaattgacacagagtaaatagaaaacctggatatttctgtaactattagagaaattggatttgtaattaaaagaaccacccactttcatatattcagagataagcctttggcccagatgatctttttttctaagaaaaaaaaaaacaggcctcttcagagacttcatttattatatgaagaattagtggaaactttgtcccaccattttaggctatttttacattagaaaaaatactgcacatttatgaaaatttactaggggcaaatttcaacttatctgtaaaatagtaatgccaactgtggagatggcactgtaaaccaaaaggcacaatgactaaagaaactactgaaaatttaacaattatctcttcattatccttccttattggggaacctgccccgatagtcatgtaggttcttttctattttccgtaagtgttggctggttagagaaataaagggacagagtacaaaagagagaaattttaaagctgggcgtccgggggagacatcacatgtcggtagattccgtgatgccccacaagccgtgaaaccagcaattttttattagtgattttcaaaaggggagggagtgtgcaaataggtgtgggtcacagagatcacgtgcttcacaaggtaatagaatatcacaaggcaaatggaggcagggcgagatcacaggaccacaggacggggcgaaattaaaattgctaatgaagtttcgggcaccattgtcattgataacatcttatcaggagacagggtttgagagcaaccagtctgaccaaaatttattaggcgggaatttccttgtcctaataagcctgggagcgctatgggagactagggcttatttcatccctacagtctcgaccatagaagacggccacacccaaggggaccatttcagaggcccaccctcaggggcacattctctttcccagggatgttccttgctgagaaaaagaattcagcaatatttctcctatttgcttttgaaagaagagcaatatggctctgttccgcccggctcaccggcggtcagagtttaaggttctctctcttattccctgaacattgctgttaccctgttcttttttcaaggtgcccagatttcatattgttcaaacacacgtgctctacaatttgtgcagttaacgcaattattacagggtcctgaggtgacatacatcctcctcagctgacaggattaagagattaaagtaaagacaagcataggaaatcacaagggtattgattgaggaagtgataagtgtccatgaaatcttcacaatttgtgtttagagactgcagtaaagacaggcataagaaattacaaaagtattaatttggggaactaataaatgtccatgaaatcttcacaatccatgttcttctgccatggctttagccagtccctccgtttggggtccctgacttcccgcaacacttcctgctccaagatttgctatgatgagttttccaaatgttaacgacctggaaaagctcattgtctttaagacgtatcccttctgagtcttgtgatttggtggtttcttcatccaaaacgtatcatcctctataaaactccctgatcctcagatttaacttttcagtttctttttccaagttctcatcagtggtttaatggctgtatctgagcacctaaaaggtaaagactcttccaagctgttgagactccctccaggcaggggaatgactatctgggtctgagattatgtcattaagttctttttttttctttttctttttttttttttttctttttgagacagagtctccctctgttgcccaggctgggatgcagtggtgcaacctccactccctgcaacctcagctgcttgggttcaagcagttctcctcagcctcccaagtagctgggattacaggcacctgcctccacgcccagctaattattgtatttttagtagagacagggtttcacatcaggtctcgaactcctgacatcaggtgatcaacctgctgggattacaggcgtgagccaccacaccctgcgtcgctaagttttttaaccagagaggcttcaggtttcagacacacagaagcataattctggccatacaaaaacctcagtttcttctgtcttccacccaatcaaagtctccttcaaaactttaagtaagtttctatttgccacttcaggacacacctgcactgaactagacactgacttagaaacttggtttgatttggcaaattttctgttaaaatgctccatacttttcttatgcctattagagttatttctgacctactgtatttactttcagaattttctgaagctataatctttcaggaaatagtactattttttgaaatagtatttctattttttgaaaatagtatttctattttttgaaatagtacttttcaaaaaagtactatttgaagaactcttgagtatttactttctgtaaaggaagttcacatgtggcagctttctcctgagtatctaatttgcaattgcctaactgctcagtgacatccactactgtctgttctttgtgtttggcattagctttgagaccagctttctttttcattatgcttttttggtgcagctgtcgtctaatacttgttgaatttggtctgtttcctggtagaatggaggaaacaaagtcttgctcattatcactgctgctgtcattatgagtgctggaagaacaattgctagaagattcatattgcttttcaaactggctaggattgttgatatctgatgttttaatggctttactgcataactatttcttttccagaatggccactttgcccttcctttagcagttgaaaatctggatgcctctcaccgtactggagttttgggaatttgtgcttcaaaaaactcagatgcttcataacaaaaattgctgcaaaaagactttctttcagtaatatcatagactttattggttttgaaattttatatttaattcccagcttcttgtgacataaaggataaccacagagtttgacaatagaatgttcattcactacatcgttgtagtgagcaggtgtaatgaacttccccttttagaagcatcttcttgtttcaaagtacttgtctgtttagtacctgtggcatttcgagaatggtgggagccctggccctctgcagcccagggcagtcagccatgggagagagtagtctgcgggtctggaccagctccagagtctcgccccgaggcaccatctccctacctggcccacgttatcttaagggtgaattcttttaaactgtccatgtcgtaggtatgtccagatttacacatgccattccagagaatagcaaattaaggaaagttcctcagtttattgtgactagtataactttggtaccaaaaccaagcatggctaatatgaaataaattatagaccagtcttgcttatgtaaaatctaacaagataggagcaaaagaagtccagtattatgtttaaatattttatatgtatatatctcatgtctacaatgctgactgtaatacagttctgacagagttagcatgaaactccacaggtttaagggtgcagttcccaacgagactgcccttgctgcgagtacaagttaaaagtttggtggtccccagaccacctgttattccgattaactggctgcaaatctgggggttcccatgaatcccctcaagtttgataatttataaattaactgactgaacttgggaaagtggtatacttaagttacactttaattatgaagaatacagatcaggaccagccaaatgagatacagggtactgggagggttcctaacatggagcttctgtgctctcttctcctgggatcagggtatgtcaccctcttgacacatcagtatgctcaccaatgaggaagcctacctgagctatggtgtgtgtagattttatatgtaggtgtaatggaataattggccatgtgattgaactcaaactttcagtgttctctcctttcttccttagaggcttggctagctcaaaccccatccttctacacatggtggcctttctggtgagcagaccccattctgagtcatcttgttagcataatctcccccattctgagtcaattgttagcataatctcaggaatgatccatgaggctcgtgagtaacaaaggcattcctactaccaaggaaattccatgaattagaggttctctcccaagaactagggtcaaagactgaatacattatttattatacaataatgacaaattgaaattatcccaggaatgcaagataagtgtgttaattatcattgctgcataacagtttatcccaaaacttaatgacatgaaaccctaatttacaagaattcaggagtagcctagctggatgtggttctaatctttatgtttcacaaggttgcagtcaggaagtcagcaggggctacagtcatctgaaagcctgactcggggagaatacacttccatgtggcatactcacatggtggttggcaggaggcctcagttcttcaccctatgggccttcccataggctcgagtatcctcacactgtgacagctggctttctccagatctagtgatccaaaaaaaaaaaaaaaacaaggagaaagctgcagtgccttttaagacctagtcattactttattcgtttcttttttttttaaattaaattgagatggggtcttgctatgttgaccaggctggtctcaaactcctggtctcaagcagtcctcctgcctgttcctcccaaagtgctgttattacaggcagaagcctgtagtttttcctgtatcctgtttgttagaagaagtcactcagtttaacccatactcaaaggaattagtttccacctcttaaaaagaagagtatgaaagagtttgtggacatatttaaaaaccaccacagatggtttattcagtaaagttcttaatatgaattagtattaatttattaattcatttgcacattttgaaggagaaaaactctgtgctcatatcactagatgaagcaaaagcacttgatgaaatttaactccatgatgaaacctctcagcaaactaggaagggaacttccttaatgtgataaagactttcattaaatttataattaatttaggaacagttgacataccttatattgaagctttctgtacgtaatatgattcatctatttgttaaacttattattttgttcttcagtattttaaaattgtgtttatatcagtgttttacatttggaattgcaaaatgatatagtgaaagatgaagactggaagtcctagctagagcaattaggcaagagaaggaaataaagggcatctaaattggaaaggaggaagtcgaattgccacgatcatatatatatgtggaaaaccctaaaaacttcaccataaaacttttagaactgataaatgaatttagtaaggttgcagagtacaaaatcaatatacaaaaattagtagtgtttctatacaccaataatgaactagcagaaaaagaagagagtaatccatttacaaaagctaccaaaaaatgaaatacatttgaccaaggaggtgaaagatctctacaaggaaaactataaaacactgatgaaggaaattgaagcgggcacaaaatatggaaagacatccatattcaaggatttgaagaattaatactgtgaaaatgaccatactaccaaaagcaagctatagattcaatgcaatccctatcaaaataccagtgacagtcttcatagaaatagaaaaaaaatcctaaaattaatataggaccataaaggactgcaaatgccaaagcggttctgagccaaaaggacaaagctagaggcatcacactaccagacttcaagatatactgcaaagctgtagtaactgaaacagcatggtactagcataaaaccagacagtagaccaattgaacagaatagagaacctagaaataaatccacatatttatagccagctggcaaaggcgccaagaacatgctttggggaaaagacagtcttcaataaatggtgctgggaaaactggatatacatatgcagagtgaaactgtacccctgtctttcaccatatacaaaaataaactcaaaatggattaaagacttaaatgtaagacaaaggcaccaaagacaaagtgaatcatctattttcttttattattattattttttgaagtatagagatggggtctcactacattgcccaggctggtctcaaactcctgggctcaagtgatcctcctgccttggcctctcaaagtgctggggttataggtgtgagccattagcgcccagctaaatactgtattttcagcccatgtttgcctgcaatatgaagagattgctatacttattgaaaagaagagaccggaagtggtggttcatgcctgtaatcccagcactttggaaggctgaggcaggtggatcacctgaggtcaggagttcgagaccagcctggccaacgccatctctactaaaaatataaaaattaaccaggcttgctggcatgcgcctgtagtcccagctactcgggaggctgaggcaggagaatctcttgaacctgggaggcggaggttgcagtgagccaagattgcgccactgcactccagcctgggcgacagagtgagactcgtctcaaaaaacaaaaagaacttgcatataaattgacccatgcagttccaacctgtattgttcaaaaaaaccaaaacctcccttagacctagaatcccacttctgcaaatccagcctacagttttatcagcccaaacaacaacaaaagcatctcttcaagtttatttattgccgcattgcttatactaaattattggaaatgatctaaaatgtccatcaacatggttgtgcactgtggcatgcacctgtagttgggactgctcgggaggccgaagcagtgcaatctgattgcacctgtgaatagctcctgcactccagcctggaccagcatggcaagaccctatctctaagaagaaaatgttcatcaacgagaatgagcaaatatgaccataagatatttataggataaaacactagataacaatgaaaatgaattaagaagaactacaagtatctatcatggaaatacttcacagtgttatgtgaacaaaattaaagcattatatatataaaaacagtaaagtttttatatatctgtagaaagtttaacaatatgtaaggcaatgctatatgttacttaacaatcctttctttgaaataaaaggcaagttgatgtgtgtttaaactagaaatcccaggaaaaaatcagaaaggtacctgggcttaaagaaaaatgctaaacggggctgggcgccatgactcacacctgtaattccagcagtttgggaggccgaagctggtggatcacccgagatcaagagttcgagaccatcctagccaacatggcaaaaccctgtctctactaaaaatacaaaaattggccaagtgtggtggcatgtgcctgtagtcccagctactcgggaggctgaggcaggagaattgcttgaacctgggaggcggaggttgcagtgacccgagattgtgccattgcactacagcctgggcaacagaatgagactccatatcaaaaaaaaaaaaaaagatgctaaaaggaaagcagggacaagtaaatgtcaaatccatttcatgccatagaacttttttttttttttttttgaggcggagtctcgctctgccgcccaggctggagtgcagtggcatgatctcggctcactgcaagctccacctcccgggttcatgccattctcctgcctcagcctccccagtagctgggactacaggcgcccgccaccacgcccggctaatgttttgtatttttagtagagacagggtttcaccatgttagccaggatggtctcaatctcctgaccttgtgatccgccatccttggcctcccaaagtgctgggattacaggcgtgagccaccgcgcctggcctagaacttcttacaacaccctaaaccagtacatttcaacctggaaaagatgttgtaacgcagaataaagaaaataaagtacagatatttcattcccaaggcggggaactcttctaggttcccaagttcttgagcttcacgtgcatacagcaggaatctgtcatcttgagggagttctttcttaaacctatgggtttgtaagattttagttttctatgctgtccttttttggtcatgcttgtcagggaagaattgttaaaaatctattttaacaccctctgcccttattcagggcagttagagacttaaattttacgtacacatactacctttgaaccttcagtgtgttgtttatgtactgaaagattgcagttgaatttagatcatgctttgaagttccctttgtcagaccacattgtttgtacccaaagaaagacttcattttctttttgtctgtaattatttccatacttatttaacttggtataacatgtggtactgtaaaagcataacccaagccattgtttgccttaagcaacattttagacattttagatttggggatgtggtgtttacttatacaagcctttcttaagcccttttaatttatatctcaaacttgaggatatccatgaaaacagcggaaactttttcctcaccggatcttgacacaagtcagggatggaagtgagcaaaaggaagtggtgtggtttttatatcatttcagttgtgttgagatagggaaatgggatagtttatccactgtactgctcttttgggaaagtctggtttgtatataaaagtgaaaggaattggcataatgttttaatttcttctgctccattcagtcattccctcaataaatatttatttagtatcgactctgtgccaggcactgttccaggtgctaaaaatataaagtgagtgaaacagactaaccctcctggcctcatggagcatatattctagagcaggtggcaggcaataaaatacagaaaaattatatcaaattatatagcatgacaaatgctaaagagaaagaaacagccagaaaggagaggagtgctaggcatggggatgggattacagttttaaatagggtgggcaggaagcctgtaaataagaaagggattttgagtaagtgcttggaaggggcaaggcagcagtcccggggaagaccattacaggcatagggatctgcacgtgccagggtcctgcagcaggactgtgagcggcaggtgcaaggaacacctattaggctggaacggagggagggtggaccactggagactttagctttttgtctgagtgagttggagcaccgttggagggatctgaatggggtgtgatgtggtttaacatgctttctcttaggatcactctggctgctgtgttgcaaatccatagtgggcacaggtggaagcaggaggccagttaggaggtgccttcagcaatccaggcaaaggggttagtggcttggtccagagcgagcagtggaggtagtaggaagtgtgtgggttctggacagattctgcaggtacaaccagtggatttgatgacaggaaatggaatgcaagaaggaaagagggagttgtcaagaatgacttgagattttaggcctggttacatcagtgtagcgatattctaaaaataaaaaaaaaaagattttagacctgggacttttaagattttacaccaagtaaagaggctgtcaacggaggtgggaaagacttaggatctagcaaatttgggagggaagaggcaaggaaagataaatagtgacaaattgtatagttgctgataacattgttaagtcaatatttatactatttgagctgcctttttttttttttccccctctgagacagtctcgctttgtcgcccaggctggaatgcagtggcacagtctcagctcactgcaacctctacctcccaggttcaagcagttctcctacctcggcctcaagtagctgggattacaggcacccaccaccaggcctggctaatttctgtatttttagtagagatggggtttcactatgttagccaggctggtcttgaactccccgcctcaagtgatctgcctgcctcagcctcccaaagtgctgggattacagacgagagccactgtgcgggccttagctgtcttaaaaatagcacttatagcagcctgtgttttcttttcagatgttatcaagtatcttttctggtaagacatttatttgcctttattcagaattgctaattttatgctaatctaacccagaatactcaagtgtgcctttccctttaatcctcatattagctatattagctagaatatttttggttgtaacagaaaaattgactctctctgacctaaaaaatggaatttattggctcttaagagttccaaagtaattgaggcttcagacaaggttgcttgagtggctcatcgatgtctcccgggatctggcttctttcagtctcctggctctgccttctggttctccttctgggcccaacatagctgccagcagtttctgggactgccttattcatattgagtctgagagagtgactttgtcactgcagggtcagtcaaagtcctgagactattagaccagctcgcccctgaactttttgtggcagggaagatagaatatgcttagtgtaagagcctctactcctgagatcttaggggaaatctttgtaccctgaattaaaaaaaatttttaaatagttacataagtggaaatgattgatttttaaaaattgcttttgcattgtacaagcaccatggttaacaaaacaattcctttttaaagcagtcaggtgggaagggaaaaaaagtaaaattgtattcatacattagtttgatcaagataatttttcttcttagagatttaatagtgttgccacttgaccagctggaactacaaaggaaccattagatagtaatgaagtatgatacccttttcagcactccttctcacctttttactttacatctccagttttgcctcgcacaaggtctcttcttcctctgtggatcctctacctacatgtgtctacctgctaattagacaggcacatgcacactagttttctttatccccaaaattcagtttgcaaatgggaccgaagagctccctgttcccctcatgacaccgacacgacaaaaaaaagttattccactaattcccttgatggtcggtttaggagtttctgcctccactattgctctcggtactggaataacaggcatttcaacctctgtcacgaccttccgtagcctgtctaatgacttctctgctagcatcacagacatatcacaaactttatcagtcctccaggccctagttgactcttcagctgcagttgtcctccaaggacaactccgaggccttgacttactcactgctgaaaaaggaggactctgtatattcttaaatgaagagtgttgtttttacctaaatcaatctggcctagtgtatgacaacataaaaaaactcaaggatagagcccaaaaacttgccaaccaagcaagtaattatgctgaatccccttgggcactctctaattggatgtcctgggtctcccaattctgtcctttaatacccatttttctacttcttttattgggaccttgtagtttctcaattcatccaaaaccgtatccaggccatcaccagtcattctatacgacaaatgtttcttctaacaatcccacaatatcaccccttaccacaagatctcccttcagcttaatctctcccactctaggttcccacgccgcccctaatcccgcttgaagcagccctgagaaacaccgcccattctctctccataccaccccccaaaaattttcgccgccccaacacttcaacactattttgttttatttttcctattaatataagaaggcgggaatgtcaggcctctgagcccaagccgagccatcgtatcccctgtgacttgcacatatacgcccagatggcctgaagtaactgaagaatcacaaaagaatgaatatgccctgccccaccttaactgatgacattccaccacaaaagaagtgtaaatggccggtccatgccttaactgatgacattccaccacaaaagaagtgaaaatggccagtccttgccttaactgatgatattccaccacaaaagaagtgaaaatggccagtccttgccttaagtgatgacattaccttgtgaaagtccttttcctggctcatcctggctcaaaaagctcccccactgagcaccttgcgacccccactctgcccgccagagaacaactcctctttgactgtaattttcctttatctacccaaatcctataaaacggccccaccctcatctcccttcgctgactctcttttaggactcagcccgcctgcacccaggtgattaaaagcttttattgctcacacaaagcctgtttagtggtctcttcacacagacgcacatgaaactaggcaagaatcagtgtttctctacaaattgagttgacaaaaagaaattatcttcccctgcccccacaaaaaaagaaccagtatttctcaacaaggagagtactgttagcatttggttctttattttgaaggattgtccctgcacattgcattttctatcctggtccctggtcaaactgtatgtcctgtcatatcccagacattattccaaccaaaaagtcacctacatatttttagatcctcttaggagggggtggtaacccagccactgctgatgcctgaggggagtgcaaagctgggtttttgaggagctgggactgagatcctgagtagtaggcaccactgggcctaaaaggattccatggggttggttctgggagtgtggaaggaagcagagagtgtagattgctgctgccaattgaatgccagtggcattcaggcaactgacaggaacagcgaaccaaattgggaaaaagaaagtcccttctcccctcttccagctttctctagttccccagttggcagagcctctccaggaaccagctggtgaaggacatattgtcagcagcatcccagctccagcatcagaaagcagaatctatagatagaagagggagctttttttttttttttttggctgaaaagcgatagtgtaaaaagggacacagtactttctgttttttaatctcattactttcctgccagcgccttaacaagtggaatttgggctttgtcagcagcaaacctgccacttactggttgtgttaagttgggcaagtttctttctttttttttttttttttttttttttttgagatggagtctcgcactgtcacctgagctggagtgcagtggtgtgatcttggctcactgcaatttctacctcctgggttcaagtgattcttctgcctcagcctcctgagtagctgggtttgcaggtgcctgccaccacgcctggctaattttttgtatttttagtagagacagggttttactatgttggccaggctggtctcgaacgcctgacctcgtgagccaccatgcccggccaactcaggcaagtttctttgcgcttcatttttttttttttcagagttatgaagatgaaaaaagatcttacagggttcagtaaaaaataacttccagtttcctgtttaacatatgtgctcatggtatacccgacaaaacactgcactttggattagaaaacctgggtgttagtttgtcatatatactagctacatggaattcagcaagttatttatctccttgaacctatcttttctctgtaagtaggaatgattttacttactgtaaggatcacagagatgggataatgcacgtaaaactaatttgtaagttataaaaatgacagtgacaatgggatgctaagcaggtaccattaaataccaccacatatctgagtttctctgatttaatctgcacaaaatacctagatcatctgttttaggctagactctgaactctttaccaccacattaaactgtttttttctctattcaatttaccagtaaaggttgagcatccctaatccaaaaatctgaaatctgaaatgctgtaaaacctgaagtttttgagtgttgacatgacgctcaaaggaaatgctcattaggtgttttggatttgagttgctgaaccagtaagtatagatagtgcaaatattacaaatttaaaaatccaaaatccaaaacacttctggtcccaagcatttctaataaggagtagtcaacttgtacccattgtatgcctatggggtgaccagaccctctccctttccagacagttctgcaataactgattcacttcgcctgtttttggtcatttctgcgtgttctagaggagaaacagaagagtgacacctaggtctcttaaatagacagctgacagacattacgaatctcttcgaagtacagatatgccaaagattgctgtgtagtacaatctagttgtaattgtgagacttttgttgttgttgttgaatacagttaaacaaaaaagctttggagaaactaggttagggaatttgtagtacaaggttgaatgatgttttgaaaacagattatctatttgaaaaatgtttcagaaacctggaagcatttcttctgcatctaatattgaggtcctggtgaagggtataaaacacacagcatcaactatatataatgctatactagattgtcttgattctgtggtcctggaagagtttatacttgtgttggggaaactatcttggcatagaaggaaagtgaaggttttgagtggggcagggacagttgagcagaaatacaaaggttaaatgtgggcttgttttgattgttaattaataattgagcatgggggaaaggtagagttggaaagtaatttcaggggtggcgatgaaattggtaacttcaaagtggtggagacatgacagtggaagttttatacagtggaacttccccatccctgttttaggtcttcacttagttgcatggttggctctctttgctcctggcccacgggcattattgtaaaactttctaaaacaccctgttatgaatgtcttacccatagcaagatctgacagcgtggacaccaaggcaggcatttcggtaagatttctgtgtattacctcagatacactcagacaactctttaagcaagttattttcttcagggtttatgtttagatttgcgggatattgttttctacactgatgtaaataactgcgagtggtgttgctccagttgtacaagtgtgtattcctctaaggattgatggggaggagtgtagagaacgggaaggaatggatgagttgcttgttaagggaaaagatgatattcttatgctaatccaggccctggataaggagcagagcagccatgcgaacaatggccttggagccaggaagtctgcagtgagtctattccttctcagaaagcttgtcagacccggcgcctggagctgcctggcggggagggacccctggaaaggggagttttctccttgctattttatggaattggctgctggccagcttgttggaaattcccaaacttctctactagaaagtgaaaatcaacggtggggggcttaacaggaagaggaaggaatgactttactctgtagtctgttttttcaactgacttcagccttttcctgtgtttttttttttttaagttccaattgaactgttggttcagttgtcttgctgtttgaggagttttaaaatcttttacttaaaaaagaaattatttatatttgagtaattctgccttaatgttattttcctgaaaagaaacagtaccagtctgtgtatatagcaaggggaagtaaatttatttagatgcccatttcgtctaactattcaatagcttttaaatggcagcatgattaaaaaattttgattatgcagcatgtcaaatatctgcatctccttatattcttcactttgcaagattagatatttttaatgtaaaaattccgatgaatcatttaggaatttaaaaaatatattttatcgttagatattacaattacataattttaagaatgattgtggccaggcacggtggctcacacctgtaatcccagcactttgagaggccgaggtggacagatcgcctgaggtccaggagttcaagaccagcctggccaacatggtgaaaccctgtctatactgaaaatagaaaaattagctggacgtggtggtgcgtacctgtagtcccagctactccgaggctgaagcaggagaattgcttgaacccaggaggtgaaggttgcagtgagcagaggttgcaccactgcagtccagcctgggctacagagcaagactctgtctcaaaaaaaaaaaaaaaaaaggctggacgttgtggctcacacctgtaatctcagcactttgggaggcagaggcgggaggatcacctgaggttgggagttcgagaccagcctgaccaacatggagaaactccatctctactaataatacaaaaattagctgggcgtgatggcgcatgcctgtaatctcagctactcgggatgctgaggcgggagaatcgcttgaaccctggaggcagaggttgcggtgagctgagatggcgccattgcactgcagcctgggcaacaagagtgaaactctgtctcaaaaaaaaaaaaagaattgttgaaaaataaggttaatattttgctatgtgattgtagaaacagttaatatgagacaaaggagaagtgctcagttattaataattacatctgtttgttgaaatgtttactgagatgtaatattactaactcttttgagttagtaatatccccattttgtggtgaaggaaaccgagacctggatagcttaagtaattccccaaaatcacacagcaaataaatactggagctgatttttaaaaattatttatatttattattttatcagtgaataccacatcagtgtatgtggtgttaacgcctttattaatgcagtttttagacgaatggtgttctggggccctcccctcttttcactctcttggaaggccatctccagagtcatagctgaatattaccgttcttttagcataaccgatttgtatgttcagccccaaatgtgtcctttaagtttcagaaccaaatgcccgttagacattccctttgggtaatctcagatctctaaatttgaacctttgatctcttcactcctgtcaaaatcactcattcccatttcagtaactgttcatgccacagatgtgggaatcttctttgacgcctcactttcccttaccctacatttaatccattgctaagtaccactgagttttgttttgttttgttttgagacaaggtctcgctctgttgcccaggctggagtgcagtggcataatcaaagttcactgcagccttgaactcctgggctgaagagatcctcccacctcagcctccctagtgtctgggactacaggtatgcaccaccatgcccagctaatttttttaagttttttgtacagatgaggtcttgcagtgtttcccaggctggtgttaactccagacctcaagtgattctcccacctcagccttccaaagtgctgagattacaggtgtgagccacgtacccagccaaaaattatttttgaagtatagcatgagtccatccactataccactgccaccctattctttttttttttaattcatccatctgcacacggattctgccctaatcttaaccaccattgtcattctcctaaatttccacaatattctgcttactcatctgtttgcttttgctattatcccctccagtccattacgtagaagtcagatgatgcccacttaggcttaaatcccaagtccttcatatgcccttgcctgatctggtctttgtcttctctgcctcttcaccctcatctcccactacactatctcttattctcaacatttcagacattgttctctctttgcttttctctccctcaagatctttgcccacggtgttccctgtgcttagaacttcccgtctttctttgcctgactgactctatttttcagatctcaacttaaaggtcacttctcagcattgcttccctttccgcttcatctagattagaggggggtcactgcccctattccttcaggacctggcacttttcttcctttgcacttatcatgagttatgattgtgtatcatttgtgttttcttgtttggtgtcttgagtatcttaattgttttgtttaaggactctgaacttcatgaaggctgggcctgtttggctctgaacagtgtattcttggtatctaatacagaatcatgcatagcacagacacttaataaacatttagggaataaattaataattcaacggcaagaacactgtttccataggactccagcattggaagggataacgtagattatttagtctagggccaggcggtggtggctcacgcctgtaatcccaacactttgggaggtttaggcgggtggattgcttgagtccaggagttcgagatcagtctgggcaacatggcaaaccccatctcaacagaaaatacaaaattagccaggcttggtgacacgtgcttgtggtcccagctactcaggaggctgaggtgggaggattgcctggagcccaggaggcagtgagctgaggttgtaccactgcacttcagcctgggcaacagagtgagactctgcctccaaaaaaaaaaaaaaaatttagtccagtctccctttctatcatgttggtcatgtctttgacaaagatgctctcaaactttattccttatgtactctgtgagcaaagtccctgggttcttttggttgtatctcaagtggagtggttgctatgtcctttgcattcctgtcattcttctctcaagtgcttaggaggcctggccaggtggaatacagtaagatggttgtcctgtttgattacagcagcatttcccttcattctcagactgcatgcatgtcttaggagttgtcatcaataccaatacgtattgagctcgtagtcagggaagatttgatggctgttctccatacaagttatcacagctttttttgtctataaaaatttcttgcagattgaattgttatggatagcacctgttagtgacttcctttgccaggttggcaagtgtgttgtaaacatggatgagaggaggaaacttctatttagcacctactatgtaccaggctctcctaaatagtttaaaatgtgtatttacattatataatatatataaaatcaggcagggaagtataggatagttgttaacatgtagaatctggaatcagacctccttgattttaattatgactctgccacttaacctgttgtgtgatctttgataagttccttaaagtctacttgcctgtttcttcatctgtaaaattaaaataataatttaacctttaaataagttggttgatggtttgataacttaatatatgcaaagcatttatgactactggcacatagaggttaatatgtgttagctattattttatatgagttccttaagtttaaaaatatttaaatttatttaattttttattttaaaaattattttaaatatgtgtttgctgttatctcatttggttctcaaaataactgtcagttaataaatatcattccagatttgtttgtttgttaagatggggtcttgctgtgttgccaaggctggagtgcagtggctcttaactgttgtgatcacagtgcattgtagcctggaatttctgggctcaagtgatcctgtttgagcccaggattacagctgagattacaggcggtcaccaccacagttggcctcattccagttttaaagatgaggaaactaattcagagaggttaagttaaaggcagatccagaatttgaacttatgccagggtagcagggtcgtggatgtttttgcggaaggaactcacacacagtcctttcctctgaaagggaaagcacttagagtctcacggccagccagctctgcagggtgccttggttgtggctctaatgagacaaggccacatattagctttaaataaaccaatgaggaaacagtgacaatgaaagatgtaacaaggcatagcggtcagtctcctgcccaagactgtgagttccttgcagcaggaacaaccatactcatatttgtatttctggtacctaacactgggtcggtaatacgtactccagatgcaggccagttgcagtggttcacacctgtaatctcagcactctgggaggaggccaaggccacaggattgcttgaggccaggagtttgagaccagcccaggcaacatagcgagacccaccgcccccacccctattaaattaaaaaaaaaaaaaaagatgttgttggtgaataagtgagtaaattaataagtgaaaatttggggaggggtggagacctagcaagggaggcaggaccaaagccagggtttctggcatggtatccactggagagtggtagccagtggaggagcaagaaagaaaggtgtgggtttgatttagacaggtggagtgtgattctagtagaaatatttagtgggaaaattgaaatgaggaagagagattaggattggaaatacactggaaacttctcttgaattggaaacctggaacatatatccttagaatgacagttgaattatttcaagaagttttcaaagaaatgctgttaaatcatgtggcagacattattctatagttattttagactttacatctttttctctcagcattatgtaatgggaaacaattttatattacagaaataagagattgcagggatttttagaactaagctacatataacatacacgtgtaaatgatacctcactgtaaaccttctttgcctcagtactgtgaataactttggaaagctaattaaagtgaaaattcttacttagatattataaagtagaaagctcaggttattaatgtagaaatcacaccagggtcattgtgtcataaataagcaagatctttgtcattcaggaatagttcaagctgaaagtcaataaaatcaaaccacatgaaacaatgggatgggggtaaagtagaatgatatatatcttgatactaattagccttttcccccgttatttatttaacaattttactttgaggcatttaaaagttcactgtctatattaataatcaccaaaccttaattggagagattatgtttcatgtcatccatattagaagttcagtttcatcttaataaagtcaaatttgcaatattttaggaaataatttctttaagatactgcttttttccctccgctcccctcccctcctctcctctttttttatgagattgtgtctcactctgtcacccaggctggagtgcagtggcgcagtctcagcttactgcaagcttcgcttactgggttcaagccattctcctgcctcagcctcctgagtagttgggactacaggcgcctgccaccacacctggctaattttttttgtatttttagtagagacggggtttcactatgttagcctggatggtctcgatctcctgacctcatgatctgcccacctcagcctctcaaagtgctgggattacaggcgtgagtcactgcacccgaccttcttttttttttttttttttttttttttgagatggagtctcgctctgtcgtgtaggctggagtgcagtggcacaatctgcaatcttggctcactgcaacctctgcctcctgggttcaagtgattctcctgcctcagcctcctgagtagctgggattacaggcacccaccaccatgcctggctaatttttgtatttttagtagagatggggtttcaccatgctggccaggctggtcttgaactcctgacttcacttcaggtgatctgcccaccttggcctcccaaagtgctgggattacaggtgtgagccactgcacctggctcctttttcttttttttcctttaatgatgaagcaccctctttaattaaatatgtgtaattttcgcctggcatggtgactcacacctgtaatcctagcactttgggaggctgaggctggcggatcacctgaggtcaggagtttgagactagcccggccaagatggtgaaaccccatctctactaaaaatacaaaaattagccgagtgtggtggtgcacacctgtaatcccagctactcagaaggctgaggcaggagaatcacttgaacccaggaggtggaggttgcagtgagtcgagatggtgccattgcactccagcctgggcgacgagcaaaactctgtctcaaataaaataaaataaaatgaattaatatgtgtaattttctaggtcggcttcctcttctatctatagaataaattatttattagaaagacttagggtgttttcattatatctactagaatttgcaagaatgttgatggttacccttatgttttaaatttaacttttcctgtttaagtcttaatatagttgggaattttcatgttattaataaaataattagaacagccagaaaggactattgagattgtttaatatacttcccttgttgtacatatggctaatctgaggtcaggagaggttgcagcctgttaactaaattatttgaagtttgaaattatagtgcctaaaaaaaaaaaagcaaggatacctttaatcttttaaaatgtatttcattgtttaaaggtgtgtttgggcatttgtttcccttttagtttttgaaaaatttccaaaattcagttgtattccttaccttttaaatatttttgtctttcaggagtcgtaagaaagcagtgggagttgaagtcattgtcaagtgcttgcgatcttttacaagaaaatctcactgaatgatagtcatttaaattggtgaagtagcaagaccaattattaaaggtgacagtacacaggaaacattacaattgaacaatgcctcagctatacatttacatcagattattgggagcctatttgttcatcatttctcgtgttcaaggtaaatcagtgttcattttagtaatgtatgtgtgtatataaaaagcactatttcttgcttctgttctttcaactcatccctgtttgaatagttaggcccagcctactagggcagcttttaggaaagaagcaaagatgaaacacgtgccaaataattttttaacttggctgtgatggaaacattttcaagtatttttgaaatctcagtctgagtctgtcttctccttcacaacataggcgtaatgatacacagcattaggtcttgtgaggattaaatgagataaagtatgtaaagccacctcagttagtagctgaaagacagggtaataggtagtccaggctgagcttcaaaattcctctctcctttaaaatacaataaggagcaagtgtaaataataattgaaaaatcattttattggccaggcacagtggctcacacctgtaatcccagcgctttgggaggccgaggtgggcggatcatgaggtcaggagttcaagaccagcctgggcaacatggcaaaacctcatctttaccaaaaaatacaaaaattagccgggggcctgtaatcccagctactcgggaggctgaggcaggagaatcacttgaaccccgggaggtggaagctgcagtgagctgagatcgcaccaatgcactctagcctgggcgacagagcaagactcttgtccctgccccaaccaaaaaatttcattttattgttgttaaaagactttagaaagataactgacacttgtctgtgctgaatactaaaatttcttcatagagcactgacagtttgtttatgaccaataaagtaattttgctactatgtgttcacagcttagaactcccaaacaggaagttattgtgatgactcttaggaccagatggcctgtatttgcacataagctttttcctgtatggtttaagtaggataatattttaagctgaaaagacagtactgttttgcaagaggattttagataaaacttactggatgtcttcgttctcaagttttttacttcacaggttgctttttcctaatgttttgatcacagtgatctggattaatatctgctgttaagaagaaacatgattaacaccataaagcttttgatattttcatcttttttttttttttttgagacagagtctcgctctgtcaccgaggctggagtacagtggcgccatctcggctcactgcaagctccgcctcccgggttcacgccattctcttgcctcagcctcccgagtagctgggattacaggcgcccaccatcacgcccagctaattttttgtatttttagtagagacggggtttcaccgtgttagccaggatggtctcgatctcctgacctcgtgatccacccacttcggcctcccaaagtgctggcattacaggcgtgagccactgtgcctggctgatattttcatcttaaagcacaaacatagaatgaaatctatagcttctttttattttgccttagtattataacaatatccttagtattacaacaatatccttagtattaccatgctaagaatacagagccttcagcaaaagccacttttacttgtgaaacaccaaattatttagtacaatacctttacttcaatatctgttacatgccttgttgatcagcatcaaccaaagctgctatagttttgaagatgagttaaattcatagtaatattatatttgctacctcacttccaggtaatctccattttggcataaatttttttaaaatctgtttagatcacacgtaggcaatatgatacaaaattctcagtcttcgccccagttcacattgttctataataaacttttattaggtggaataagttggtaattagttactacgtaaaagcaaaagatcttattaagaattacatttctctgataaagagtgaaatttgttacatttcctttcaaaaaattattttgatagttgcttcaaataacacacaaatgtttgctcttaaagctaaaaccaatgtagaaaagttatttctgagagatcattaggaaggattgtagaatggtattaatggaaataacttctgactttagctctagctttatcttgttttgaattatgtctcaggaaaataaacttatctgtaccttggtttccttgatgtaaaatagaaataataatgcttatcctagatataaacaagaatgttttgaccatcaactgttagggtatagatttaagtgctttacattgagataaagttacttaggtttgaacagaaaaatgagtcatctgatattaacagctgatagatacttagttcttattttttaagacttggtcacaaattttacaacaggatatattaatgttggatagatatgtagtcccttttttggattttgtcacaaatttcagaaatggattttagttttaagtaactaataatgacttcaatagagatttatttttaacataggtggtagatgtttgctgtacattcagttattgagtagtgtcaaggctgacatgtctgtaattttcttgacatttcccttgtggttcccaagtggttactattatctgcatttgaggcaggtaaaacggggaaagggtcagcactggcctcaactagacctgataccaggaaagcaaaagtgtcacagattttgtcttaagtcttaatcattcctaatagcaagagctactggaaaacagagaaacaggattgtcacaattgtcttaatctatatccattgcctagggctgggtgtgttgttcccccaaacaaaatcagagtttggttagctgggaaaagggggaaaataggtatcaattggacaattaaaaggatctgggagagatttaattttttccatcaattagaatgttttcctctacaaataattaaaaaaaaattaaaagagcttaaacatgacattttgggctaggtgatttttatttttttaaaaaaaagtttgaacaataaagagcatgtagtaacacacaggaagtctgtatataaggggactgtagttggttatgtggctcatcaagacccaagttctttgtcttttcaactgtgacatctctaaatgtcaggttagccacagtgtcacagtgtggctgctgagagactagacatcacatgcagatgaggtaagcttgagttgacaatgctcagttaaagaagagggaaatctgtttgtgtctctttttaattgataaatctttccccattcactcacttcctctccccaacagacttccttctaatcttagtggccaaaattcattatatgctcttgtgttaaatcactggcaaggggaatggaactaaaattgttggattagaccaacgattatctctgctgagagtagagggctgcgcttccctgaatcacgtggaggaggggcagacccttaatgtgtgtgtacatgtgcacatgcctgttgccagcaagggaaggaggagaagaataagagtatctgttgctgggtaccacatttgttgacctgacatcatacatatgctaaaatgctcatgttgctatgaaattttcagttccttttcaaagggttctataccccagagttgcatccatttagtacatgcagctactaatccaggacttctggctggtgggaagccctctccttcgggtccaggtgcctcttcatggtccagcagtgtgtggctaaaagcaattatcagtgcacagtatatccagtatccagtgataaagatgaagtgggataagtactatataaaacttccattcagaggaagaaaaattggaaacaacctcagtattcactgctccatagcatgtagattaatgatgcttaacctgtttgtcagcctccagttttattttctgggaggatttgccttgtctctggtgttccttggctagtgtttctgtcttcatggtcacatctgagctggaattagtggaggatgatctttgtggagactgaacagctttagcggcctgctttctgttagtatggaggtctgattactggaaattgtcctatggattgaaaactcacagcctgactgagtcagcctgggatatctttggaagtacagttcctgtaaagttgtagtggtcctacattctgtttgctctgatctctttggtttcactccattaaacacagttaaatatcttgtcttgatgtgtgttctgagaatttctgacctagccactggcctctgctttgcctgttctcctggcctttggtttagtgacctccgctctgaggcactctgctcctttcccatgctagaaaatgacctgctttatttggtattgtagcacttacctatgaataaatattaaaatagtaccaaatgtcagtatttattcatctttattgtctttctccgtcgaagactgtaagctttaatagatatgggactgtgttttgtttactcttctagtcacccagggcttaaaacagtggctaccaccgtgtactcactcagtacattttggtttaatggatgaatacagttaaagtgaaaaaagcaagttgcaaagctgctttcttagccatatatttttacactgaccaacccagtaacaacaagcacctgtaacaacccagttgtagtatctgattgtcttttttcactaaggatctagaactccttggagaaatcactgagttcaagttcggcagggaaagagcaaggtgatcttggtattttggccagaaagcaaggaaaagttcaaaggattcagtgaccagtttgaattgaatactaattgtagtggattcaaacaaatcaaatatgtttaaatccacgtgtttgtaataacacttaagaaaaaaactagttagggctgagggctgtgacttacacctgtacatgccaacacttgggaggccaaggcaggaggatcacttgagcctcaagagtttgagaacatccacggctaaactgagagtccctttaaaaaaaaaatagtttgagaccagcctgggcaacatagagctggtctctacaaaaaaaaaattttaattagctgagtgtggtgatgtgtgcctgtattcctggctgaggtgggcgggagaatcacttgagcccgggagcttgaggctgcagtgaaccaatgatgacgccactgcactctagtctgggcagcagagcaagactctgtctcaaaaaaagaaaacaaaactagttggttactgttaaaagatgctaatgaagtcattaattttgaaaactggtaaatagagggagaaatcaaacattaatcttgcctttctaacatgaactgtgccacctgtatccaattagtaggtgagggaaagcatctcatagatgtattccaagtcataaaaaagagaaatgataggattagatacattattttatactatgccgattgaattagtgaatctagaccttaaaaacagagataagcaggcatttggttccctcctgcccacaacatacagagcagctgcatttcagcgctcaatagacacatgtgacttgtggctaccatattggacagcacagctctcgagctaattaccatttacaaaatccatagagaacaagaggacatgttaaatgatgccaggaggatgtgatcagaaattccagactgtggtaaatactatactagtaaataccggacaagttacccaatgtctacaagtaaatctcaaggacaggaagaggcagaagaaactggtagattaagagacttggagacaaccagcttatttggatcctgattcaaggaaactactaaagtaatttgtaatatttatgatacaattggaaattagaaagcaatttataacatttataatataattggaaatttgaacattgccttgatgtttgatgatattggtaaggataaggaattactattaatttttttaggtgtgataactgtgttttttttttaagttcttttagagatacacattgaaatatttacagataaatggacatatctggtattagcttcataattatatgaaagggggagggagtgaaacaagaagggccatgaattcatcattataaaagctgggctgtatgggtatgtgtgggttcattgtacagttttctctacttttataaaaggtttctggccaggtgcagtggctcaggagttcgagaccagcctggccaacatggtgaaaccctgtctctactaaaaatacgaaaattagccgggcatggtggcatgtgcctgtagtcacagctactcgggaggctgaggtgggaggatcgcttgaaccagggaggtggaggttgcagtgagccgagattgggccactgaactccagcctgggcaacagagtgagaccctgtctcaaaaaaataaaaagttttctggaagaatacttcatttcaaacatatatatgtaaatgaatagaaaaaggacaagaagcatatacatcaaacggataatggtggttatgtttaaggagtgggaaggggattagatgggcccaaagaggactttttggtttacttgtggggctcaatttttttttggatgctatgagaatatattgttgttttatttgagtattttaaaaactacttttaggaaaaaaaaaaaaaaagacccaacacggtggctcatgtcatgtctataatcccagcacattgggaggctgagacgggcggatcacctgaggtcaggagttcgagaccagcctggccaacatggagaaaccccgtctctactaaaaatacaaaaaattagccaggtgtggtggcacatgcctgtaatcccagctactcgggaggctgaggcaggagaatcgcttgaacctgggaggcggaggttgccgtgagctgtcatgccactgtactccagcctgggcaacaggagcgaaaacgccatctcaaaaaacaaacaaaaaaaccatcaaaaactacttataggaaaaatacttatttcaagcatatgtctaagtagagagaataatataatgaaactccatgaacttgtcactcagttttgacagtatcaactgatgaccaaggctgtttcctctctacccccatgcacttctccctcacccacgtcacccttggattatcgtgggtaattttgaaataatatttcagttaagtataagacaccttggctgggcacgttagctcatgcctgtaatcacagcattttgggaggctgaggcaggcagatcacttgaggtcaggagttcaagaccagcctgccagcactttgggaggccgaggtgggcggatcatgaggtcaggagatagagaccatcctggctaacacggtgaaaccccgtctctactacaaatacaaaaaattagccgggcgtggtggcgggcgcctgtagtcccagctactcaggaggctgaggcaggagaatggtgtgaacccgggaggcggagcttgtagtgagccgagatcacgccactgcactctagcctgggcgacagagcgagactccgtctcaaaaaaaaaaaaaaaaaaaaagaccagcctggccaacatggtgaaacaccgtctctactaaaaatacaaaaattagccgggcgtggtggcaggcgcctgtatcccagctacttgggaggctgaggcaggataactgcttcaacccaggaggcagaggttgcagcgagtggagatcgtgccattgtactccagcctgggcaacagagtgagactccatttcaaaacaaaaaaaacaaaaagcaaaattcctcaaaggccacatactgtgatcataatgcaataaaaggagttcaacagtgtaaactttgtttgagcgtatgactttttttttttttttctatttgagacgagtcttgctctgtggcccaggctggagtgcagtggcacaatctcagctcactgcaacctccatctcctgggttcaagcgattctcctgcctcagcctgctgagtagctgggataacaggtagacaccaccacactcggctaatttttgtatttttagtagggtttcgccatgttggccaggctggtttgaactcctgagctcaggtgatccacccacctcggcctcccaaggtgctggggttacaggcctgaaccaccattccctgccagcctgctgggttcttaagcgatccttccgcctcagccacccaagtacctggaactacaggtgtgctccaccacacgcagctaattttttaaattttttgtagagaccaggtctcagcatgtttcccaggctggtcttgaactcctgagctcaagcatcctaccttcctggacctccgtaagtgctaggattacaggcatgagccaccatgcctggcaaacacatgatttttttttttttttttttttttttttttgagatggagtctcactctgttgaccaggctggagtgcattggcgtgatcttgtctcactacatcctccacctccctggttcaagtgattcctttgtctcagcctcctgagtagctggattacaggctcacagcaccatgcccagctaatttgttgtatttttagtagagacaagagtttcaccatgttggccagactggtctcaaactcctgacctcaggcagtccacccgcctcggcctcccaaggtgctgggactacaggcgtgagccaccgcgcctggccaagcatatgatttttaatgcaataactatattcatgtttctagaagcttttttttgccattcagtgacattatggatgacactgcatgtcagtatgtgtcggacatgtgtcagcatgtgtcggaatgtatcaacccatttttgataatgggttcagaaccaagtttgattaatgttaactgatttatgcagtttttatgttcaactgaaatacatctaactataattttttattggccttccaaaagtgtcataaaataagcctaatcattcacatatcctatcagatgtgaaaagcccatttctatgctttctggccctgccgcaaaatcttttcttttcttctccctttgattttcctcctagaccaacgtagtatgacagaactttgtttggtgatggaaatttctatatcagtaatttgcaaactatagcccacaaactaaatccagcgcattgctgcattttgtgctgctcatgagtgaagaatggtgtttttgcatttttaagtgattgaagaaaaatcaagggaatatttaatgacacatgaaaattatatggaattcaaattttattatccataagtaattttattggaacacactcatgttcatttttttacatgttgtctggctgattttgcattgtgtcggcagaattgaatagttgtgacagagaccttggggcccacaaaaccaatacctgttttctatatctctgctgtcttgtgtgatagctactagccaaatgtggcttttgagcacttgagttgtgactagtgtgggtgagaaactgatttttaattttacttcattttaattcgtctacattttaagtcacatgtggctagtggctaccatatgggacagcacagttgtagacatgccaccttttccctagttcttgcttccttgtacttgactttccttctgctgatgtcttcctggtttctatttaattaatgatgcagactgttgttgcagaattcattaggctaccattgctgattatctcatatgtatagtgcatcagtagcccattggtctcaccaaccgtttgccatctgagttctgttgtagacattctatcttaaggttgcggcagagggcatttatttgctgtagaaaaaggaagccaataaattattgggaaaatatgaaaaattacttagccaggaataaaaatctagtaaaatcattgatgccaaaaattgctgttgatgacaaggacctgtaaatgtgcctgtgtatggtcatgtgtctcttgtaactgtttgtctctttgtatgtatatgttttcattttttcctgagatgttatacttaaacatgtaagctattaaatattttgtgtgtgtttgttttgaaatataacctatacccccagtccaccccagggctcgtagtttattctttgtaaatacacgggacttgtgggtggcgagagattgacatgttcagaactgacagaaggccatgtgccaagtaaagtgatgatggtgaggcctgcaggacccagatcctgttgggccctgggagcacacagtggaggttggattttattctgagtgcattgtggagccattgattggttttatataggagtgacagatttgtgtttataaaatgtctctggctgctctgtggaaaatggattgcagggaccaagagcagaagcagagggaacagttggagacttcttaccttagtagaggcatgatgtgatgggccttggtgacaacagcggagttggagaaaaatgaaaacaattgacatacattttggaggttgagccaaaagactttggtaagaccaggtttgaggcaaatcaagagttcatttaagacaagtcagtcaggagatgtctaagcaggtcatggctagagggggtacatccaggaaccatcaacagagtgggcgctgtcccctagggagagcacagagaggctctttcctgttacttttctttgtattcaatatctgcttggtgaaatcttgcaagtttttaagatgtagcttagatttcattacttttgacacctaagatcagtttgagtttgacacctaggatgagccttttcctttgtttacatgtaaacacctccgtattttgtcactttttttttttttttttttgagatggattttcgctcttgtcgcccaggctgaagtgcaatggcttgatctctgttcactgcaacctccacctcccaggtcaagtgattgtcctgcctcagccacctgaatactgggattacaggcgccttgccaccacgcccagctaattttttaatatttttagtagagacggggtttcaccatgttgaccaggctggtcttgaactcctgacctcaggtgatgtgcccactttggcctcccaaagtgctgggattacaggcgtgagccaccgcgcctggcctttgtattttgtcacttttcacattgtatttatttgcttttgtgcttattccccctctgctttccaccaagtttctcaaggccacatatgtggttttgatgccacatctttgcgtttctagcatttaataccttgcctgcacataatagacccctactaagtattctgttgaatatttggcaataacataagctccagatacaactactgtaattgagttttttgtctcatgaattcaaatagtattctaggaagtttcatataactttgagttttttcatgtatcagtgatcttttagtgttctgatctttgttattagtaacatcttcatttgtatactattttacatgtagttaagcactttagtaaatattcatttgatctacctataacctcttgatttgaattaggcaggaattattatccccattttctatagatagctgaggttcagagagtaacttatctgtgcccgtaactgcgacttgaacccttcacttcttgctgttatctcaagtgatatttctgccacactaaactgctttttctgtgtcactagatttttgaaaaatcagttgctgtgatatattatatactgtttgttttccagagctgaattgatacgtgtcttctgttaatgtaataggattttaaagctggtcaggttccctcacctgtcctctagtcctgtagccttatagagtaaatgaagcctggaaaggtgacatggcttgcccaagaccatccagctaggtaaagcggggtaggcccatggcaaaacagaatcccagtctcctcatttcctgctcagtggatttcttcccttcctgtacctcctgcttcccccaccccatcttttacagttgatgtttctaacataaaggaggtctttccgctttgtagcaatcagatccaacggaagccttgacattatattacggaatttatttctgaaaggagagtggtgtggggggcgcggggatgagtaatatatgtatgtacacaaacttccagctttttttttttttttttaagtgttttctctcctggccgggcacggtggctcatgcctgtaatcccagcactttgggagactgaggcaagtggatcacttgaggtcaggagtttgagaccagcctggccaacatggtgaaaccctgtctctaccaacaaaatacaaaaaaattagctaggcgttgtgtggggtgcctgtaatcccagctactcgggagtctgaggcaggagaattgcttgaacctgggaggcggaggttgcagtgagtcgagattgcaccagtgcactccagcttgggtgacagagtgagactctatctcaaataaaaatgttctctatactcattcagtagcaaattcttttactaaatattcggtataagaaagtgaaggttattggccaggcatagtggctcacggctatattcccagcacttcgggaggctgaggcgggaggatcgcttgagcccaggagttcaagaccaacctgagcagtatagggagaccttgtccctacaaagaatttaaaaattagccgggcatggtggcatgtgcccttggtcccagctactccagaggctgaggtgggaggatcacttgagcctgggaggttgaggctgcagtgagctctgatcacatcactgtactccagcctgggcaatagcgtgagaccatgtctcaaaaaaaaaaaaaaaaaaagtgaaaattattgaaactgaaggcatgtaatcatcaaaacactatttagcagcactttttctgttacctgtgtgtgcatatgtgatattttttgtcttttcagtagtttatctcatcagtatggtaaatgtaaaatcaagtctgtgttgtgtcttgaaccacttatttaacattcataatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactctagtgtaagaacatagttctatttctgtgagctaactgctgcccttctataaccttcagtttctgccagcatcgtctgcattcaaaccaatgacctcgaggtgaaaatctccagataacatgattggtccccatgctctcatgatttccttacttaagcaattaaaggccaaagcaagatgcttagtaactccttttccacatagaggcacaaataaaggaaagctggtcacaagttttgaaccaaagagttaaaagaagaatcataacttgtctctatttaatgattggaaactctcacagacttctgtgaagtctctcccccttttgtacctttcttacaagtgatgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagagttaggagaatagagttgcatttagtgctattttaagaattattaaacttgtctgcggtttttttttcattcatatatagtatctttccagaaagccaaaaagccttttgttttgtatattagaacattattccattaaatgattgataggtgagttactatattagaattatgttataatgcagcttttaaaataagatcaaagggatctagtatttaacatctgagtttttaatgatcttttaatcttaaatttattgatgctcattttagaaaacttagaggttaccaaaaaagaaatcagaaaactcactgacaacctcctacttctttttaatttaaaaaaaaattttttttttaactatagacaggatcttgctatgttgcccaggctggtctcaaactcctgggctcaagcagtccttccacctcagcctcccaaagtgctgggattactagggtgagctgccacacctggcctcctacttcttaattagttgaaatattttgcagatatatataaatcatattgtgttaattaattttatgcttttttcttacctgtgaatttaccaatccaaatctgatttataaaatgattttaatttttctagtgtatttcgtgttagctgcacaacatgtttatatatgatcatgtaattctagtccatatttgttggaaacattgacatattgacttaataagaccaaaaaaaattgcctgaacaactcaacctcatcagtcaattaattgtctccttgttatagaggcaataatgaatgtcatgttttatacttttaataattgtatgttccctgaatggaccagatagaaagcatgaaactttacacgtaaactcttgaacctgcatgacggtcatcgtgtcttaggtttgctgcttgtcccctggtggtggtgggctctgcgtggctgactgtgactagttgttcatttttaccttggtgagagtttgccagcagggaactgctctctgctatgtcaccaaataatgttttgctaaacttcttgtctgtagtacctgcctgatgtaatgggctgtctgttagtagcttagtaacccagagtaaaactgaatcatccattttaacagaattctgccccacacttaacattttctcctaacagaaaaccaagaattctgcaaaattcttctaagtagaagcagcacaattcctgatattaacaataaataggagtacagaaaaagcttttagaaatttctcccatacctgttaaagtctatatgaatatattaaggggaaactccaggatgctaacactaaaataagaatttcattatatatgtatgtaaatttattgaaaatttattcaaaagtcctctccctgttttcccatcatattcagtaaaaggtgccttttagtccccttttttttggtcattaagcctatttgtatgtttcagagaaaagtttgtttttatctattatcatatacaatatggaagtactgaaaaaatgggtaaaaagagacaaagttattttaaagtatgttttcaaaacatgacataaaattttataaatcagctttctgtgatcacatgactgattagcaaagagaagtcacataactcctatgtggaggacttgtttaattgaaatccttttcttcttgacaaagggttgtcactggccttttagatcttggctcagacataactttcatttgtcttaaaacctctggcgttgccaataaatcacgtgtgaatgcaattctaagtcacaaaacaaagtattaaaggccatctgtacctgttcacattcagactcaaatttcgttagtactttctatgtgaatttatgttttgttttgttttgtttttttctgttttagaactaatggacattgctttgccatcatagaagaagatgaccagggagaaaccacattagcttcagggtgtatgaaatatgaaggatctgattttcagtgcaaagtaagatataatttgggacccatgagacaaagaagggaggggccatatgaaagcatcgatttcccccaggagaaacatgcctggtgtacacatcgctgtatgttcacatcagtaaatatattggaggaatacctactgtctagattctgtcctgtattcatatgtagaatttataactaaatcatttctgaaaagctaattgtttgattacaatttccttttttatttccatagacagcacctggctctgttgcccaggctggagtgcagtgctgcgatctccgctcactgcaacctcaagccagcctcctgcctcagccttctgaatagctgagactacaggtgcatgccactatacctggctaatttttgtattttttgtagagacaaggttttaccatgttgcccaggctggtctcaaactcctgggctcaagcagtctgcccgcatcggcccgcaaagtgctgggattacaggtgtgagccactgtgcccagcctgattacagttttctttgttctctacttgggaggctgaggcagaagaattgcttgagccggggaggccaaggttgcagttagccgagatcgttccacggtactgcagcctgggccacagagcaagaccctgtctcaaaaaaaaaaaaaaaaaaattcttttttctttttttaaattttaaccgtctttggctactgattacaattttcaatgagaaaaagtttctaaactttcttatcacaataattgcagctaacgtttctttaaaaataaaaattttattcaagtaatatgattatggtaatttaagttccaggttattttaccttaaaaaaagttttaaatcatcctaggttgtcatgactgcaaaaaaattatattgtcacacttatttgtagattataaaatttactgagaagacttttaagatagtggcagtaacctttgtatcactctgagacaacttagaaatgttaaagatatactgcaaactctagggtaaccactaaagttgaaaaaaaaatgttaaggccttgtaaggaggtgtcagtggagctctttaaaagcagcagcaaaggaatcaggatggtaatagtttatgagcatcctgatggctctgggttataaacctgatctcttcaaaattctgcatagtgattttgtcccaggagatccttccagtgtttctgaaaaccagctccagatagaattgtttgtgcataatttaagtctcagctatgttagaaaattgttcctattatttggaaattctcaggatggaggccgggcgcggtggctcacgcctgtaatcccagcactttgggaagccgaggcgggtggatcacgaggtctggagatcaagaccatccggctaacatggtgaaactccgtctctactaaaaatacaaaaaattagctggacgtggtggcgggtgcctgtcgtcccagctactcgggaggctgaggcaggagaatggcatgaacccgggaggtggagcttgcagtgagctgagatcgcaccactgcactccagcctgggcaacagagcgagactctgtctcaaaaaaaaaaaagaaaagaaattctcaggatggatagaaaccttaaaggttatgtttcaacctctcagctaatgtttggaatcacccttgttgcaaatgactgcaaatctatcttcctttctgactctttggaccatagagaacaaacctaatctctctttaagatgacagccctttactaagtaaaaaaagtgcttcatcctactagtctttgcccagtgaaaataattgtccataatgacctcaactgctccttatatgatcagctttagagttattcagtctccacttcctcagtgtaatatgcagaattgagtgtgatatgaccaaggaaaaaagtagagaataaatagccctgttccctttttctaaacatagtcttgtgttagatatttggcagtcatgccatattcttgaaccattgagccttctgtccgctgaagtccctatgctactcactcatgctgctgctaagccacatctcctccactcttcattggtgctgttggtttcttcacacaaataagtagatgggaatggaatgaggttttcctatacagttgttacatacttgtctttatgaattttatcgtataagcattaatcctttgctctaatttgttgggatttaaaggatgctaatttcgttgttccagttttaggctatttgcgtatttatcaagcacacatactatacattttttaatcacttaaaaaattgaagaaagagctatggttagggtactgagcccagcagtaataaccagtgttcaacaggcccctagtgtaggcctgtcctaagctgaattcaccattataagttagttgttaaacttgacaagctgttcaaatctatatactatatatgtgaaccttcggacaaggtgctctgctctcgttttctcatccatgaaggaattactatgaggatcaaatgagatacatgtaaatagtttagcacaattagcacatagtaagggcttaatagatgttagctttgaccatattgattctttaatagagcagtcttcatgctgttacccatatccctgggtacactcagactgtgttatacaagggtaacgggcacgttgatagttttaagggaatcagtttttggatcctaaacttcagtaggtcctgttgctgaatatttctctgcctgagaacagaacttctcaagcagttctctttcccttagtcacttttcatagtcaacccctcctagtttacaaatagaaggcctgaggtgtaaaacttcaaggttccaaacggtgttgtaattcgaagtaaaggcatcagtgtaggctatgtcgggatatcaaataagtgtttacatgacagatggttttcaattgtttgctttcaaccaagttgctggatcattgaaaataattttcgatgataggatctttatggcacttttagcatatgctttggaaggactttaaacaattatgggctgatcgtggtggcacggtggccccagcctgtaatcccagcactttgggaggccgaggcgagcagatcatctgaggtcaggacttagagaccagcctgatcaacatggcgacaccccgtctctactgataatacaaaacttagtcaggcgtggtggtgcgtgcctttaatcccagctacttgggaggctgagacaggagaattgcttgaacacaggaggtggaggttgcagtgagccaaaatcatgccattgcactccagcctaggcagcaagagtgaaactccatccaaaaaaaaaaaaattatgggacaatggtataatagtctccttccgtgatcatcatcttgcttatgtgaatacattgtcttgatgatgacaaaaggaaaaataagaataagattaatgatgaatcttctcactctagcagtaatttttattcatgaattcgtgaactgatttgtttcaaaagtcccatccatatcattaagaaatgcctggccaggtgcagtggctcatgcctgtaatcccagcacttttggaggccgaggcgggcagatcgcttgagctcacaagtttgagaccagcctgggcaacacggcagaaccccatctctacaaaaattagctgggcctggtggctcacgcctgtaattctagcactttgggaggccaaggcaggtggatcacctgaggtcaggagtttcagactagcctggccaacatggtgaaaccccgtctctactagaaatacaaaaattagccgggcgtggtggcacactcctgtaatcccagctacttgggaggctgaggcaggagaatcgtttgaacccaggagttggaggttgcagtgagccgagatagcaccactgcactctagcctgggtaacagagcgagactccgtctcaaaaaagaaaagaaaaaaaaaaaaaaaagctgaggtgggaggatgacttgagcctgggaggcagaggttgtagtgagctgagatcatgcaactccactctagtgtgcggagtgatagctagatcttctatcataaaaaaaaagaaaaagaaaaaatgccctttccaataacattttcttaagtttgtatttaatgaagattgtaacatatatattgttttgatcaattttatgctaataatgattatgataaactagaataattttctaagacttaaagacatacagttataggaaataaaagaatttttatgtacttatctttgatgtggacagttatatattactttaggacgtaattatcatgggagatattgaaaggaaataagagttcaaggagaaataagagttctagtgtaaaatttctcattgctaaaagaagcatttgttcatttattctttaaaatgatgataatgggtatcaaattgcaatgctatttagattctactgaatgcattaaaaaatgatgtaacacttctatttcaaaatgaggtaacaattctatgtcaaagtgtcattatgtacagtaagccagaaattattaatatattgcagccatttaaatttatggtgaaaatttttaagtgtcacctgaaaaatacgtgaaggatacgttgcttttaagaattgggttacgccagcaagcattttgaccagcacttatctaactttctgtatttcttggtaaacgtcacccaagcacagcactcacccaagcacagctctgtcatgctcatcctaaccctttccccagtgtcttcacgcactgccatgtgtggcacagaacagatgtgagtgcctctcaccaggcctcgcgttcttccactccccaggctgcattggtaaattgtgcttattctgtttcctcctataggacaaattatttttcagaaacctcactgccattccttgtaacttggcgtcagttccttcctcatatactgtctccagcctgagcacactgaataagtttatttaagtcagaatcacttaattcatcagtgccaagtaaatttgtttcccacaaaaattcatattccccacataagtctagaaatacaaaattgacttgggcagagggtacgggtggagagtgcaggaaaaggaaaggctgtgtcacccaaattcataatctcgacaaacccaatttttgcctacccagatacatagttaacctgagtaagacagacgtgagatgaggcaggtgttgcttattcttagtgaagccacaatgggtctttagggacttagaagttttttggcttagtctagaatctcatctgggattcatgtcaagcaagaggaagggaagttaatttattgaatatttgttatatgtgtatagtatcctggggattcagtatattctaccttgtttccccccaactactctatagagcagatttttttaaagacagggtattgctccatcacccaggctggagtgcagtggtgcaatcacagctcactgcagcctcaacctcctgggttcaagtgatcctcccacctcagcctcctgagtagctgggaccacaggcgtgtaccaccacacctggctgatttaaaaatttttttagagatggggtctcactattttgcccagcctgatctcagactcctccgctcaagccattctgccacttcagcttcccaaagtgctaggattacaggtgtgagccactgttcccagttcatctttttttaacctgtattttttagcacactaaagcctagagataaattacttgctcaagttcacaaagtgaacaactggcaaagctaggattcagactgtttgattccaaaacccttgtattttctgtaatactatgctccttaatctgttggcagagtctatttttggcttctttttaaaaattattatttttagagatagggtctcactacattgctcaggctggacttgaactcctaggttcaagtgatcctcatgcctcagcctcccaagtagccaccacacccagtttaaagtctactttctttcccttttaaagaaaagggacgtatataacacatatatatataacatatatataaacatatatacatgtttatatgaaatgtttatataaaaatataacattccattatctattgtagtttccaacactccatctttctaaagtctttaaattacacctgtctttcagccatctctcttacaagggctttcatcttcctgggatataattcacctaggttagaatataggaactcataaggaatacaaacgcatcgtaagatctcttcgtacatttgggatgtcgtttcccacttagtagtgtttgagctaccttcgtcatccctgtcagcatccttcatagagaagaaaaaacaagacaggagttgaagaattgttcgtttttctccttatcatccactgtcatgtcagcagtacatctgttgcttggagaaaccccatgctgccaaagaaaccctttcttggtttttctttgcacttttctcttctgcaaggccaagctcattttagctttcctggaaccgtttttggatgcttgacacttctttcattcatcgttagttatatgattttcatttcctcctccatgtgttttctctgaatctgggattatttcagactctccagtttaaccctaacttttttctctctctccttatgatcatttaaaagtaaaaattgtttaaaagttattaataaaacttcatttaaaatataaaatatgtatttggacatttccaaatgctcttgaccatcttcccaacagaatctgaagtcacaggctcatgtttacctttttaaagtcatagctgattatactgaggcttttccttaatttccgcttacattcttgttacttgtgtagtgacaaacagttctttgctattcacatgttggtcagaatggcagttctccccaggctgcagcattcaacttgtcagatattgtgttgttaatccaataaaacatcacatgcaagtgctgctgcgcttccagtgactgtgtccttctctgtgctagctttctgctctcttagggacagtctccttgctggctggtggtctgtaatcagctctcaagaatgctttctgtagtttgtccttccctcaccatggatgctcaacttgcctctgcatcaggctcatgacttccgacgtggctggggtaggcagggtctgcagcgcctctgcacgctcagctgccttgctaaccagccttttctttggactacgacaccctccactttttagtctgatcttaaatctcatccacatctcagtaccacagtgagattatatgtaccagaccagtttatgattgtaattacctaagttcgggtttggtgttctaatctagtgtctaacacaccatccacatagatatgttcttaagaaaagccattttgcagtcttcactatttcagcacaaattttaatctttcaataatctgtttttacatataaaatttgcaggcccctttcactcactgaaatagaaattgtattttatgaatactaaaaagacatatcagtttaaaataccaaaccatttctaattttatcattactcttcttttaggattctccaaaagcccagctacgccggacaatagaatgttgtcggaccaatttatgtaaccagtatttgcaacccacactgccccctgttgtcataggtaggttagccgagaaaagtcggagcatgcttctcaaatatcttctctggttttacagtaaccaggctacctagaattgaacacgtcagattattttttcatttcaattgtttacattgtttacttttattgtcaggtccgttttttgatggcagcattcgatggctggttttgctcatttctatggctgtctgcataattgctatgatcatcttctccagctgcttttgttacaagtaagaagatatttattttgaagcaaaatattttgtcaaatattagatgtcaaccgctgtttgtaaagccagttgcagaaaccattaacttgtattctctggttgtatatctcctttatgtaactagactatagttctcttaagggaaaaggaccttactaccaattaattaattgggcacaatttcatacttcttgtatgttcatgattacttatgattttcttattaatggaatagtgagctttctggcatctgaatgttttcgatctgtcccaagaaacccactgtgttataattcttttttttttttttgcgttataattctttagaaatttggagctccagaattgtttgcatgtagccatgatttcagaagacagttgccaaaaaagaagagtaataagagacagtccctaatggatataaactttaataataaaacatcataccaacctagatacattaatgaaacaagttagtaaacccataaataaacaaacccaagtacatacagcaatttagcatataataaaggaaacacttcagattactgaggaaaagacgttcgcatacctccttgtttttattataattcctcaccctcaacaatggggtaccacagttgagaaatcgtgttttgggtctttctagataatagacttggaatcttctgttagggaggtgatgcgaaagtcatatgattattcagagtaggagatggggtcgagaggagagctccacatctgaggtagccatcatcccaaatggcccccagtgattctcactgcctggggttcctccccttggggccagtcccctcccataacacatcagggctgatctgtgtgacaaataggatatggcaaaagtgacttccaagtctacgttataaacagctttgcagctttcaccatggtctctgggatcactcactctgggggaagccaggcatcatgctatgtggacactcaactctgagagaggcccacacagggaggaactgaggcctcttgccaatacccagcctgcagcctgtcggccttggaagtgagccaccttggaagtgactgcaagctcctgtcaagctttcacatgagtgcagtctcagctgacatctgaccctgagctacccaatcaagtcactcctgaatgcatgatccacagaaacagtgagataacaattgctgttttaagccactcagtttgggagtgatttgctaacacagtattggataatccagtgtccgactttctgaaaattgactttcaagcagtcttcttggtgttattgtcaccctcaactttacttccagacataaccacaatggccagttccgaagttcttgggggaactccatagtataaactggttgcttcttggttttctcaatttctaacctaagaatcagactttttgggtgtgcaaagtcactgctcattcatctgcttcatgaattccaacagtgtttactgttattttatctccttttctccttgcctgttagataaagaagtttaaaactctttattgctgttttagtggactagtaaaagcaagcaagtatgctcaatcggttattttaagctcaaagtccctttgtcaaataactgaatctttgccagtaagacaggtgataatatctcaaggtgattttaatttatattttcatattaaaatactttttttatacattggtttctttattacacaagggcactgtaatgtatatattattttatttatttatttatttagaaatagagtctcactctgtctcccaggtggagtgcagtgatctcggctcactgcaatctctgcctcccaggttcaagcgatactcatgcctcagccttgcaagtaactgggattacaggtatgcactgccacacctggctaatttttgtatttttagtaaagacgggggtttcaccatgttgaccaggctggtctcaaactcctgacctcaagtgatccacccacctcgccctcccaaattgctggaattacaggcgtgagccaccgcacctggcctctaatgtgtatagtaaaatattgttgagtatgcttttatttttcttttaagaaaagaaccatctatatttttatttaaatcatgtattcattttggggggcctgtttttccattgaattgcatagatttttttctctttgatttatagaagctctttatatttcagaaatcagccctttgtaatatgagctacctatacttttctttttttgtttttttttcatgctgcgttacctcagagctacctacacttttcactgtggtgtgtcttgagactgcctgcagtgccttcagccacatagtaaagaaccctatcagccaggtgtgtgctctctaagcaatgggtaggatgtttcttaaggaaatctgttcagcccaagagataaaacctaaaaatactgctgttagggcccagtgaaatggtccaggcagattatcttacagtgaagcttgtaatcagtaaaccctacccatatactaacagcttgccaatcaaggtgtcaggctgtgaaggatactgatctctgagaaaccagaaacaagtgaggtgagccttgtgattgcccaccttcttctccctgaacagagtttcgggttgggcatcacagggggaacccaggtgtagccagtagcctgtctcagttcgaagagttgtgaggaagctaccaagcctagggaaagagcacctgaaatgattgagaaaacagtgtttggtgctcacacaaggctgggagtaggatctgttcacaccagctgtgagagttgaaaaccccataattcataggttttggttgaaggactcaggaggattttgcctcagtggtggggaataattagccctagactaaacatggctctggtctcaccctaaaagcaagccccaaacagatcacaccatttctaagtcactgtatcctagaacaaactcaacagtatttataggaatataaaaatatctggcatccaacaaggtaaaattcacaatatctgccatccaataaatgaatactatgaataaatgaatacatatataaatatggtccataatgagggaagaaatgaagcaatcaaaaccactgacccagaactgatatagaccttagaattagcaattacattaaaatagttattataactgtattttttatgtacaaaagttaaatcaagacatggcagattttgtaaaagaccaaaatgaaactttaggaaatgaaatctataatatctcagatgaaataatatactagatgaaattagtgacagactgtagaagaaaagatgagtgaacatgaagacataggaatgaatagagaatagtgagctgtgggacaacttcagatggcctaatatagatataattggagttcccagaagagaggagggacgaaaaacatacagaaataatgatcaaatgttttcaaatttatctattattattatttttatttatttatttatttatttattttgagacagagtctcgctctgtcgcccaggctggagtgcagtggcacgatctccgctcaatgcaagctccacctcccgggtttacgccattctcttgcttcagccttccgagtagctgggactacaggcacctgccaccatgcctaagtttttgtatttttagtagagacggggtttcatcgtgttagccagatggtctcgatctcctgacctcatgatccgcccgccttggcctcccaaagtgctgggattacaggcatgagccaccgtgcccggcctattatttttatttttgagacaaggtcttgctctgtcacccaggctggagtgcagtggtgcaatctcagctctctgcatactccacctgctgggttcaagcgattctcgtgcttcagcttcccaagtagctgggattacaggcgtgtaccaccaagcctggctaatttttgtatttttagtagagatggggtttcaccatgttggccaggctggtctcgaactcctggcctcaagtgatccacctgcctcggcttcccaaagtgttgggactataggcgtgagccactgcactcagctttttcaaatttaatgaaaaccatgaatccagatatctgaaagctcagcaaaccctgagtataagaaacatgaagaaaactacattaaggcacatgataattgtattgctcaaaaccgataataaagaaatgttaaatgaaacaagaaggaaaaaaggcagagtatctacagaggcacaaagttaaggatgacagcagaccttctgttggaaacagtgcagtcaagaagatagcgaaccaacatctttaaagtgcccaaagaaaaacatcacagactttgaattctatagccagagaaaatatccttcaaaaatgaaggtaatgtgaagatttccagtcatacagaaaacttgaaagaaccccgcccccttagacctacccaacaagaaatgtgaagggaagttcttcgggtggaaagacaggccaggtgaagataagaatccacataaaagaatgaagatccggaaatggggatctaagtgaccctggcacaaactaacaatatcttttaagatgaacaaaaaagactactcatctgagactcaggccatggacactcaagtgagtgacctataacacttcacagaacatacaatcagacatcaggaactggtcatgtaggcttttttatagttctaaactaaatactacatagaactttgtgactgccctgtttatttagctttagaacttcatgtgctagttcagtctgtgaagattcattattgatcagatatatacaatctgtaatttggaatattcattcatatttagttgaactttaacaagtcacaagttgttctccatagcaaaccgtaaaagaataaaattaaagttaaagagaggtctgtccgtcagcatattaaggtttgtctgttttgtttgcctcattaatattttgtttcccttttttctgatgtgatcgttttcctccaatttagatacgtctgcaatttattcttcagtctcatttacattcatgacccatgatcctcaaaacctataccttctctaaaaccttatctggaaccatggcctccctccactgtggacgaggcatcattctgtaccatacgccagttcctggttgtttcctctggcatcttcttttgtagctcctttaatccttcagactgcttagatcctatgatctgcccccataacacttactaattttatcttgcatttttttacattggcaagtattcgtttacttactcatgcatatttgccaaaagtctgcatttccattcaacaggaatctcattggtaacagagattacttaaccattaatattgatgatcaactggctggctgtttaaattgccactttcctattgaattttgaagggtgcccatggtgaatcttgtgtgtccctcatgcttggcacacagtggatacttactcactcttgttgatgtttgccagccaccttggcccagaatttctgcttgggaaatagtatcacggatgcatttgtcagatgaaaagcctgcttctggctttataatggaccctttatcctcattgtctttaggggactcctggtcctagagtagttaaatagtaagaattgaatgatttttttaagttgcagtgattacagcaaaaaaaaaaaaattgccaagtaatgttttatttaataagaaagaaacattttctgaatacctaaaaaagaagctgccaatcagcttttaaagtgattaaaaataagaaaaaatgccctatatgtacacatatttttatcactttcagcactctccatgtatttaattccaagttttaggtccaagttttcatttgataccatattccttctgcctgaagaatttctttaacctcttggagtgcaggtctgctggctgtaagtcctctcagcttttgtctgcagtcttttgacttcattttcccaaggtattttcactggctatagaattctggatgggctcaagtttgtttcccttaaagctgtcactcattatcttccacttgcatgccttctgacatacattttatctttgatgtattatatgtaatttttttcatggcatcctttaatgttttccctttatcttttaaacagctacaatacatttagaagcgtgtgtgtgtgtttcttttttggtatttactctgctttgggtttcactgagcttagtgaatctatggtttgctatctttcattattattgcaaaattatctactattttttttaaaacactttgtccttttggctgggcgcggtggctcacgcctgtaatcccagcactttgggaggccgaggcgggcggatcacgaggccaggagatcgagaccatactggctaacatggtgaaactccgtctctaccaaaaatacaaaaaaagaaattagccaggcgtggtggcgggcgcctgtagtcccagctactcgggaggctgaggcaggaggatggcgtgaatccgggaggcggagcttgcagtgagccgacatcgcgccactgcactccagcctgggcgacagagtgagactccgtctcaaaaaaaaaaaaaaaaaaaaacactttgtccttttatctgtctcttctgtttttgagactccaattatacatattttagattatttggtgttgtgccacagctctttaattcttcagtttttctcacttgttttttctctttgtattttagttcaggtaacttctatttacctattttcaaatgcacagatttttttttttcttcacctgtgtccatctgagctgtgtattgttgagctcatcaaacattcttcatctttaatagcatgttttccctttctcacattcctgtctgacttcatttttctgctgagactctccatctgtgtattctgttaccaccttcaccagttgccttccccttttaatcacagttctgtgaaaggccctcctgacagcttcagcacaagtgctgtctgacacttggcctcttgattgcctgccctcttggcagtgagtgattattccttgctttttaatgggtctcataagtttatttggatgttgtacatcatgttaagaatagcagagattgtcacaatgagatatcaacctcaccccaattaaaatggccattatcaaaaagaaaacaaatgctggggagggtatggagaaaggggaaccctagcacactgctggtggaaatgtaaattggcacagctactatggagaacagtgtggaggtccctcaaaaaactaaaatcagaactaccatatgatcttgcaatcccactatttggtatatatccaaaaggaaatcagtatattgaaggcctgttcattcccctgtgtttaagcactattcataatggccaagatgtggaatcaaccgtgtccatcagcaggtgaatggataaagaaaatgtggtccatacagtggaatattactcaaccagaaaattaatgaaatcctgttattttcagcaacgtgaatggaactggagttcattaatgttaagtgaaataagccagtcatagacaaatattacatgttctcaatcatacgtgggagctaaaaaggttgatttcatagaggtggtaagtagaataacataccagaggttagaaaggagggagggaggttggatgaagatggatggatgaagagaggttgattaaggggcacaaaaatacaattactaatagaaggaataagttctagtatttgatagtacagtagggaaattatagttagtaatttattgtgtatttcaaagtagctagtctttaagagaagaattgtaatattcccaacacaaagatacagcctgggcaacatggtgaaaccacatctctacaaaaaaatacaaaaattagctgggcatggtggtgcacatctgtggtcccagctgctggggaggctgaggtgggaggattgcttgagcccaggaggcggaggttgcagtgagccaagatcatgccactgcactctagcccaagcgacagaacaaggccctgcctcttcttccccacccaaagaaaaacaaaagataaatatttgaggtgatggctatcccagttactctgatttgttcattttacatcgtatacatgcataagatatcacatgtaccccccaaaatatgtacaactattatacatcagttttaaaaagaacaacagacattgaaataaagacatactcctgaaaatgggcatacctcctcttaggctgttgataggcaggaggtgttcagtctagtacgagtcgatttgggttagggttttgttcagtgtttgggcctgtgccttcaatgcctcacaagtttcaaattccttcagtgatgggctgctgttcatttgcttcgagttggggtttaggtgcagaaggaagggtttttctctgagttcctacctcccctgtagctttcagctcttaccacgtcattgcacctctgtgggagtcactgtctatgttcttgttcctcccacagaggtcatctgctgttgcgtgttattcacattagaggacagttggaaagtgaggggggcgtgcctgttgtccttaggtaggttctgtgttgctagaccttaagggtgcagcttcctcagggctcttgcacctcctcccacagaggtagctgactgccctgtggtcctcctgtaggatcctatgcccacaaggagagaggaaggtgtcatcttctcctcttcctcagcatcagaggatcttagcctggtcagagcacagggagcatttcctctacatccccaagaggcagagggactttgctgcttctcctccctccaaagtaatggatctttgcctgtgctctggggcagggggaagagggtgtgcaagaaagaaaacaacagtcatgttatacagcgagggccttgtgtagatagagtttatgtagtcataataatgcaagcactgaatgttgagctaaacaaataatataactgtaaggaggatgtgaggatggaagtatttctgttttgggaagccgcagggtgttaaatgatcagttaaattgtcatattccccagtgtaaggtcaatagttaaagcctaagactgaaaaacttaaaatgtcaatgtaaggatgctatttagaaataatgagggccagctgtggtggctcacacctgtaatcccagcaatttgggaggctgaggtgggtggatcacttgaggccagaagttcgagaccagcgtggccaactagcggaaccttaactctactaaaaatacaaaaattagcctggtatggtggtgtgtgcctgcagtcccagctacttggggttcccaagaattgatcaaaccaggaaggcgggggttgcagtgagctgagatcacaccactgtactctagcctgggcgacaagagtgagaccctatctcaaaaaaaaaaaagaaaaaaaagaaaaaagaattaggtaaatattaaataagcttcaaaaagtcacaattctttattctaagaagtggaaactggataggaggaggagaggagacaaagtatggctttttcattaccaagccatggagaactgtatgacattcaaaggtaggcgaataaagatgcttgataaaattaaatattaagttctataaatataaaatttgatacatttaaaactgaattctaaaagtttataacacaagggtagggataaaggtgtagggaaaataggcattctcatatgttggtggagggattccaactggttcaccctttaaggaggtcagtagggcactccatcaaagttccaaattcagtaattcctactacagatatggtagaaaattgtatttcacacttgaatgcaataagactagaaaccatccaaatattaccagtaggtggccgggcgcagtggcacacatctgtaatcccagcactttgggaggctgaagcaggtggatcatttgaggttaggagttcaagaccagcctggccaacatggtgaaaccccatctctactaaaaaaaaatacaaaaattagccaggtgtggtggtgggtgcctgtaatcccagctactcgggaggctgaggcagggaggattgcttaaacccgggaggcaaagcttgcagtgagctgagattgcgccattgcactccagcctggaggacagagtaagactccatctcaaaataaataaagaaaaataaaaataaagattaccaataggtgaatggttagcagctatacagtggaatactatctagccattaaagaaaaaggtgacactttgtgtacttacgtggaatgataccccaggtaagaagcaagatgcagaacggcatcagtgtctctccagattaccagagaaaccagaagtagttttgtttctaaggaaacagggaaataattctcttctaaggaagtgaacttgatagcttagggatagagctgggaggaggatttttttttgccatatacccttttgtgtcttttggattttaaactatttgagtcaattacccatataaagttttaaaaataaaattataatggttaagtacattgggctatttatatggaaaatactttaatttgtttcttagtttccattatatattatacattctgaatggaccatatgactaaatgagagaatcaatatgttaaaaccaggccaggcacagtgggtcacacctgtaatctcagcagtttgggaggccaaagcaggaggattgctttgaacccaggctggtctcatctcgaactcctgtggtcaaatcaacttcctatcccaggagtttgagaccagcctaggcaacatggtgaaacctcatctctatgaaaaatacaaaaattagccaggcgtagtggaacataccagtagtcccagccacttgggaggctgaggtgggaggatcacttaagcccaggaggttgaagcttcagtgagctgagatcgtgccactacactctagcctgggtgacagagtgagaccctgtctcaaaaaaaaaaaaaaaaaaaaaaattaaaccttgagaacatatttcttgacattaggattggaaggttgtcttaagagacaaaagcatgtcaaaaagagtaaagatgaagtaatttgtctacactaaaatttaaaaactgacataaaaatgccataaagagaatgctgtgataatcatggactgagaagattgttgaaacacaattgtcaacatttggtatacagattatataatgaacgcctacaaatcaatgaggagaagagttcagggaacacttcaattgaataatgtgcaataaacacaaatagattgatcaggcatagtgtctcacgcctgtaatcccagcactttgggaggccaacatggcagatcgcttgagctcaggagttcgagaccatcctgggcaacatagcaaaaccccatctctactaaaaatacaaaaaaagattagctgggcatggtggcacgtacctgtagtcccagctactcaggaggctgaggtgggaggatcgcttgagcctgggtggcagaggttgcagtgaactgagatcgtaccactgcattccagcctgggcaacagagctagattctatctcaaaaaataagtatttgttaaaaatatgagtaggcagttcacagaaaaaaaaaagctgaactgtggaaaaaaattcaattttgctagtaaccagaggaaagcatattaaaagaaggcattgtttcatatctatcaagttggcaaaagtctgaaaatatgacttcgaggtttgggttggaatgtaaggaaatgtatattgtgattatttgaagtcgtatttttttatagctaggatgacacttcacatctgattttgatagtgtctttttacatgccaatacactatagacatctttctgttttaacatgatacatagaactctgaactccatttctagatgtatttaacaggatatattatccaatgataagactaatttggataggattctttctgagggaaggataatggtatagagaacctcaaggtttttcttagggttttatagtttttcatttttaatgtagattgttttctgcttttttaaaagacattattgcaagagcatctcaagcagacgtcgttacaatcgtgatttggaacaggatgaagcatttattccagttggagaatcactaaaagaccttattgaccagtcacaaagttctggtagtgggtctggactacctttattggtaagttaaacgttcctatagacatgaatggtgtgttgatttagaatgtgtcctcatgatggtggacagtataattattgcagatcagggaacaataatggacacatttttttctccttatttagaaagaggtatgcagtattgcaaggtgaaattagttaaaaataagaaatatgaaccaagaaaaatagaatagtcaagtaagatagagctataaaccaggttataggaaccaagtcctacagagaaaggcaggggaagttagatcacgaagtcctatatgaaaggcaagagttagctcacaagttttgctctaagcattttaccagccaacttaaagaggaatcaggtataagattccttgcatctgtaagtttaaactgattgattgagggaactgtaactatttcagattctgaaataaaaaagaagtttcaacagatattcttagagaggatgcttctctcaatatactactaccaaaacacatagttcaataaaaaataattttaaagggaattacaaataaattccaacaaatttggatggattcttggtatcagggaaaaaaaaataatcccagcaggttcatttatatatggaaatactcagttttgggttgaaggaactcttatttgagaggacctgtattatgaacactagatatccagataggtttaagtttttaattgtattagttgaaagaaactgatctcttcttattttattttattttactttattttattttaatcgtatcgagatagtcttgctctgtcacccaggctggagtgcagtggcccagtcttcggctcactgcaacccctgcttcccaagttcaagcaattcccgtctcagcctccgaagtagctggaattaccagatgcaccaccacaccaggctaatttttttttttttttttttttgagggatgaggtttctccatgttggccaggctggtctcaaactcctggcctcaactgatccttccaccttggctcctaaagtgctgggattacaggtgtgaaccaccgcacccaccctgatctctaattttgaaattcatcttattaaataactctaattgaattggaaaggtaaaagtaaaactgccttcataggcagacaacatgattgtttacgtagaaaatcccaagaatggtacaataaaactactgcagccagtaaatgactttatcaggttgcagaatacagagtcattgtacaaataccattgaatttataggctctagcaacaaacaattaggtaattataaaaacagtatttaaaatagcatcaaaaaccatgaaatatttagaataagcctaacaatttatgcaagacctgcacactgaaaattataaaacattgctgaaagaaattaataaagccctaaataagtggagatgtttataaatctgaggactcagtattaagatttcagttttcctcaaattggtgtgtaatttcattcgaatccaaatgaaaatcagagcaaacttttatagcaattgatgtatattctaacatttatatggaaatgcaaaggactagaagagccaaaacaattttgaagtagaagaacaaagaggaatcactacctgatttctggacttaccgtaaaactcaataatgatctcaatttggtactggcataaggatagatgtattgatgaatggaacagattatggagtttagaaaggaacatgcacttaatatggttaattgattaaaaaaaaaaaaacaaaaagatgcccaagtaattcaattggaaaaaggcagtccatttaacagatggtgcaggaaatatcaggaatccatttaccaagaagttaatctcagtccttacctcctcactctataccaaattaacttgaaatgtagcatagacctaaatgtaaaagttgaagtataaaacctctaaaagaaaatgtctgaaaaaattattctgaccttgggcagacttcttcagtacataaaaaacacaaatcatttttttaatgataaatcaggctttatcaaaatttaaaacttctgctatttagaagacaagaaaatgagaagacaagtcacagattggcaaaacagatctgatacagggtttttgtgcaaaatatataaagaccttttgcaactcaataataagataacccaatttttttaaaaaatggacaaaagatttgaacagacacttccccaaagaagatataagaatggcaaacaagcacatgaaaagatgctcagcatcagcagggatatacaaattaaacacagtaagatactactgcacatccactagtatagctaagactgataatattaagtggtgccaaagatgtagatcaactagaaatctcatacattgctggttggaatgcaaaatggtatggctattttgaaaaatagtttgacaattgcctggaaagttaagggcatactttccgtacaatgaagcaatccttctgctaattatttacccaagagatatgaaaacttgtccacaccagaggcctgaatgtgaatgtttatagcagttttatttataatagacataaactggaaacaaccccaaagctcatgaattgctaaatgaataaacaaatgctggtacattcatacagtggaatattactcatcagtaaaaaggaacaacttctaacacatgtagcagcaacagtgggtgaatttcaaaagtactttatgctacatgaaagaagccagacacaaaaggctacacaaaagtgattctcctgcctcagcctcccaagtagctgggattaaggcatgcaccaccatgcccagctaatttttgtatttttttttaagtagagacagggtttcaccatgttggccaggctggtcttgaactcctgacctcaggtgatccacccgcctcggcctcccaaagtgttgggattacaggcgtgagccaccacgcctggccaaaaagtgagaatttttttacgttattaaaatattctgtatcttaattgtggtattggtgattacatgatatagatttgtccaaggcttgttgaacttttctcaaaaagggtacattttatataaattatacctcaataatcttgacttaaaaacttacaggctgaggcaggcagatcacttgaggtcaggcgttcgagaccagtctggccaacatggtgaaaccctgtctctactaaaaatacaaaaattagctggacgtggtggcagatgcctgtaatcccagctgctcgggaggctgaggcaggaaattgttttaactggggaggcagaagttgcagtgagctgagattggccgccgcactccagcctgagcaacggagcgagactctgtctcaaaaaaacagaacaaaatttacaaaaggattctataataaatgatacataaagtcactttagctttgcactaaatctagtccattttagaagcatttccaacttggagcataatgttctttttaatttagaatgatcactaatgcttctgaaaatgaaagataacaatccatgtacatcttttatttaacaaatattaaagtacttctgatattgtcccaaataaatacttatattctgtgagcaggggatggaattcaagcaaatatatatgtaaataagaataaagttatgattgtgttaagcgcagcaactgagaggttttgtgtgctatgaaggtgtttaagtgagaaaatagcactctaagtaaagggaactggatattcaaaaaaacccagcgacaggaataagcttgagtgaattctaaaagttgagataagtcaaacgaggtttgtgggtgggtggtcaaagcaaataatgggaccaggccagatcaggcagggtcttatagatgggatttttaagatctttaactgttatttggactttgctgcataataaaccaccccaaaacttagtgatgtgaagcaacaaacattatttctcattctgtgagtctgtggggcagttcatttgttggacttgcttagctagagctaggtggtgtagttcacacccttggccgacagttcatgctgccattattttttggtcacagggttcccaaagcagcaggaagggggcaagccccagtccacaaacatttgtcaggtctttgcttgcatcacgttcgctgttgttcttttatccaaagcaagtcatgtggcctaagccctgagtctgtggaccaagactacccacgactgtgtgcactgggagggtaattattatgaccatttttgcaaacagccagccacttgaataacctgtttatgatttcagaatacattgtacattgtttcatactttaaagtacattatggccgggcatggtggctcacgcctgtaatcccagcattatgggaggccgggggtggggtggatcacctgaggtcaggagttcaagaccagcctggtcaacgtggctaaaccccatctctactaaaaatacaaaaaaattagctgggcatggtggcgggtgtctgtaatcccagctacttgggaggctgaggcaggagaatcacttgaatctaaaaggtgaaggttgcagtgagccgagatcgcgccactgcactccatcctgggtgacagagcgagactccatctcaaaaaaaaaaaagtacattataagtttttaactggagttggttgggtacaccatgctttttgatgagatggactacccctttgccagtcttaatgggtttctttcatcaagagctcaaaccttttacttttttctataaaggttcagcgaactattgccaaacagattcagatggtccggcaagttggtaaaggccgatatggagaagtatggatgggcaaatggcgtggcgaaaaagtggcggtgaaagtattctttaccactgaagaagccagctggtttcgagaaacagaaatctaccaaactgtgctaatgcgccatgaaaacatacttggtgggtacacactgattcagtcaatttcatttttgacaaggctagtgaggtacaggtggaagcctccatatgtgctttgaaaatgtgtgagttcaactatatacatttggctaaaggaaacctagtagaatacacggtttgaataaaacatagtccggaatgccaaccaagatctttctttactaaccagctgaagaaacagcagtgagtttcaaatggaaaataatactagtttattggacttactcccatagtaatgaaaacccagtcttttatagataacttaagcagtgatttagggtaacattaacatatgtgccttttccctttcataagctcaacagcccaacatgcagtttcattgtacgttctgtgtttaatgtgtgtttccccccatctccacatttacacaatagcaaagtaatttaggtgtgagctggtcagtcaggtacataagccgatctggctatcctgagttttcttttcccttcacctcttgttttcctccctttaatttggagagcccatagcatgttgccaagcaggcaattgtattagtttcctagggctgctgtatcaattaccacaaactgggtggcttcaacctccaaaacgtattcactcagttttcgaggctagaagtttaaaaccaaggtgttggcagagctgttgtgtctctgaatactctagaggaggagccttccttgcctcctctggctactggttggtggccaggaatttttggtgttccttggcttagtatagacaacactctagtctccatttctgtcatcaggtggccttctccctgggtgcctgggtccacatttccaccttacaacatcaccagccattgaattcgggcccacgctaatcctgtatgagtcatcttaacttgattacatctgcaaagaccctctttccaaataaggtcacgtttatagatgacatggattttagacatgaattttgtcggggagcactgttcagctcagtacatagcactcactgacctttttctggagggaagagggtaggagagaaaggaaaagagcaggactgtgggcctggcagtcaacgagccagactgaaaaggcagctgtgatgagtcactgatgggcaaatgggagttggcttaattaggagctaactcttagttgaacattcttaattttataaaagtgtccactttttgctttgaaattgagagccttttctactagagaatcatgtaggttgataatattctccaggttatttgtataatatgtcatctttttcttttctttccttttcttttcttttttttttttttgagacggagtctcattctgtcgctcaggctggagtgcagtggcgccatcttggctcactgcaacctctgccgccaggttcaagtgattctcttgcctcagcctccagagtagccgggaccacaggcacttgccaccatgcccaactaatttttgtatttttagtagagacggggtttcgccctgttggccaggctggtctcgagctcctgacctcaagtgatcctcctgccttggcctcccaaagtgatacaggtgtgagccaccacacccagcatatatgatctttttcttaatcctattcactttcatgattattaagattattataaatttattgtagaagtacagttatatgtgtaaatgtagaaatataatttttagtaacacattcacgacttggtgtcaggcgaattaaagtttcactatctgcacatgatacctaagtttttctcagtatccagaatgagcattacttctccctagcctatctctgatgataactaaccttttaaactcatcaactggacaggtttcatagcggcagacattaaaggtacaggttcctggactcagctctatttgattactgattaccatgaaaatggatctctctatgacttcctgaaatgtgctacactggacaccagagccctgcttaaattggcttattcagctgcctgtggtctgtgccacctgcacacagaaatttatggcacccaaggaaagcccgcaattgctcatcgagacctaaagagcaaaaacatcctcatcaagaaaaatgggagttgctgcattgctgacctgggccttgctgttaaattcaacaggtgagtggttctttgccccactgttttgaaattattttaatttccaaaagatatttccctatttgtattcaagataatggaattctaaaaatgtgcatatgcttgtttttagttacataaatgtatagttgggggggattttgttctttttacaaaaattgtgtcctacttctcctatacataattcttgatatatatatatttttttggtgtttttttttgtttgttttttgttttttgttttttgttttttttaaagacagtgtctcactcagttgcccaggctggaatatagtagtgtgatcttagctcactgcaacctcgacctcatgggctcaagcaatcctcccacctcagcctcctgagtagctgggactacaggcatgcactgccacacctagctaatgtttttattttttgcggagatggggtctcactgtgttgcctaggctggtctcaaactcctaggctcagctgatcctcccaaagtgctgggattacaggtgtgtgccatatagtcttagccatccttccatttcagctgatgtaaatctacttcattctttttaacagatgcagagttttccatatgtggaggtactgtagtttattcttaagacccaactgatgaacattaaaggtgtcttcagttgattatgaaaaggttttttaatgaacattgttgtattttaaccatatattatatatttgatccttgtgcacttgtacaagcatttcttcatgatggattcctagagaagggcctgctgaggcagtgagtttatacatattaaactatggtatgttgcatattatttctttcagcagtgtgcctcagtttacacacccgtaagcagtagagataaggatgtcatttttctgtcaccacttgatagtgtcagtattttaaaacaaatgcaagtgttagaaattacaaatttttaggaaacctttgaaaccattttaatcttgtaattctagaatggagtggctgctttacatttcagaattcattttaggctgtaatataaaagtaccagtctttaaaacaactgtaagagacatttaaatctgttacagtgttctgagtcagtgtagtatttgttggctcagatatttatcagatgctataggaaaatacaacgcattatattgatcactgctttagagtaattattactaattgtcagtatgatcatgtaaacattgctaacaacagaactctgttgatgggacccataaagaagaaaatgtaatcctatgtcacaaagccttagtgtatcatatgagagtggtaaaagcaagcgattcctcttgtattttcatattcaccacttctcagacataattatctactactttatcttttttttttccttttcttttctttttttttttttttttgagagagattctcactctgttgcccaggctggagtgcagtggcatggtctcggctcactgcagtctccgcctcccaggttcaagtaattttcgtgcttcagcctcccaagtagctggaattatagtcatgtgccaccaaccctggttaacttttgtattttatagagacagtgttttaccatgttggccaggctgatcttgaacacctgacctcaggtgatgcgcccgccttggcctcccaaagtgctgagattacaggcatgagcaaccgtgcctggcttaactttatcttatattcagtgttgtcctctttcttagacaccagacttatttagtgacaaaacctgacctgaacggatgtgaggtgtgtattgcccttatccagttgaggaggactatcggacttagtgttttgctgtagacacagtactgagtactgagttggattaagagtgctgccccaaccctgctgaggatgtcatgtagtatgtagcatgtatttaaagaaaaatctgaaaaatgctaaattccacaatgcatctggccccaaggagaaaaagaagcttttataaaataggacaaaaatacaagataaactattttatttttggccctcaacttggaccttggctttcttttgtttcagtgacacaaatgaagttgatgtgcccttgaataccagggtgggcaccaaacgctacatggctcccgaagtgctggacgaaagcctgaacaaaaaccacttccagccctacatcatggctgacatctacagcttcggcctaatcatttgggagatggctcgtcgttgtatcacaggaggtgggagtttgagtagtttctgattatgttgatttactcatcattttaaaaataacagctccagttatataactttttagtttttaatttttgtgggcacatagtaggtgtatatattattggataaggagttattttgatacaggcatgccatgtgtaataatcacatcttggagaattggatatctgtcccttcagacatttatcctttgtttcaccaaccagttatactccttgagttatttttaagtgtacaattaaattattactaactgtagtcctccccgttgtgctataaaataccaaatacttattcattcttctattttgtctctacttattaaacatccccccccatctgctgctacccttcccaacctctggtaaccatccttctgttctccatgagttcagttgttttgatttttagatctcacaagtaagtgagaacatgtgaagtttgtctttctgtgcctggcttattttacttaacgttatgacatccagttcctccatgttatttcagaaggcagaatctcattcttttttctggctgaatgatactccattgtgtgtaggtgccacattttcttgatgtgttcatctgttgatggtcacttaggttgcttccacatcttggctattgtgaacagtgctgcagcaaacatgagggtgcaggtatctcttcggttagctgatttcctttcttttgggtatacacctaggagtgcaattgctggcagttacgtaatttagatgtcacatacgtcagagtccccaagaccacccccaggttgtgcgatttcacttgaaggaccacaggactcggcatgtggttgtcccaatggctaacatttatcccagtgaaaggatacaaatcaaaatcagccaagtttagaaaaccaggcgaggcttcccagaatcctgtcccagcggagtcagggcgtgtgcttcattcctcttactagttgtgacaacacatacaaagtgttctcattcgggaaagctccttagagacttggcacccagagattttactggaggctggtcacataggcatcctctgcctggcatgtaccagaattccagcaggaaagcagacgtgcagtacacaccacattgtttgcacaagcagcccaggagtggtgagttaccctcaccgtttccggtaagttttatatccatgtagggaactgtttaccatttgtgtacccgggcactggccaaggccaaaccttgcaagccgcctttcctaagggaaggtctcaggcctgctgtgtgaacccttatctgcacctcataagtctttctactgcagagcaaaatgaaacaaaataataaaaactattcattagtaggaacaaccatataagtaaataattatactttagggtaaatggctgatttcgccttgcttattttttttaaggaagattgatatgccctttgtcgatggactctatcacagttgtgatgacatccctggtggaggtagaggaaatagttggacataaataagagaaaaacatacatctactattaagagtgaatcatagtgtctatattttttcttgtgtaagaatccgttttagttccatagtttagcaaaagatgcttactagattggtatatcttgtccagcaaccatttttgtgcccatgttttctcattcccttatagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaagtgagtggaactcagtcccctgaagaagtgattcgtaaatgccaccaaatatattctctgctcactgaacatctctttacttttcagtgtctacgagcagttttgaagctaatgtcagaatgctgggcccacaatccagcctccagactcacagcattgagaattaagaagacgcttgccaagatggttgaatcccaagatgtaaaaatctgatggttaaaccatcggaggagaaactctagactgcaagaactgtttttacccatggcatgggtggaattagagtggaataaggatgttaacttggttctcagactctttcttcactacgtgttcacaggctgctaatattaaacctttcagtactcttattaggatacaagctgggaacttctaaacacttcattctttatatatggacagctttattttaaatgtggtttttgatgcctttttttaagtgggtttttatgaactgcatcaagacttcaatcctgattagtgtctccagtcaagctctgggtactgaattgcctgttcataaaacggtgctttctgtgaaagccttaagaagataaatgagcgcagcagagatggagaaatagactttgccttttacctgagacattcagttcgtttgtattctacctttgtaaaacagcctatagatgatgatgtgtttgggatactgcttattttatgatagtttgtcctgtgtccttagtgatgtgtgtgtgtctccatgcacatgcacgccaggattcctctgctgccatttgaattagaagaaaataatttatatgcatgcacaggaagatattggtggccggtggttttgtgctttaaaaatgcaatatctgaccaagattcgccaatctcatacaagccatttactttgcaagtgagatagcttccccaccagctttattttttaacatgaaagctgatgccaaggccaaaagaagtttaaagcatctgtaaatttggactgttttccttcaaccaccatttttttttgtggttattatttttgtcacggaaagcatcctctccaaagttggagcttctattgccatgaaccatgcttacaaagaaagcacttcttattgaagtgaattcctgcatttgatagcaatgtaagtgcctataaccatgttctatattctttattctcagtaacttttaaaagggaagttatttatattttgtgtataatgtgctttatttgcaaatcacccactcctttacaaccatactttatatatgtacatacattcatactgtagaaaccagctcatgtgtacctcatatcccatccttaagagaagaaatgttataaagtagaactaaatataaattttcagaattaatgcattcaaagtaatatatcaaatccaggactttgttaacttcaggtaaaaacttcattagggtaatatcatctcaattttttcaaatgaaaggattctctaattagaaatttatatgtcagagctgttataaatttatcaactgtcaaatatgttctggacagctaaatcatttgagatttttggttttttgatttctattccctaacttgtgaagacaatgaaaaatcaggcagaaatatttagtatctagtcagtatctgtagctacactgtataactgttcttcaataaaatggttcatattttatagatgccttgttatctcaagaaatctgatttacataaacttatacttctttaatgctttttaaatatttattctgagcaaacaattcatgagtacatcaagtgagatagttttatttgattataacataaaataaatgtgattatatcacatcatcatcaaaaaggtttaaattaaatgggaggaaatcagcatatgtccacccattaccaaaatttgactatcatttaaggttaaaacttacaaatttgtctgcacatcaaatttcacaaatttgaaaattgccttaaccattttgattaataagtttcatctgccataattaaagtctgaagtgttcatcaagataagtaaatttgcatatggataatacccaataacttgttttttcagaatttttcaccatatgtatactgagaaatacaaatattttaatctgcgttgccatatgatatgattgcacttagaacacccaatttacttaaatcttggtttacttttgacttgataccataatctttaaaatcatttgtcatgttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcaatctcctgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtaatcccaacactttgggaggctgaggcgggtggatcacaaggtcaggagttcaagaccagcctggccaacatggtgaaaccccatctctactaaaaataaaaaactcagccaggcgtggtggcgggtgcctgtaatcccagctactcgggaggctgaagcaggagaattgcttaaaatcagaaggtggaggttgcagtgagctgagatcgtgtcactgcactccagcctgggcaaaagagcgaaactccatctcaaataaacaaacaaataaataacaaaaaacaaaaatgttgcattaaacttagttcttgtctctcctttccactcttattcttaaatctgaagctcatcgactaagtgaaatatttaaagaatatgataggccagcaagaagaagtattatgtagtaccatagttagtaaattcgtaaaaccttggaagccattatttggtcccacttgcaatttagtgtttttgaagtgtgtagcttcattcagatagct

SEQ ID NO: 13657 - DNA, 8607 bp, Human
  misc_feature (1)...(8607): n = A,T,C or G
ggctcctcctctgtaagtggggctgttggagggatgaactgagatacacgtggcaaggtgcctggccctgagactgggggccccgtaaacagcacctgctgctctgactgaggggcagttggagatgaggggggacttacaggcccaacacctcatcagcaggatgggccctggctctatacacatagaatgttggaaagctatgttctgggtccagttgcaagaccatcctgcccacttgctgggtcgctgaggcagagcgccctggactgtgctctggagagcagggggccgtctctgctcactgctgggcagtcagagtcaggtccccagggaactcagatcaaaatctcagggcagccttgctgggtctcagctttcagaattgatttctttggaagaacaggaggcatagccaggccagctggcaatggcttcagccacagtcccccagtgccccatgctgggtgattgatggtaggagctgtgcctccctgccagccccccaagccccattccctgccatggctccgacagggaactccctgcaattcttaggtggatcctgaaacacccagtccagactactttttcagcctcacagatggcccagagatagatactattagcccatttcacagatgggaccccagtgaggtctagagaggctctgctctagctgagctgggactcagatcctactccatgacctctgccaaggtccaggccctcttaccgtcctacggggtccttgccggtgtcctcagcctctgccttccagaccccaggtgtcctggagctctgcagatcagagaggctagtactggaagcctgggcccatgcccccagcagcccccagcccagggggcccccaaggctgaacagcaagctcaggatcatcttggtggtggggcaggctcagctcacactcagccttggcaagtagctccagaaactgctagtgacgttgtcttcaagttaaatctcaggaggaaaagaaaatacgaggacaacaaagagaggaagtggcctgggccggcctacccggtgggtcttgtcctgccccccaactaccctggctggccccacaggggccgccaaccacacaagccagttcctgtccctgaggacttggctcagggactctgggaatgtggtagacatggggtggccccaccaaatgcatccttatgggaacctgctccctgggagccatgaaaagagcgtggacttcgaggtggggccacaggaagtggtcaggtccatctcaggggacctgctgcccatccacactgctggccaggaaatggggggcaattcatgcctcctcagcaccttcagcactgggcggctcaaagaaggcaagggactattctggggtcacacagcatgcagccagaggccaaggcatgaggaagtccttcatttccccacccccacccacctcagatcctccaaccggtttcatggcagcccagggtccagcggcatccaggatgctggtgggtagctgcacagcccaggccgcgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggctccagctggcctccgcatcaatatttcatcggcgtcaataggaggcatcggggacagccgctgcggcagcactcgagccagctcaagcccgcagctcgcagggagatccagctccgtcctgcctgcagcagcacaaccctgcacacccaccatggatgtcttcaagaagggcttctccatcgccaaggagggcgtggtgggtgcggtggaaaagaccaagcagggggtgacggaagcagctgagaagaccaaggagggggtcatgtatgtgggtaagtggggcatggcagggtgggacagtgtggtggccaaagggtgagtgcccagttaccttcgccagaccttactccccagccccagggaggcattttgggagggggcgaggccctggctatcaaggtggggtctccagaccctggagcacccacaatgccctgtgcacacctatgtgtgtttgtctttggcctcctcggggcctctgggtgtcagagaccgcagacagggctggctacctgtctgtgcacgcacacacacattcccaagcataccagcctcccctgagcctggagcccctgaagccatgagcagcctgtgctcaggtggcccccaccctctccacacgggagcggctacagccaggtcacggatcccctccctccccagagagaaggggcaggctgggggatgaaacctaggctcagtgttccctcccccgcatcctctcctggcactctccagaggaggaaggggaggtcaagccaatgactcagctctggcccatcctgtcctgttgctgcttctgaggcccggccacacccgggcaggggctggaccctgggtctagccagtgtccctacctcaggcctgctctctcttgtcccccacattctgtcctgtccccttcccatccatccacttcttccagacacagcaggaagaggccctctgaaggggccgccggcccccagacaccatccttacccccccaccgaccccacagtttgtccagctgttctgttgtgtttgtcctgaccgcccccaacacctcgagggaggtctgggctgacagctccatttcctccccaggagccaagaccaaggagaatgttgtacagagcgtgacctcaggtgagaagccccagggccaggggacacatgggggataggacccctggggctcctgcatcctagtgctggggctcaaacctagagtcctgccttacccccaactggggtcccaagccctacagacccctgcagaccatgaggctaaactagggtgggcgtctccttacccccaccagcatcagaggtgccctggagtcagagggagcaggggagggtcccagcagggccagggctctgagctcctgggaaggggctgcgagcctgactccagcaggcctgccttggggctggggctggggtggaggccagccagtgtcctcccatagtggccgagaagaccaaggagcaggccaacgccgtgagcgaggctgtggtgagcagcgtcaacactgtggccaccaagaccgtggaggaggcggagaacatcgcggtcacctccggggtggtgcgcaaggtgagccccggccctcagacctgcccagtcctctcctgggcccagaaaggctgctgggcggaggcggcatcactccactccacaccccaggaaacaacacggggggctgcggctggcttcagtttcagtacccactgagcgccggcatggggtggggtccatgcttgctgttcgacctgcattcgggtctggaatcaccacaaccaccccttcgggggacttgggagcccatctcatagacaaggaaagtgaggctcaaaaccacatcttccggacggctctcagcacttaggagacaccccattttataagtgaaaacaggatcccacacggtgacaggcagcctcccgggcagtggtcaccaggccgggggctgagtagcaccagccccgcccccagggcctagcctccctccctgggctgggcggggcagctgcctcctgctgggagcctcagggaagtagcgtcccctagtggtaagaaagcagtgctgcttctgaccctaccctctgcagctgcctttgtgtgtgtgtgcacgtgtgttgagtgagcatgtgggtgcatttgtgagaatgtgtgggtgtacatgcgtgtgaatgtacacatgcgtgtgcggcccaatagcagacagcacaggagcagtggggcgcaccccagggacgggtgttggctgggtgagctgtcccagcacctgtgacacagcaagctctgctttacgcattgtacgcttattagttcatttaatagacacaaaatccatgagacggtgtggaaactaaggcccagagagattaatgtgcccaaggtcccatggctagttcatgtgagcttggaattcccctgagcagcctgtactctgagagaccctgtggcagtgtaagtggtggcctgggctaggattcctacctgggggtggggcgggggagcagtgtccagctctcctacctgctccaggcctcctaggtggtggagtctgaggctctgagcactgagaatccctgcgttaggagtgggtgggtggaagggtgggggctgccctactcctcttggctctggggcgatgcccaggtgtctgcttccagggccagcacagggtctccatgtccttggagctggcagccgctccctctcctagttcccctttctcgtcgtatgaccttgagaagcaaaggaacctctctgggcctccgtgttctcatctgcaagatgggggtgagagtgtcggcctccctgggctgtgtgatgaggcagggccatgacctccatgaagcaattctcctggtctatgtgagcacccagcagaggaaggtgaccatcatcatcatcatcatcatgtgtcccaggcagaacacatagagccccagggggctcctccctcctcacccccagcaaaagaggccctggggtgagggtgcccgggcattccttgtgaatcccggagcagggctagtgagcccttggagccacctcgagggagactcatttcctggtgacaccccaaaaccagtcacgactcatctcccagtgaactgtgaaaggcctcagcagggactatctgaccactcatacccctggcctcatcatcagccttagggcagcaggactcagcaggtggccacctgccctgcccctggatagcctggccgactcccgccagcacagcactgcccttttatgccccactccgccaaggggcaggatggccctggggcaacacagaggtgacagtatccccgcctcccccccgtcccccgccagaggcaggtgctgaggccagagtgcagggcaatcaccagtgtggtcctacacacccagctgtcatgatatctcacgcaagtgtctggccggcatggagtgcaggagatagaagatgggaagtgagagaggactgtgtaacctctgctggccctgaccagcctgagcccagagcctgtccaggaggcaaagagagggagccatgctcctgtggactgaagtgggcctgaagcaagcctgatctgatgccaacacaccccaccactttgagctcgaaggccctgagctgcatgccaagcctccctggcctcagagtccctatgtgaaccccaatcagtcttccttgtagggctactgagggtggggtcagacctggggcttcaggggcctctgcccactctaacccccactccaccctaccccacccaggttcctcatcagtgaagcccaactaggggcttcccagagactggggaccagcttgaggggtgaagctgggctccagggtacttggtgcccctggaaggcctcggcatcatcagagccccgggtattgtctgaattgcacgcccccaatacctccagcccctccaagtacaacaaggccacgaggggcctctgctcctccttgaggccagggtagacaaggccctggttgcagggcagctaggggtctctgcattctccacatggtctcatgcccccttttgtcccctacaggaggacttgaggccatctgccccccaacaggagggtgaggcatccaaagagaaagaggaagtggcagaggaggtaggagctgggctcctggggtgcaccatggggggttccttggtagggaccccatcccccacagacgcactgcttccctcctgggctcccagggcccagaggggcctcctgaccttccacagcccctacagggactgtgtacagggctaaccctgaacctgagtgggaggtccccccacggatgacccctcaggcatggggcacagaagacaacttttctcagcccactcagggtggcccattaaggctggggcctggagctgggtgtgcaggtcattctctctcccaggcccagagtgggggagactagagggctacaggccagcgtggatgacctgaagagcgctcctctgccttggacaccatcccctcctagcacaaggagtgcccgccttgagtgacatgcggctgcccacgctcctgccctcgtctccctggccacccttggcctgtccacctgtgctgctgcaccaacctcactgccctccctcggccccacccaccctctggtccttctgaccccacttatgctgctgtgaattttttttttaaatgattccaaataaaacttgagcccactcctgccatgcttcctctgggtgctgtgtagcttgaggaggggtccccaggtcctcccaggaacaggaacgggttcagcctgttgataggaccaggtatcctatagggacacacacagggcattcatgggacctgcgtgagccttcaggaacacccccaacccacccattgcctttaacatggaggaggcagcactgccttcggctccccaagacattcgacaggactcacagtcccatccacggggatagcttagctcagcctcaaggtagcccccgcctgcctgctctgagtccctgaggaacccactgtcagcaggaggtgaagataggctcctgggtcttccctccatgtgagttctgggctccagtgtcgcaagaggaacagggccacctaacatcctccctggggcagatggtgactttcaaagatggagaagtctaaacctagtgaggatgaagggcatcccacaggagagacaggaggtggaccctgcggcgcctcccacctggccccagccagtctcatgctccccgctggacctggagctgggtaccccttgcacccctcctgcacccagaagcctgccagttgccaccaaaaacacaacagcagagacgcacgaagccgcaccttgacagaaaaatagtaaaaagcaacagctgctgaggtcctcacaggcgttgactgggcactgttctgagcacttcaccttatttaatcctcagaataaacctctcaggttggagctgtagatccaggttttgctgagacgcacaggactgggcagaagcccaggtggctccccagccctgctatggctgcatggaccccaaggtgcttacagtggattgcccccaacccaaagtttcaaaacaacccagggcttgctggccagtggcctacatgaaaggctgtttgcccagcccactctgaacaagcctgccgggcacgacgcaaaccacccatcatgtaggccactggccagcgtgtcctgggttgttttaaagccttgcatgccgggcgggcttgttcagaccagggttccctggggatcctggcttcccctttgatactcagatggtttgggctcaaagcatctcagtgccttgccccaggccttcaggcctgggtgttggagccagagcttgagtccgtccacatgtgacttcagacactgccctgtccacaccgcctccccatccagcctctgcagtggattcaagggcagcccaggaggctgggagcccagtcagacacagcggagccaggctgtatctgttgtctggccatgggcatccactgaggaggcagaacggagcagggggctgctggtctccacatccccaagcactgccatgggcaggcatgaagggtctggaagcagctcaggccagtcagggctgttcctgctccccagcccagacatgtacacattaagcaggcctgtatgaacccaggaggaggccacctggggcctgggtgtgcccgagagtcccctgggctgtgagagaaagcaaggaggagcaaggctggtcaggtgatgggggtgagggagagggcacctatgcccggctcccagcgacaacctgccccaggtttcagggccctctgcctctgctggaggagcccagaggggtccctgctgcccctaccacagcccccctacaaccccctctcacatacactcagggcttgttcctggactcaaatgacaaacatcaccagaaagccccttcccagccatgggcactggcagtgctctttgcctttgaaacctcatgtgctctgcaccctgtgaggctgcttctgacctccctgcaggagcacggttgactccccttatccaccaggatacactcaagatgtttccagctgcctgcaaccccagatagtaccaaagcctacatatgtatcttcctacacgtacacatgtgcctccctatgatgaagtttatacattaggcacagtaatagactaacaataaccagtaagaaaacgg

SEQ ID NO: 13658 - DNA, 96845 bp, Human
cccggctgttcatgacacgggtatttggattcacttcactgtgggcaactccaacgttcatgtttgctctgtaggaagtaatgaaatgaatcaacactgatacaactggcaacctaacacccccaattctgacatgacaaggtacctgtgttgcgaggattattttttcctagttactttgaagtagcacacaaacaccatccaaaatatgctacttgtagatgctgatgacagcagtaaagaatcttcagcatttgactttagggtaagacaagacttgttattatggttctatttgaaaaaatagttacaatgcctttccaaaagtttgttttctagcatgttgttttactgaataggaaaattcaaactgaaagagaaaacctacattttcttatatcatgagagcaaagtgaaaagccaaaagctaaatttaccaacataataaatttatattaaaaagaaaaagcagaactcaccgagccagtgtgtcaagtagtcagactcttatatttgacttaatgtatccataaagaatggtcagagttcagatcacttctttctgaatactcaatgtggaaggtacatgctgttgacataatgtggtgtaaaatttacatggtcaagggataatgtttgtttctcaattttgtgattagactaggtgaaaataaggagtcttctgaatatttctctagtcaaatcaaaaacttcagttttctttcttctttttaaaaaaggttttcccttctcctttccattgaagatggactccaaaggaagaattgataatagttctcagttcttttaatgatggtgtttacttgagactaagaattgcttaaaataaaactgtcctgaagaacacctatcatccgacggagggggaaaacgaggctagattatatttggaacagctgtgattttaaaatacacaaacgcttgtattacggagttagcatacagagaggaatttctcataaccccttccagcaaatgtttccggagtataatgctccttccgctctagagacccatagaacaggcatcaagggttaaggggacgaaaagttagttacactaagaccgctaaagcctccaatttatatgtgtaaatctttcgtctaaacacccatgatttatcatacattaaactattatgtcatacttagaacatgccaacactcaagatagttttcccacgttccacaggatggaggcctgaaatttacatctcagctggaaggcaaagctggtgcggtactcatcctattccaaccagaaaaccttttcccagcaggtttgccgcgctgcccacgactggcaaacaatgaccttacagaccgtgaagaggctgttggctctgccctcgccggtgcctccgaagacggcgacccgcagcggcccctcaggggagtcccccctgctagaccgacagcccgagcgctctgggccagagaaaactcagcaaaagccgccgctgctaccacctcagcgcctcccccaacccgccccttccttctcgcggccgcacgtcacgtcaggaccctggcaagacaacgaggatttgcgtagggggcgagcctctgaggccacttggctcttacggccacgcagggcgccgcagatgcagccggagcccgcttttccctctcaggacgacccctaggccgccagcagttccctaccgacgaaggcgactgtacagcgtccaccgcgttcgtgcccacttacccgccgccccactccgggccgccggctcgcagcaggaccagcccggctgctacggccgcggatacacgccctcaggcccggcgctgcgcagcttgcggaagctttcccggacagactcgctgccagcggattggctgcgagcagcgccaatctcacgttgcccccgggcgaggcgggactcagtgccgcgctctctgcacccgctctgccgcgcgcgtgcgtgctgggtgcgggtgcgggtgcggggttgggcctgcgcatcgggtgagacgctggctgcttgcggctagtggatggtaattgcctgcctcgcgctagcaggaaggtagtgtggtgtgactaacgggtatttattatatcctcgatggctcgagggccccgtcccctctactcgtcctggtccgggcgcgaacgctatagggcagctaagggcgctccccgcggggcgggaagcgaagccgggcttgcgggcgcgcacacgtggaacgcgttctctgagcaggtctgggctccggggtgttctggcttggtctttgttgcgtcccattccccagacccttctgggtggaggacttaaaatttgtttttcaggcagcagatttaacccatggcaactgtaactcatcttgtgtgagtggcggtttatagtattgtatcctgtggcatcatacaaggggtgcaagttaaactctttaaagttaatcacgatttttgctcgtggccttctgggtttatccgtacgccgaagacaggcacctgtattacatgctaaggaaatgtgaataccaaaaattgatcctgaggaaagtcttgattaggtttttttggaatcgcctttgaaatgtaatttccctcaccttggcagtgcagaaagtttgtgatttttattgccgaaatagctttcaacattttgaaattgacttaagagaatgttggctgtgtatgtctgtatcttgcatttctattggctttgtgaacctaattgttttggatttagtctgatctttaaataaatgatttctttgtgttctctctaatggaagtctgtgagttctctgatctttacttcttttttaggcacacctgttgtccttaactgactttccgggtcatcagcacttcttcagaagtgttccttttccctcccagcaaatatggaagactgactatcctgatattcccagacattctttgctgtgatttgtaagcccgatataaacccttccatttggtacacatatggtatagagtgctatattccaggggctatgctagcgatgtgtgattgatataaaacccctgtcctcaaagaactctgagtcaggagcaacagacagaaacacatattaatagagtaacttgtgatgaggttaattagaaatgaggtaaagggggactgcaggggaaggaatacctaatctgttggcaggtgaaggaaaggaggctgcagcagggaagaaaggctttcttgaagagttgatactgaactaaatctggaaggatgattagaagtcagctgagagagaaccatgtgagctgaggaaggagtgagtgtcaccatgttaagagagacaagttggctgggcacggtggctcacacctgtaatcccagcactttgggaggccaaggcgggcggatcacctgaggtcaggagttcgagaccagcctggccaacatggtgaaaccctgtctctactaaaaatacgaaaattagccgggcgtggtagtgcgctcctgtaatcccagctacttgcagggctgggacaggagaattgcttgaacctgggaggcagaggttgcagtgagccaaaatcgctgcactctggcctgggcaacaaagtgagaccctgtcacaaaaaataaaaaataaaaaaagacgagctgtgcagtatgatcgccctagagcacatttgggcaacgatgggatgactgggagagtaggcaaaaatccagttgttaagaagtttgtacttaacctggttggcaattggaaacctttataaaaattttaagtggggcagcaacatgatgaaatttaaatacagaaagaaccctataggtggttgagattcgagtcaaaatatcaattaggtggttattgcagtagttcaggagagaaaggccgaatggaggcagtacaaagaggagaggactagtttgggaaacatttagatagtaggagagagatgactgggtggcaggatgtagagagcgagtagaatttctaggatgacttcaaggtttctaattttgctttatgtgcttggatggaaggtgtttgagagcatggcctttggagtcaaacatgccaaggtgtgcatctgccacttaatagttttgtgatcttgagcaagttaccatgcctttaaatcctatttggtgataaaggatgatagaatacgtagagttgttgtgaggattaaataggataatatatataaaattctcgtgttggctattacttttattatcaaacaagaaatataggaagaaagttgattagaggccagtcgtggtggctcacgcctgtaatcccagcactttgggaggccgaggcgggcggatcacctgaggtcaggagtttgagaccagcctggccaacatggtgaaaccttggctctactaaaaatacaaaaaattagccaggtgtggtggcgggcacctgtaatcccagctactcgggaggctgaggcaggagaatcgcttgaacccgggaggtggaggctgcagtgagcggagattgtgccattgcatttcagcctgggcaacaagagcgaaacctgaaactctgtctcaaaaaaaagaaagagaaagattctctgatcagtttgggacatgttatgtttaggttgccttcaggtcatctaaatgatgatatttagaaggtagatggaagtaaggccctaaagtccagaaaaaaagtgtgagatacaggtgagctggaggatggtgtggaagccaattgaaattatgtatataaagggaaggaggatactttttctaatgtttgcgttagcataagaaagatgctgataaattatatttagtggtccttcattaatattcatgaagtgaagggcttgccatgggtgaagcatttgactgttctgcctggcattccagagatacataatacataatttcctacattcaaaagttgtacagcaggaaaaaaaaagttttacagttcaggacaaagatgtagtaggtttaattatacaatttaattaatttaatctttacagttatcttacattgattataggacaaaacgatatttgatattttgaatatattagattatccaaatacgtaattaagattaacttcacttttttatttttttttttagcttttttaatgtgagtactagaaaattttaaatgatgtatgtacattatagttctgttgaacagtgctggatagagtactggttaaaatggcaggctctgaaatcacgctactttggttttatcctagctcttactaacagctatatgatactgaggaaattaaactttctaaaactcaatcagctaatctataaaatggagacaatacagatatcatatgcttatgaatttggtagagacacaaatattcagactgtagcaattaggagagaagaaagatgacatgacatggaagaagagtatgaaaagagatgcagacatcttaagaccagaggatgcaatgggatggggtagataaagtgtgacagaattcatgctatgaattgccatgatcttagtaaactagaagaatgaggaatattgggatgcaattatagagatttaaaaaaaaaagatcttggatttggcattgtaggagatgaggtattataggaaacgagacaaagatgatgagattaagactgctcagaaggagtcagtctaagtttataccccaaagttttgttgatcagtgtttttcttagatccttgggatttcctagctgaggtggaagacttcttgaacccaggcctaatgtgtgagcccctttggggtaggggttagaggtggggggattgttcatttaggggtttagaggagctcagtttagtcccagtaccctgggatgtttttagcacttatatgccaaacactgtaatacattatttatatatactactttatttacttctcaccacaatcatatgatatcattattagatccattttatagattaggtgattgcattttagagagtttaatttcctcagtgttacatatctgttagtgtaagagctaggataaaaccaaagtagtgtgatttcagagcctgccattttaaccactgctctatccagcactgttcaatggaactataagccacatctatcattttaaattttctagtagtcacattaaacagattttttaaaaggttagttttaataatatattttatgtaatctagtgtatccaaataggataaaatcatttcatcctataatcaatgtaaaaaattgatatgatttttattaatgctgagttggaaattgagtgtgtattagcacatctcaatttggactacccacgtttctagtgctctagtgttcagtaagctacatatgactgatggctaccatattggacagtgcagatctgtcccttagatcgaggtaattctgaagctttggaaaagtgcagaggtgccttttgcttgtgacagcactaatttgtgtgaatgttatgatgatggagtagcctatagtccactgtttccctgcttgattgggacaggaaagcctcccagctgttgagaacaacaaaaacaactattgaaaggtagttgttcacagctgctctcctgagaactgggtaccccaaaactaaatcaaatatatagattaattagagggtagttagtatttaaaaagaattctcagcattcctttacataatgatctcttattataatactctacattttataaggccttatcatttgtagaacaacactttatatattcttccttatttgattcttcacagtaaaccagtgaggtattagctccatctttacagatgatgaattgatttatggagggatttgagtgatttgctccatttttatagatgacaaattgatttatggagggatttcagtgatttgctgagtttatgtgtaataaaggtgaacccccaatacctattttataggctctggtctgttacatttttttcattgtgccaatcacctttgccttctatatagcaaaatatactgtatttatgaactgtgatcagttaacactctcagaacccaatatgtcggcctcttcccagaagtgcattccttaaactcctgtgtaattgttatagtgcctgtactccatttcctactcaattactgagtctttctttacatgtctttgtcttatgctgcctgagaaataatcctaaactgatgactttttgttgtgtttgttttcggtgttgctattttatttgcacctagattgcataggattaaatcatcataggagcatgtaactagtcatgggaaacaaagtaccttgagtccacccccagcccccattttttttggtccaataaaatcttgattctgcagaggaattgcatgttgtcaagcttgtgcttattttcctgtaatcttttctgaaattaggcaataagatgcaaaaagcacccccctccctgcatgctttacagatggaatttccataggacgtttttggatttttcgtttgtttgaacaaaggatttccagttaccaacagagattttggatctgcaggttggatctataaaggacctcaaatgccaacttagagatttgagctttatattattggctttgaggagccacatgattaaaataatgtcgtaggcagaataatatagaggatagttatctgacatgtctggtatgagaccagttcagattaacagtaatcctaactctaaaggagctcagtgattgaaaaagacattataattcatcagaatgtatggatgactaatgatgtttaaatgagactgttggtaaggcacataactgattgtcattatccacttcccaaagttatattatcacttggtcattctcagccaacattacactcattatagcacaattgttcttatcattattcagttattaccatagcatttgtttttaagaaatctttttagaacatgcatgtcttgattccagtatctgtgagctttcggtgatctactgtaatgagtttggaccaagatgtagttggcacagacatttaaggaaatatatttgaaataaaaatctcaaaagtacctgggcccagttacttactcagctttcagcctcttaaatgtccataataataagtataatgttttattcatagtacctactttctatggtttagcggtttaaatgcaatcctatatgtaaagtgtttagcatactatatatttaatgtagtagttgctgttcttattgtaatcatcattttaataaacggcagtatagactgggtgaccaaaggtgaagagtcattgaggctaattaggaaattatattgggaactaaatgtgagaaatactgagaaaagaattgataggatttaggagttgattagatttgagtcagggtgaatggataattcctgtaggaaagttgtgggtttagggtagggattggtaattatacccggagtttgagctagtgattatttcagcaggcagttggaaatacagagttcgagtttgcaagaaaagtcagaatataattagtcacacaaaatcctggaagaaattagaaaaaaagcaatttcttcctctaatgttattgtggactttttttttttaggtgcttgtggcagaatattgtggattttttgaacccatttttggttatttttattcataggcatttatatgtattcatatattaggtatcaatagaggaattgttgaaggacttgccttagctctgcctcttaataactggatgaccttggacaagttttctaatttctttatgccttagtagttttataaaattgaggtgataatggcacctattttcatagggtaataataagaaatagaagacttatggctgggcgtggtggctcacgcctgtaatctcagtactttgggaggccaaggcaggcggatcagttggggtcaggagtttgagaccagcctgaccaacttggcaaaaccccatttctactaaaaatgtaaaaattagccaggtgtcctggtgggcacctgtaatcccagctactctggaggctggggcaggggtggctgaacctgggaggcagaggttgcagtgagtcgagatcacgccactgcactccagcctgggtgacagcgagatttcatctccaaaaaaaaaaaaagaagaaatagaagacttaatattgtatgtgctaacagttgagcgtagcatacagtaagtctcagtgaagatgatctattttcatctgtcattattattgccatttgtcctgttggtcaggaatgcttaacaattcttacaagttgcatttttatcttctagctgctctgttaaaagcgaaaatgaaacaattgcctgcggcaacagttcgactcctttcaagttctcagatcatcacttcggtggtcagtgttgtaaaagagcttattgaaaactccttggatgctggtgccacaagcgtagatgttaaactggtgagtgtccttgagaacccaaatacctttaagacaaagaaaagggtctggacacatgttttctccttaaactgttacctttattttatttctttacaccaataaattattcttaggacattggaccctttgtcttaagagtaaatccttaaaaataaattttaatttaaattaacattatagtaacactaaaggaaatataaaagaaaacatgttctttaggtctccatcacctaagacatctaatgtttgtattttctacaaatattggttattcatatttccttgttttagggatttacttttgcattttattttttccatctaatctaatttcaaaccatttcccttgttacttttttcacattttaaaatttaagtgctgtatattaaatcatttgagtaaatatggcctatatcactcattatgatttattgcaattagtttccatgactagttcccctgttctaaattgctaacacatagagatatggtctattttattcatttttgtgtcctctgtacctggctagtacctagtatgcactaggaaggtaaataaatctgactgaatgtaagaatacattttttaaaatctcttaattatcagatatttatgctatttctagtgttatagaactagaaacaatgctgatagaaatatatttgtaggaaagggacctaactttttcttatctaccagataagattctatgagataaacatgtatatatatatggacacaaatatatatatatatatatatatatatatatatgtaaaataaaatcccttctataaatcacttctcataaaacactgtgacttaactactactatacccattttattttttatttatttatttatttattttttatttttttgaggcagagtctcgctttttcgcccaggctggagtgcaatggcgcgatctcagcttactgcactctccctccccggttcatgcaattctcctgccccagcctcctgaatagctgggattacaggcacctgttaccacgcctggcaaatttttgtatttttagtagagatggggtttcgccatgtcggccagtctggtcttgaactcctgacctcaggtgatccgcccacctcggcctcccaaagtgttgggattacaggcgtgagccactcatgcccagccatactatacccattttacagataatgttctgagaagtttcccaaagtctcataattagtaagtagtggagctaagactagaatccaggtctttctgactcttaaaacccattcttgatcttctctctgtgccagtggttctcatgatgtttgggtgcatcagaataacttaggatgtttgttaaaactgttactgggtcttactcatacaacttcatagtctagatggggcctgagaatttgcatttctagtaaatttctaattgatgctgatgctggtgggttatggaacacactttgagaaccattcttctatatcaaacctctgttctgttttgaatacactataagctttataaacgagaaaacaagtatattaaattatacccaaagaaagacaatttgtttttcttaggcatttcatatagtcagttcagtctgattagagtataattgataataattaaacaggattagatagttatatctgacagacttcacttaagaatctttggcaggcagacatctttttcttaaacatttctggaagaaaaactggtttttaaaacagtgttacaaagccaacagaagtcctgtataaactaagttaaatattttaatctggctgtaaattttagtctcttgacatttaccagtatttgctttgtagaattttaagatatacaccttaaatgtgtggctctacatgataagacctgtttcattatggttttatgctataatagctatcctgactagatatgttttcataattaattaaacgtgatggtactattttgaacatttaaacaaatctttgtgttcttattacgggatttcgagaccatgttgcccaggctggtctcgaactgctgacctcaagtgatccacccatctcagcctcgtaaattgctgggagtacaggcgtgagccaccatacttggcctgatttttctttaaaatatagaagaccgacagttcccagaatgtaaacttaactttattcatttatttatttattttgagacagtctcattctgttgcccattctgaagtgcagtggtgcgatctcagctcactgtaacctccgtctcccggtctcaagcgattctcctgcctcagcctcccaagtagctgggattacaggtgtgtgccaccatgcccggctaattttttgtatttttagtagtgaccgaggtttcaccatgttgaccaggctggtctcaaactcctgacctctaatgatctgcctgccttggcctcccaaagtgctgcaattacttgcatgagccactgtgcccagccaaactgaattttagattgagagaggtgtgaggaacaaaatcttaggcatctctctccaatgttttgtatatctaatttatctaaaaattgccgacatatacagtattatatcattttaggttattaaaaagatgtgattttattttaaataccagagtcagtataattatagaaagattttatttccccctttgtaacttgcatctgtggtcatacacataagactttgtggagtaaagtcagacttatttattatggaagttggctgccaaatttagaatatggtgttcatagaaagtatgatcactatgggaatttaaattttgtttttgttatatatgtatatttttagtataagaatataaaactaagctatgaattgagattttgaaaagattttcatctgatatgatggctcacacctgtaattccagcactttgggaagctgaggcaggaggatcgcttggagccaggagtttgataccagcctggacaacaaagtgagaccccacctgtacaaaaaataaaaataaaaatagttaggcactgtggcatgcagctatagtcccagcacctcaagaggctgaggtgggaggatcacaagcccaggcattcaaggctacagtgagctgtgatcatgccactgtactgtatgtagcctgagtgacaaagtatctaaaaaaagtcttgattttttttcaaattaaaaacttactgtggttgctaaattagatgtgttttctcagcagtttcctgttagatggctgtttgcagaaaaagatttagaaagttataatgtagtaaacatagatttttatgtaagggagaaagtattaaatattaggttgattcctgccatagaaaagcaaaataagaaaacaaaaaacaaaataaataaataaaaatcaggttgaataatgatacttgctaggttctgcctgactagaacatgtgttactttgtcgctgatggagttctgttctgttctgttttgttttggggccatgcataccaaaggtgtatgtaattcagaagaatttttttagtcaaatttaaacataaattattgtttattgtaaatacccatgataatgaaacagtgaaaagcaaccttaaagatcagcctaacctccttattcaacagttgaatctgtgtccagagaaaacaagggagttgcctgttgcaccataactagaaattagtagagctgaagaatttaaactcttatatccataatgctatgcttccataaaagtaaataaatgtcaaaattctttcacttgtgtttctttctaagtgtgataacagtttaatatttttacatattaaaagtgttttttgacattttataggagaactatggatttgataaaattgaggtgcgagataacggggagggtatcaaggctgttgatgcacctgtaatggcaatgaagtactacacctcaaaaataaatagtcatgaagatcttgaaaatttgacaacttacggttttcgtggagaagccttggggtcaatttgttgtatagctgaggtaaggtaattatattggttattttagtgatttcatattcactgaacattacagttaaaactaacccagtatttggtgaagtatggttttaattatttttattatggtaaaatatacataacataagccgggcgaggtggctcacgcctgtaatcccagcactttgggaggctgaggcaggtggatcacctgaggtcaggagttcgagactagcctggccaacatggtgaaaccccgtctctactaaaaatacaaaattagctgggtatggtgcctcacgtctgtagtcccagctacttgagaggctgaggcaggagaattgcttgaacccgggaaacagaggctgcagtgacccgagatcatgccactgcactcccacctaggcaagatagagtgagattctgtctcaaaaaaatatatatatacataacataaaatgtatcattttaattatttttaaatgtacaattcagtggcagtggcattagctacagtcacattgtcgtgtatctataaccattattcatctccgcaaccttttcattatttcaaactctgtacccattaaacaataatgccttttccccccatcccctagtactcactgttctactttctgtctctatgaattagactattctaggtatcacatataagtggactcataaaatatttgttcttttgtatctggcctatttctcttataatgtcttcagggttcatccatgttgtaacatgcatcagaatttccttcctttttaaggctgaataatattccatcatgtgtatataccacattttgtttatctgttcattttcatcggtggacacctgggttactttcacccacctttgggctattgtgaataatgtttctgtgaacattggtgtacaaatacctgtttgagtccctgcttttacttctttggggtatatatccagaagtagacttgctatgtcatatcataattctgtgtctaattttttgaggagcagcaaagtgtgttttgcatttaaaaattgtattaagaaaattaagcagatatttaactatagcacttctcagagcctttactatattcaagcacattgtaaatctctaaggttggtggtttatatacgcactttttcctatacctacttgaccatgaaattcttttattgagaaagcatatcatttttgtttgtttgtttgcttgttctgtggactacactttagaaataccactctaaccggtacagttagtgagattacgctctagagatgtgaattgacttggtctaaaccttaactagttaagggcagattggatttaagaactttactcttctgactgtgagttaggtgctcagtgtctatgaactcctgagttcagtgcttggcacattcacttgcatagtaccaattatactacgctgcctctgccccagatcttataactagtttgtagcaaagcccgtctagaaccttgatctcttcatttctgttatctcagttgtgtttgatcacgtgactctgtactactttttttgtactatactattaccctgtggatgttgggctcttattgtgtgacagtatctatgtgccaggtgacagggtgattgtgagggtctcttgagttattgaaatttgcccagtagccatgtaatccttcatttgtgcttaggctggcagaccctatttaggcaagaatgttccagtacagtaaaatgataggacttcatacttgttgttctggaaaagtggcacagaaatgagatactgttgctgtctccccttctggtctttggacatctgtttagtagtccagtcttgccaagaataatgatatattctctaggttcattgtggtcttccctcagcccttctgtttttgaagtgctggcataggatagtgtaggttttctccattttttgtggctaggattccagctcagtacagatactccttgacttatgaggggattacattcctgattaaacctttgtaagttgaaaatattgtaaatcgaaaatgcatttaatatgcttaacttgctgagcattacagcttagcctaacctactttaaacatgctcagaacacttacattggtctacagttgggcaaaattatctggcaacatagtacactggagaggatctgttgtttatcctcatcgtcacatggctgactgggagctgtgggtcactgcctcagcattgctagcttatccactgctttctactgaatgcatatcacttccgcgccactgtaaagtcgaaaaatcctaagtagcaccgttgttaaattggtgaccctctgggttcagttttttacttttgggcttttctggctgtgtaacatgtcttaagtaggccagagaaattgcaaaggagatgaagtttaagtgggagattttgctgttggagcatagaggactagggggccttgcttattagaatccagatgtttagagatcattaaagggaaattgtcatgtgtactcttaaaaccgctgtccaaaatctagcacactgtgtacttctctattttcctcagcactcgctttatttggagttcacagagccttcaaatagattttggggaagagggactagagggttcaattgggcattgtccgtttttctcctcaagactataaatgggaatccacaaccctggatcttgtacaaagagtttgtctttaaaattgcacgaggtttgcatcagggaacctctgaatctgccagtactatttagctgtcagtgactactctagaagtcatttttttttttctgttttagagcataagtatttgatttttttttttttttttttttagctgttgttcaaacttgacagataggctttaagctttatttggtagattatcaaaaagataatttggcatttctgtattttctgcaagatatatatgtaacccttcagagctgaaattagtcataattagctttgcctactaggtggcagcactatacttggtttttagaaataggtttcacatgagctgtatgatttattcaaatcttcactgtagttctgagtttagatggcagttttgtaagtctttctccattggtcactttctatcttgtttccttatttgattacttaaacccacttgataggcaagtttatcattttgtctttgttttattttgaggcactcaagtggccttgagtataaataaaataattttgctcatcagaattacaaaagaattgtcaaagtatcacaatagtggaaaactataaagtttttaaaaaaatgtttgcaatgccaagcatttatcttagaaaatattaacagtattttatggagtttcctttcttacaagtctttgggaaaaccacatatagatgtgtgtgtgtatgcatgcacacacacacctacactaacaacacaatgaatttttacatatgtatactcctgatcaagatttagaccattatcagaaccccagaaggttccctcatacccactcccagtcagtacttctcaaaggtaactgctattcagacctctgtcaacacagattagttctttatgttcttgaacttgatataaatgaaatcatatggtatgtattattttggcacagagtttttgatgatgatttaggtttgattgtacctgaaaactaaaggaaatacagagctagctggaaggaacttttatagtagtaggggaccctagtacaccatctagatcccccacttcaggactgagcagtcagcccccagctgccaagagtgttggtgactcacccctgagtctccatctggagcttgcccttaccgcagctgaagacagctgccttacccaagtcatgcagggcaacctgcatccaatgaatccagtgactggttgaggtgttataaacgtcccagttcaggacaacattgccctatgcccactggtgatcatcccaaagaaccccccaataaactgactgctcactaatctccatctcagaatgagcttcatggattagccagcctacaatgtaggtcttctgtgcttcagtttcttcatagtactgatgaggaaactgaggtcttttgaagccaaatgccaagtcttcttacccaacttcaaaacactgtctctaataactcaagtaatgttcattgtctacgcatgcagggtgctgcactaggtagttgatttcagaggaattgtacacagtgaaatatgaaatttgtaacctattcaggtatacatagtgtgttcaaggcaaagcccagaattcagtcctaatttcatgcctttcagtaatgtattttccgtggtaggttatattacctctttactagcatgattagaaatgtatttataaagtttaaaaatacttccatattaaatattaaattatttacaaatatacccaggcctgcagtgctaagttcaatagataagttgttaggagtaggtgagttgaaacttatatgtgaggactgtgaatagtatttgagaaaaacaggaagtaatgtatgtttgttgaagtcagttacatttaaaaataaatatttttaaataagacttaatgggtgcattttgggggaaaggagttcactttttaatcttaaggaatattccttagcactcagaaagaattgaggtttcatatatagaaaaaatatattttcaagactagcttattttgaaactttttagatgaaaattacagtgaatgcaataaaaattagtaatttggttattttatctaccaaactaactgatgcatataattttaaagtcatagagttgtaaaccatcctaggctcagtggatcgatatgtaattgggcacactattaaacagccatcacctataactctagttgttgacattattttctgtttatttaaaaaatgttattaagaagaaaaattaagttagactttcagcaaaattggctggagaaatctaaaatacatctaattctttgttctttatttatatacttgaatggtcagttttcctaatttgtcaattataaaataacttccaaccttaaacagtccaaagaagtaaagcattatttttgttttgttttgttttataatttttataattttttgtagagatagggtctcactctcttgttcaggctgggctcaaaatcctggcctcaagcaatcttcctgcttcagccacccgaattgctggcaggcaggagccactgtgccctgcaggcattctttttatatctgcagagtaaactattggtattttaaaatggaattattgctttcatgatctgtgatgagtatatcagcaactgacacaaatttactcgtaatggttttctttaaaatcataacagcaagcataacttcttgaaatttattgtttgtagagcaataattttgagaaatttgtcatcttcaatgtttaattactagtactaattactaagcacagtgactgggttgaaatagagagagtgaaaatcctgtcttgaccgtctcataaaaatttttataaagattgtgtatattattcctatcacataataaaaaacacaaaatatttttctttttaggttgatattttatatgtgttatcaaagaaatgtttaagaaactaacaacatttttgaactggattttacatggaggctggttttagaaatacagaacagtttattttattttattttttttcttaaagaacaaattctgaagtaggagtcagaagcctaattctaaatcctgagtgtttgaataagagacctggccaaaggccaaagtcagattaagttttctgagaattttttttttttcatttatcaagtgagggtcaaatacaataatacatcttacagtgtcttgaatattgtgtacatacagatgcaagttatttctactttggacttgtatgtgaaaagtagtatgcatctggataagatcattagacttgcttattcccctctgcaaatagtatttcacctccgcattctatgtatgctattccacattttggggaaatcctttctaaaatgtaatagccattcataggtaaattccttctaattctcaccaaatgtcttcatcccgtagtgttagttcatttttttctctcgtttttccctcagaagaataaatgtcatcctctgcataacatttacatttattgattcattcatccaccatttaaatggttacagtgtactgaatattattctcaccttatcaagctcattatgcagttgacccttgaacatcacccagttgaccccaccacttcgctatgcagtcaaaaattcacatgtaacttttgactcctttaaaacttaactactgttgaccggcctcctgttgaccggaagataacatattttgtatgttgcatgtattatatactgtattcttataataaactagtgaaaagaatgttattaagaaaattataagagaaaataaatatgtttgctattcattaagtggaagctgttcattaagtgttcatgttgagtaggctaaggaaagggtagaagagaagagattggtcttgctgtctctggtggcagaaaatctgtgtgttaagtggacctgcacagttcagacttgtgttgtggaagggtcaactgtacataattttgtgatgagataatataggatctgtaggtttgtttttgtatcacctcacattaagcctccagggcttagaggagcagaatgagaagctgagtcattttgttttgaagatggaagttgggactcacttatttgtgggcccacatactataaaagggtcaggggaagcccctaatgtcattatgatggttctaaaccaaggacttctgactccttttccacagtgtagggttgtctcgtatattttttatagctgtgatggaggagctttagtcaaaatacgtctgggaagttttgaagcagttggaatattttacttcctaaatgcagcttcatcacaggtgatggaactctattgaaaggagaaaagccagggccaagatctccctgttgctaggctccccatagtgggtatctgggaacaagtcctgcagtcagagtactttaattagtgcacaatacttgcacaggcaggcaggcatactcacatgcagaaaagaaaacatttcagccattcaggcaaaagtctgtatttcacctgaatcgtaaagactgtgcgttttcaactcgtttttgtgtcagttttcatctaaaacttagcccccccaaaaactcaaaaggctttatcataattaccttaaatgaatttttgtcaagaggatttttacctgaattatcaggatatattctaagttttttctttactttttatctaaacattgaagaaaaactatgtttatctgaagtttaaatgcttttatgtaattttaattttgtaatgatactgcgatttcttgaaactcagtaaactggaccagagagtcagtttttaataactgataactaatatagcctccaaggtcctctaaggacttgtaaaacttttccttttaaaatactggttttctttatttcttctcttgacaccactaggttcactctctgccaccattcctcaatgtctctagtaagaatcaccagtaatagtgtgtactgttagagatgctcctgatggtggagttactgcaggctcaaatgctagctcctgcacagctaatgaattctgaacctgtgcccggtccaaaaaaaagtttcctgctccagacacagggtcatatgatgaaacaaactctcgaaatacaattccctttccttcctctgtggaacacactgtatttcataaatttatgaagtacacttatgtgtttgctttatgctttactgtctttagccatgaattgcaaagcatttcatatctaaatacgttttcgtagtattctacaaattgtaattttacaaaattttaatgttggaaaatagagggtttttttttactttaacataaatgttacattatgagcactaaggtcttattttgctttttagcacttcagtttcttcgtctagactggagtatatatgtttaaaggatgagcaaattaatatcttgtaagataaagtggttaaaacaaaatcccatgtaaccttataaagtattagcatcatcttcatcttatcatcacccttcccttaaagatgatctgtgtaatcatttattcaggaccatctagaagccactggcagggttagtcctggaactcagagttccagggccgcctttgctcagtgacaccaactttaggtcaggtggctagttctttggagtagagaaatagaattcagttgaccttagcattttggaaaatcagttggttaaatgtagaattgtcttcaaagggataattatggaataatgagccacagaaaagaaaatctctagcactttctgtcctctaaattacaccatttttgaaccatggaatgtattttggaagaggtagatcccttaagagtactcagaaactcccaactttgttttaggttctgcttttttgggggatagtatcacagtaatagcttgacatagcgcccctagtaagagtttcatagacttcattttcagagagaatctaacgtcctctgctggtactgtgagctggagaagccgtttctttttgttgctctgatattccctgcatgctaccaacatgttccacagagctgtaggccctacagtaaatctgcttggttagggcagggtgacagaaccttcaaatatagacccacttggattcagatgagttccaacagtggggttggattcttatggtgtctaaattatatagatttactttagaatattcagctcttcgtataaagatggccaagaaagattactcccaattttgggtcatcattggctcaccagacatgtgaggaggctaccttcttcccaatgctttccttgccagcatccccactccccactttttttttgttttttttctgacaatggcatattttactattgtactttcatacctacctcatggggtaagtaaatagaaagctgaggatgaagctagctcaaaagagggcagacacttcaaaatttgtgtttctatgactaacatctgaggaaatattttcatgctgaatgaaatgtcttcttcacttatgcttacatgttttaaatttttttaattaataaaaaatttagccttaatgagtttaaagctcagttttaagaaaaaaatctgtaaatatatatataatttaattttttttggaccataatcttgaaatacagaagtgcagttttacacataataaagaagggggagggaatgatcactttaccaaagaactattcatttaccaacaaatttatggaaatagtctgttaaaaagcaagttcccttaatacagttgaagtacttgcttttacagacataagtcatataatgcatataatacaaatggcatttcaggtatacttgtttgtgtacgagtgttttaataaagtgaaatactcaaaacagtaatttgcaacataaaaaaaatacaagctggcctgttgcttatttgtgtaactctaaggaatattacaaaagaactggtcacaaatgtttattaggtaaaatacgctattgagtaaatatattatgcaataatcatttcaaatctttgataatgaacccatcgcaatatctaaagtgttagttttattagatgtttttttcccccaggttttaattacaacaagaacggctgctgataattttagcacccagtatgttttagatggcagtggccacatactttctcagaaaccttcacatcttggtcaaggtaagaaagtagctttgtatacaaacattctttaccttttctgtcttaattgttggtttaaaaaaaaaaagttactcggtgaatacaaatatattgctttgggcttggtcctgataaaggctagttaacttccaagtaaacattcagcctttattctagccaccaatttcttaaatatttagaattgttctcaaaaggaactgtatgagagactggacacttccatggactagttactcctctgtaaaaactaagagtatttattttaccagtgctggattaccagtgtcatcttcatatatgaagaagattaaaattttattgaaacatataaaacataattgatttggtaatagtggaaataaacgataccatcaagatatgattaaataatttaaaatctatttgttaattgatggaaaacttcaaacatgcataagaagttactgtacttatcactcagtttcaataatttatcaattcattgctaaagttctttcatgtaataccctcgcccatttcttccctttctatattactttgaagcaaatacgtattgtttctacttgtaatgtagttagtgttttatatacttttatgtaatattattacattttaattgatatcttatgttttttattttattttattttattttcctgagacagggtctcactctgtcacacaggctggactgcagtggcatcatcttggttcactgcaacctctgcctcccaggctcaagtgatcctcccacctcagcctcctcagtagctgggactacaggtgcataccaccacacccggctaatttttgtatttttagtagagacagggttttgctgtgttgcccagctggcctcgaactcctgagcccaagcgatacacctgccttggcctcccagagtgctgagattacagatgtgagccactgtgttcagctgataagtgtttaaatttctctaaaaactatttacttataaaggtaaaaaagatctctttaggcttcagtttcacatatctcctttaatctttttttaataatttctagtgatgggatgattaagagactattaaagctattacctctttagagtcatgttcaaaataattattagatctgaaaagggacttgtgggttttgttgttgttgtttatccttctgcttctccaatttgtgttgtaaattcatgtttaattttgtgttccctcattgcagtttatcaaagtacattctgtatattttctgtggtttttttccttcagttttaatattaaattattggattctttttttcaaatgacttctgtcttcatttcatgtataaaatataaatttcttatattttaatactggtaccaaattctctcactcattcacttattttgtaaatccttagcttaattactgattacttttgcccattaggaattgatatttttgttccacataaaggagagagttaatagaaactcctaagacaatgcacattttttcctcatttattcagttaatgaaaatgagctcaagtctaacagctattttatttgatgtagaatgatacaaatattatatatgttttaattaaaaataatagattataattcttttactgtatatcaaaggttaggacagacagaaggcatttttaaaatatggctcctctctagaaatactctgaccccagttcttacgagttcaaattaggacaccattaggagatatttgagtggctatccagtagagtactttgaagtaatctagtcgccttataaaacttaaaggaatttatttttgtcttagtagtgaccagtctaatctggatggccaatggctttgcatcactcatacttctcatgcttttctttattcatctccatgggaactatgaaataacaatccttagatatggaatccatctgatctttgcccttttgctgttgattttccttttcctgctgacctcagtcttataccttaagtaagtgagaccaggtatgcatattaaggaatttctgtagtcaacaaatgaactttactttctttagtatatttcttttatctcaagaaacaagaataaatacttagaagatcagtagttgcaaaactactaattgcttttcataactcagttttttcacctaattatagttgattggttaggaaaacagcagaaagttaaagtcttaattttaagttgttcttggtggacatattatatatatctacaaacactttcaaaagccttttatgtttatattgccttagtgctgataggttttgagtgattgaatcacatactcatatttcaccagctgtcatttagcttccatttaaatattttctgcgtaagataaaattacagttcaaccatcctaatttatacctgtacatgtagggttcttggactaatttctgctgtgaggtgaacatccctgcttagcatttactcttcatgtcatctgatataatgatacctgtgggtggcataattgtaggtacgggaacaacttacaacataattttatttaggcattggaaaatttgttacccctttaaaaaacgtaatttattattattattcttattttgagacagagtcttactctgtcgcccaggctggagtgcagtggcgtgatctcagctcagtgcagcctccacctcccaggttcaaacagttcttgtgccttggcctcccaagtagctgggattgcaggtgtgtgtcaccacacctggcgaatttttgtgttttttttagtagagacagggttttgccgtgttggccaggctggtctcgaactcctgacctcaagaaatctgccctcctcagccccgcaaagtgctgggattataggcgtgagccactgtgcccagcctaaaagacatattttacaatgtttaaaaatagtttactagaaattccagctctggtttttctaggtgtatatttgttttatggattaattcagccatttaaaatgatttatgtgtttaacagtatgtcaccctaagttgcccttgccttctgttcacttccattttaaagcatttttttaaactaaaaagaaaaatagaaatacatctctatcttttaaattattgtaccaagaacatggagtaaattaatagctttagtcctatcattttctgtcatcacttctattccctttaccctagataatcagtattaagctttccaaattgatttaccctcctagtcagattcttttaagatcttccagtacttctgccttagaaatttctcatatatcaaaagtagtatttaaagggctgtgatcattttcctaccctgttactagagtttcagaacatcatgttctttgtaaattcctacggtgtgtgattgtgcgtgtattaaaagatcttttcatcttaatttaagaatggaccttttattccttaaatattttaagaaaactttctgatatattcaagcaaccatacctttacattaggaatataaatagctgccattataataaatggcataccatagggtcatgtaaaaatataacagggagcatattacaacactgcagtttaattctggtgtttgtaggatgtgctaaagttagagagctgaatgattttcttgtaaaacatgatagtataatggggcctcctccctattattggccaatattacttggtgcttttaaggaagcacatttctttttttttttttttttttttttttttgctttttgagacagggttcatttggaatcagaaaagacttttccataagtatgttttattcaaacatataattcttattaatctcaattggctgggcacagtggctcacgcctgtaatcccagcactttaggaggccaaggcaggcagatcttgaggtcaggagttcaagacctgcctggccaacaaggtgaaaccctgtctctcctaaaaatacaaaaaattagccaggcatgggggcgggcacctgtaatcccactgaggcaggagaattgcatgaacccaggaggcggaggttgcagtgagccgagattgtgccattgcactccagcctgggcaacaagagtgaaactccatctcaaaataatgataattctcattttactttcagaggatattttgaggtgctgaagcaataatttatcaatatacagattaggtataatgtggtcttagatacatatatttaaaaatcaacaggtatctctttttactttcatatacacatttatattttgccctcttgatttctgtcttccttctgtctagagctacagtgcatgccattatatttgtcatctaggaacttactgactagtggggaacacaggtgagtgaataatgacaaaatgaagccactgactgcctagagagaggttagcaagtttttcagaaaagatgacgtttgagtttgaagatggtaggagtttgaagatgatagataagaagacatggagtgtaacctttcggcaagagaaaaatgatggatacagattttcaagagaccattgctatctgcgtagcaatgaggggaaaaaacataattttaaaaacttgtagtctttaaactcattgaagacctgtgtcacagagaagtttaaatgaacaaagctcaagagaaacactacatcctcctagaaaagaagtgcctggtggccatttgcatccctgggagcattaactgagtcataggtagataaaggaacaagtcttctacaaataagggagcttttatggtacaaggagaaaccagctgaacttttatagccacttgtgggcagacatgacagattagaatatgggatcctcaaacagagctagtccaacccccacactgaatctcagcaggacttttgttgagtaaaaagtgattaagaaaattgggactgagctagagaaagaaggatcttaaaaccttgctagagaaagagacctgattccatcttcaagacatttgaaaccaaagacatttgaactggaactaaaaggttcaactcagataaactcctagttagattgaagagatatattcttcactctactcttggcaggaaacaaagcactttctctgggagaaaatattttcttctttagtatccttttatattcaatgtttagcaaaaataaaaattttgagagacttgaggagaggaaaatgggatccgtaatcaagagaaacaatagtgtaaataaactcatcaataacccagatgtttgaattaacagacaaaaaaaaaaaaacttatgttaaagaatttagaagaaaagatggtcaaaactggtaagaaggtagcaaatttcagcagagaaatggaaactaaaaaactaaatgaaaattctagaacaaaaagtactatgaagaattaattggttggacttattggagtcaggtcagtaaaaataatatgcaaacagaagcacggaagtagaatgagaaaagagcatcagagacctgtggggcaacattaaatggtctaacatgcctgtgactggaatctcaggagagagaatggggcagaacaaaatctgaaaaaaaaaaaaaaaaagtctgagggctgggcacggtggctcacacctgtaatcctagcactttgggaggccaaggtgggcagatcacttgaagtcaggagtttaagaccagcctggccaaaatggttaaaccccatctctaccaaaaatacaaaaattacccaatttttttgtgttttggcgcatgcctgtaatcctggctacttaggtggctgaggcaggagaatctcttgaacccaggaattagaggttgcagggagccaagattgtgccatacactctagcctgggcaacagagtgagactcttgtcttcaacaacaaaaaaaactaataacataattaagattgaaaaaagaaaatgtctgagaatgtttcaagatttttgaaaagatacaaagccacataccaaagagtgaacagaaccaagtggaaaaaaaataaacagaaccacagctaactacatcataattgaattaccgaaaaccagtaatgtgttggacaggagtgttgttaaggcagtgtattatactttaattggaagtgttttttcttttttagagattcataaaagtgtggcgctatttacagctttcatgaaatattaaaagcagccagaggagaaaatacattgaattcagaggaacaataaaaataatgacagctgacttcccattggaaacatagaagtccaaagaaaatggaatgacatcttttaagtttttaaatttaaaattacaggcgggtgcggtggctcacgcctgtaatcccagcactttgggagaccgaggcaggtggatcatctgaggtcaggagttcaagaccagcctggccaacatggcgaaaccctgtttctactaaaaatacgaaaattatctgggtgtggtggtgcatacctgtaatcccagctactcgggagggtgaggcaggagaattgcttgaacccaggaggcggaggttgcagttagccgagatcacgccactgtactccagcctgggtgacagaattagactctcaaatgaaacaaaacaaaaagacaaacaaaatttgatttagacttctataaccagtaaaaatgtttaaagaatgagtacaaagtgaaggcaatttcatacaaataaaacagagaatctcccaccatgcactacaagaaatactaacagggtttttaagctgaaggaaaatgattctacatggcaacctgaatctgcaagaaggaaagaaaagcactagaaaatgtgtggaaaaaatggaaagacgagtattttaaaaacttattttacaaaaacaaaatcagtatattgtggagtttatcacacagaaaagtaaaacgcatgacaaaaactttacaaaaggtaagagtaaatgaggtacactattacaaagttgttacattgtgaaatataatttatttcatggtaatcaaggtaaactgataatttaagaatatatgttatactcactgaaagtaatacaaagttatatagctaaaaagccaattaaagcatataaaatggagtactgagaatgacatgacagaattcagtgtaaggattttggagtagtagaagcaggaggtttagcttagaaagtggtagcgtaggtgttagattatgaagggccttttatatcataccaggtagtttgtaccttaccattatgagccactggaatttattttaggcagacgattgatatcatgttatttacaaaattaactagtaggattaatatgttatttacaagattaactggtaatttctactataaattttgtcttactgtaagatactgtcttcaactactagggtttgaggggagggaaaggacttgacataaattggagagactcctaggatagaatagatagacctataagacttatgcaatattgcagtaagaagtagagggaagaatcaattctttctgtagtatctgcctttggaaaccattggatgttggtgttatatgagaaaggaaggttaggtgtagtatcaaacccaaggaagaagataatgagttccagcctgagtgtggtcgatttcatataccttgaggatagccaggtggagttaatgagtgagcatctgtctataaaacttaaaagagtagtgtaggtctcagatatgtgtcttagttaaccaattctaagatgcacattttgtcacacttgacgtccctggaaacagattgtggcttataattaatggcctcccaaaatcctttttggaaaagcagcagttttggatgttcttattgttgtatcaattgaattttgtgcaatattaataattcatgtgttgattggaggaataaacaacttcatattttattgcaacaattgctttatgagagttaaaaagggaaatagtcacaactaaatgaagctgcattaagtgccaaaggattgctgtcatatgcaaagcattgaaattgatggcaccagaagaaattgccatattcatgggagtaaagaaatttcaaaggaatgagaggctgatgtgtccatttcatgtgttacacgggactgttgttaaggcagtgtatcatagtttaattggaagtgtttttttcttttttagagatttataaaagtatggtgctgcttacaacttccatgaaaagaatcattggcatataggtagtagttgaagacatgggaatggaggaaacatctaggggaacaaagaatgaagtgaggtctctgtgaataggatctggtatagattctggtgtgtgtgtattttccatttagcagtagaggcagaatgcatacctgctctgactgctaaatgcatgcatttcttgatctccatcagcttttgctccaaaatttggcagtgacctttttactttcctaagccaaagaatagtagcgccaaagaatagtagcaccaaagtgttactagtgagaactatgtgttctcaccatgttagaacatggtgttccaaggaatttaatcctgcctctggaagtgatgtatgcaggtaagccaaggaaatgctctatataaaaatagaggaagacccccccccaaaaaaaaatcattagtaatgttatatgctaatgaggcaccagatcaagaaaaaagcagaaaaacatcaagtgtgagcaaaataggaatattgcacttcctttagtctttttccacaaaaatcttttccccccaatcttcttttatttttctcttatagtaaatttcctttcaaaaattgcaagtactatgtgtcttccataaataaataattcagacaaatacaaactttattactttctcttattttctttaagtattcatttaagacttttttgttaaatgcctacagattattcattgttgtttaaggtgctagggatataatggcaaacatggtagttctttgctctcatacttgtattctaagaggcgaggcagacaaaagttttttcaagtagtgacattttctaaaaagaaagaaaacatagttccactgtagaagcagcagccttggatagggcatttaaggatggattttcaaaacatacgatactctgggccaggcgctgtggctgacgcctgtaatcccagcactttgggaggccaaggtgggcagatcacgaggtcaggagatcgagaccatcctggctaacatggtgaaaccccgtctctaccaaaaaaatacaaaaaattagccaggcgggctggcaggttcctgtagtcccagctactcaggaatctgaagcaggagaatggcatgaacctaggaggcggagcttgcagtgagccgagatcacgccactgcactccagcctgggcaacagagagactccatctcaaaaaaaaaaaaaaaaaagatatgatactcaagctgagatctgaaagagttagctgtggaaaggttgacagaagaacatgtacaaagggtctgaggtggaaacaattctgatgtcctctaggaacagaaggaaggacatcggtaggagagaagatagccatggaacaggttgtgtaggacagtgtaagctttaattcccaccccttttctccagttaaccagtgttactgatatggtttggctctgtgtccccacccaaatctcatctcgaattgtaatctccatgtgttgagggagggacccgtaatccctatgtgtttagagaaggtggtgattggctcatgagggcagtttctcccatgctgttctcatgatagtgagttctcacgagatccaatggtttttataagtatttgacagttcctccttcatacactcacactctctcatgccgccttgtgaagaaggtgcctgcttccccttccgccatgaatgtgaatttcctgaggcctcccagccatgtggaactgtgagtcaattaaacctcctttgtttacagattacctattccagggtaatatctttatagcagtgtgagaaggaacggactaatacagttactgataacagtttgtaacattgagttacaagctactgttaggccttctcagacttacattatatctcatgaatctttatttaagttatgttgcaaagcccacccacattagcatcttctgtttacagtcaaacttttaagatgctttgcacaccacatttattttctcatcttgttgtcacaaaatgtctttttttccccccttagaaacagggttttgttctgtcacccgggcttgagtgcagtggcacagtcatagctcactgcagccttgaactcctgggctcaagggatcctctcacagcctcccaagtagctaggactataggcatatactaccatgccagactaattttttatttttaaagacagggtctcactgtgttgcccagtctggtctctacttcctgggctcaagccatcctactgcctaaggctcccaagtagttgggattataggtgcaaccaccacacctggtgaaatctctattttgatattatagtcatttggttagagtttatcttccattattttcatcaaatacatttgggtgctatacttctggatctttgcaagtccaaaaatgtcttcattttgccctatacctatcttaactgggtgtcaatttcttaatttcttcttaatagttagtaaattgtttgtcttctagtgttataggtgagaaatttgatgttagtcttttcttgtaagaaacttgttctttctgtatgacaatgtgtaaaattcttttcttgtcctcaaaatttaggatttccagtagaatgtactttcttttttcttcctaaaatatttctccttataatgaagtaagctcttgaaatctgcacttaagcctttaactcaaaaattttcttctagtatttatttaattacatctccatttgtttctttttctccttttggaactttaaaactaccagtaatttctttttctcctcttggaactttaaaactacgtaaaattttacactacagtttcaaagtcttatacgttccttatgattgccattttctttgtgtttttgctctgtgttataagcagtaggacaaaaattgacctattgcagcaacttcagcctttttgactgattcacggtaataaatatattttacatagcaacccagttcacacacagctaatcaaaacaaaatgtcatgacataatatttatcctaactataggtgatgcactctatttttctagtttattctatctttttattctattttatttttaaaaaaaaagatggtagtttttaaatactaaatcagtggttctcaaccaaggcaactttgtttcccagggaacatttggcagtatctggagatatttgattgtcacaactaaggaggatgctactggcatctagtgggtaagaggccagagatgctgctaaacattctacaatgcacagaacagtcccccacaacaaattacctggccaaatgtcaatgctgcgaaggttgagaagcactacactataaatttatttcattactcctcagtgtaatgattctctactctgactgtacattcataagaatcacatggggagattgatttcataactcagattaactggtgactagtagtttttaaatgtttcattcttcagtgttttaaaaatatgtacctatgtacctatcgtatatggctatgacaaacattcagtcctaattttatgtggtagtggtgtttttttgagtaaaagctagtggttaatctgatagttcagcagtataatttttgcacctttattcagctttccagttaaactataagttaaaaaaattcttttgttaggttatcctgtgtttttgaatgttgttgaaaatgaggtaaatttaactaggttaccagatattatttcaggtaagaatttccagtaacataaggttattatataaactgtaatattatatctcctataaattatattttaaagtccagaataagcaccattcccaggtagtttgagcacagcagatttcttatgatactgcgttcttgtaagcccatgtttctacgcagtgatagaagtaagattatacttctttagaccacatagacgaggtcatacttcgtaggtcagtcttgttacaaatagaagagtctagcatggaatcagagtagtttgcaaagttgagcctttgggtttctagaattggaggaggagaccttcagttatagaaggggttaattacaaattgtatacggatttgaagatctgtgacgttccttccaaatctaaatgtgcttttctcttgtctgccaacaggtacaactgtaactgctttaagattatttaagaatctacctgtaagaaagcagttttactcaactgcaaaaaaatgtaaagatgaaataaaaaagatccaagatctcctcatgagctttggtatccttaaacctgacttaaggattgtctttgtacataacaaggtaaacattattttatctttataagtttctgggtatatgatataataaacaatgtatactttataaatcagttagatatgggctatgactaaatgtttgtgtgccctcacaaaatttatttgttgaaaacctaaccaccatgtgatgttattagggcatggggcctttgaggagtgaaattcatgctcttaaaataaaggagacctcagagggctgccttccttcttctgccatgtgaggaggccactacatagtcagaggcaccacctatgaaccagaaagtgggacctcactagataccaagtcatctggtaccttgatcttggacttactcagcctccaaaattgtgaaaaataaatttctattgtttataagccacctagtttatggtattttgctatagcagcccaaagacaacatgtaaagagtctttttttcaaaatgttagtccacatttatctagttttatctttattacataaagagtgtctttaatttgttgcctaatatctatatgatctgattgaacttttcatttcttaatctctgaaatcagggattcccccagcagacgtttttcatctaagaaatggcttgagtgcttccttttatcgggtgctgtgatagattctcaaaatatgaaaatgagtaagactggttcttttcctttaaagacttcacaatttagtgacatttttcaccctctacactgttgattctttggaagagtgtgtgtgtcaggaggatacaagtgtaattttgttacatggatatgttgtgtagtggcgaagtcagagcttttagtatatccatcaccagaataacataccttttaccttttaaataatttgtcatcatccaccctcctccctctctacctttgtgagtctccattgtctatcattccacactctatgtccatacatgtggtttagcttccacttataagtgaaaacatgcagtatttgtctttttctgagtttcacttaagataatgacttccatttccatccttgttgctgcaaaagatgtgatttcattcttttttatggttgaatagtattccactgtgtatacatacacattttctttatccatttatatgttgatggcacttaagttgattctgtatctttactattgtgaataatgctgtgataaacatatgagcacaggcgtccttctggtataatgatttcctttgggtagatacccagtagggagattacttggtcaaatagtagctctatttttagtttttttagaactaaaaatactgttttccatagaggttatactaatttacattcccatcagcagtgagtaaatgttcccttttctctgcatcctcaccaacatctgttatttttcatccttttaatcatagccattctgactaaggcaagatgatatctcattgtggtttaatttgcatttttctagtgattagtaatgttgagcattttttcatatgcttgctggccttttgtcttcttttgaggaatgtcaattcatgtcctttgcccactttttaatgggattatttgtttttgttttttgagcttcttataccttctggatgttatctctgttggatgcagagtttgcaaatattttctcctattctgcaggctgtctgttcactctgttgattgtttcttttgctgtgcagaagcttttgagtttaaggaaaactccagctttctttccatttttcaaagcgccgataagagaaggtagtcatcttgttgcttggtgaatcttaaaggaaagaaaggtttatatattttctaattattctgtttatctaatgaaatttcacatgggtatcctgcaggaaagcaaactacacagcaatgtggaaacctgatgggaaatagggaattaacatctattgagggcctacacaatgccaggacctgtgctaggtgtattagttttctgtaatcctcacagcaacaaccaagtgatgtagggattatatcagttttgcagttgttctctgaatggaattcagataggtttaatactttgctcattgttgtgcgactagtaaattgagatgggatttgaaacttaacatgccttcagagtgctttgctctctaccatgctctcttccttttttttttctttccttttttgagagggtctcgttctgtcacccaggctggagtgcagtggcacgatcacagctcactgcagccttaggctcaagcaatcccttccacctcagcctcctgagtagctggggctacacatgtgtaccaccatgcctggctcatttttaattttttttgtagggatatggggggtctccctatgttgcctgggctggtctcaaacttctgagctttcaagcaatgcaccctcttcaagcaatacacgctcccaaagtgctgggattacaggtgtgtgagctactatgcctggccctttttcctattttaatactactttatatttatatagttttttcccatgtttcagaacagttacaataactttgtgagatagaaagcattatctctgtttatatgggggaacttaaagctcagagcaactaatggaattgttttatattttacagtaatagtgctgaggtcagaaccctttttgatccagttttcttattgtcaggaagattctttattaaagctatggtagaatgtttttgatcaaaatctttgatcatttaaaataagaatagcaacctgttcttgttggcatagagctcaaccaaatgataccttgagatcctttccagtgccaccgtgctatgattccttaggatgttgatggatggaggctcatcctattaataaaaataaccctatgacctctggatccagaggatatttagtaataaaaagtttgtccctaaattaaaaaaagaccaacatcagaaggaacataataattaggaaggaaaaatagatgaaaaaggtaaaatataaagagaaataggaattatatatttgtaaaagaaaagtgggctgggcgcagtggctcacacctgtaatcccagcactttgggaggctgaggtgagtggatcacgaggtcaggagatcgagactatcctggctaacacggtgaaaccctgtctctactaaaaatacaaaaatgaaccaggcatggtggcatgcgcctgtagtcccagctactcaggaggctgaggcaggagaatcacttaaacccgggaagcagggaggttgccgtgagccgagattgcgccactgcactccagcctgggctacagagggagactccgtctcaaaaaaaaaaaaaaagaaagaaaagtgagtggaagagaaatctttcgagttagaaaatataataagtgaaggctgggtccggtggctcacacctgtaatcccagcaccttgggaggccgaggtgggtggatcacctgaggtcaggagttggagaccagcctggccgacatggtgaaaccccatctctactaaaagtacaaaaattagacgggtgtggtggcagatgcctgtaatcccagctacttgtgaggctaagacaggagaatctcttgaacctaggaggcagaggttgcagtgagccgagatcgcaccactgcactccagcctgggcgacagagtgagaatctatctccaaaacataaataaataaataataggtaaaaacaagattattacttcacgtgataaaaatgaatatattagaaatatttgaaatgacagagttcttatttcaagtcaaatatgtatcttctaagtttttttgagaggtttatatcattttcccaaccaatgtaagattatcaatgtgggtattttctttagaaattggaaagcaggcgccccgccactcgctctccgggcggggcgggtggcgcctcgggcctccacctccccctgcctgcgcgtgtcctgcgtgagagggcagaggcagggtggaggcgttggcacgggacatgtgggccgcggttgccgactgtggcgcgggcagtggaggaggaggcggggctggcgctgaagtcggatccggatccgttgctgtgcaccctggtcggggagagtccgatgcgcctgggtaggagcaccgactgcggggcctctaccgaccttactagaaagatgaaacctgatgaaactcttatgtttgacccaagtctactcgaagaagtggactggaggcagaatacagctacattttctccagccatttccccaacacatcctggagaaggcttgattttgtggcctctttgtactgctgacttaaatagagggtttttttttaaggtattgggtcagctgatcgagactggagttgtcagccctgaacagtttatgaaatcttttgagtatatgaagaaatctggggattatgttacagttgtagaagatgtgactctaggacagattgttgctacagcaactctgataatagaacataaattcatccattcctgtgctaagagagtaagagtagaagatgttgtcgttagtgatgaatgcagaggaaagcagctcggctaattgttagtatcaacccttactttgctaagcaagaaactgaactgttacaagattacccttgaatgtctaccacaaaatgttggtttctataaaaagtttggatatactgtatctgaagaaaactacatgtgtctgtttctagagtaaaaatcttataagaaaattgtcaaaggagctaatgctacaaggctccactcttcctagagttaaaatattttgttgctgcagcagagtgacctccataaatagtagactgagaaaacattgtaatactacaagtataatgacatctacgagattactttgggctggtgggaaatgctgtgaatttagattacaaatgaatattataaaggggatttttttcatctcttttttctttttttattttattttacataattcatgtcttgatctctaaaactaggcagtcacctttaaaactttggatctttaaaaacaaataccccgttactcctaaaatttaactgaaaaaactcacagatttgggtttttttgttttgtttttttgttttgttttgctttctgcttagattttatttttatttttttaatttatttttattattgtactttaacttccagggtacatgtgcacaatgtgcaagtttgttacatatgtatacatgtgccatgttggtgtgctgcacccattaacttgtcatttacattaggaatatctcctaatgctatccctcccccttcctcccaccccctcaacaggccccggtgtgtgatgttccccaccctgtgtccaagtgttttcattgttcgattaaggggatgatttttaaccaagggaatatattttaaacttgaatcttttcttgcattgtatttttccaaaagtttggcttcatttcttggtagttaagagtatgggtaataaggagttatatgtctgccgtgttgctcatttaaaaaaagtatttattgaataaggctgttttttatcacaggcataaaatttaatctttttgtttcaaagaaacatctcagtacacttaggggtgtatcgtttcccacatataaagtatttattgaataaggctgttttttatcacaggcataaaatttaatctttttgtttcaaagaaacatctcagtacacttaggggtgtatcgtttcccacatataaagtcaggctggataaattagttattataactaaacacagtgtagtccaacatttgttgatcccaatacaggcaaataacctggtcagccttttaaagaagtagaagaaatgaaaattatttgacaagattaaaagtaaaacaatttaaatgttttactaaaagtttatataggtctatgtagataaaaagtaccacttgtcttatctgtgaattataactgttcctttgttaaaaacacctaagagcaattatggtgggacatctaaggtactttttaaacagtgaattagcaaacctcagcatatgtgtttctaccttgatttttttcttttcatgggtatctgaagcctcccttctgagtaacaggtttttcaaaaatggagtatcacaaaattgagtgaaatacaatactgaaacaatacttaaaaatatattgtaccagatttgtcaaattcataaaatgttgatggaagctttactttttagtgtgattataatggcactattctggtcattatcctgtttttattttatttattttaattattttttaaagttgaagaattaaatagtttaatggttctaattttttgcattccatgttacattaaacctgttcatatgatgagtaattttctgttaggaaataaaagaaattggaaagcagtatttatagtgtactacattttattattttcggaggacactgtatcagaacttatatttagcaaacacaagttcctctatagccttcagtaatttcagatgcagttcaaatcctggagagtatgttgaaatgattatactgtgaaagtaatataaagtttttaaaagtctttttgtaaaattaagtattagctattatagagagaaatcatggactgaattagaacaagctatttatgttcaagcttttttctcatagtagatttttttatttttatatttcttaatagtgctgttgcacctttaaaatgttaaaatatattgttaaacctcccaaaatagcaatgacatgttactataaatctctttgaacattgagtcctactttgctcttagcctttttcttttaagcatgcctactttcatcattctatatgtacttttttgtaaagaatttttttgtctgcttagaatttaaacctgacgatattgttgtctttattttttttctgcattagagacaaacaatcatattgcgcataatacgagaagtactattgctattttgataacttggattagatagtgttctttctttttatgaaggtttaacctgccaagacattctttgaatactgataatgttgatgttcttgccagtatggttatgttagaaagaggtatttttcttctttcatcaccatgttccttgaaagcatagtgaataatgacacagccaaagggaaataatttacaagtggattcagtgagtttatttaaagtagatattatttggagaactgctagagccattccttagatgagcactacagaagctttagttgtaataactgaatccctgtgaggtcctactgtaaatatttttatttataaagtagttattttgcagaattaacagttttttctcaatattatagtatctgaaaccactttagtattcttagctatttcatatgacaatgcataatttcctagaccactagttcagaacataatgtgaaatgtatgatttcaaataagggctactcctatatacattataattgctgatttgtgtgtgtacttgcttttccaaaaatattatttgtggttttaagaattgttttgattgaattttgttttgataattagaggcccactggtattgcaaaagctgaattggatgtcattgataaaagaaggttttaactgttacgaaagagagacatgaattaaagaatgttttccttcctattcccacttctatatcacatgagcattaaggcttattgagatgttggttttcagtgttgtctttgtttttgttgttgttgttgtttctttgtatgttttgtgctctgtaagaatgatgtcagctccgaagtgttgaatatctctgaattcagttaatctgggaagatgcaggcccttaaccaggaacagagacccaaaaaactggccgtggagatttggcagtgagtggtggctgaagatttggtttataagatgaagataaataagtgatgccctataatatatatcccctgcactcatgatattctccatggtcattttatccttctctaaccttttacgtgatcatcttgaatgtcccaggtttgtttcgcctgtgctatggggaatcaaagaaaagtcttttgccgcatttggaccaatgttaagggtcagttcccctcccgcaatcccagccaggaatgtggagtcagtataatcagagagaggttctaattcaggagtgtggctcaaatgccccttccttaggaatgaattattccagtgccaatctggaaagtttgggtgtgttttgtttttgtttcttttttaattaaagaaggcggacatcttttcagatatattttaagattagcttggggctgattatcaatatggtttggtttggggtcttttttttttttttgctacttacaaattaatgattactaaatttattaaatggttttcatgtgttcctcttttgttaaggattacttttcacctaaattttgtgaaatatagaaaagatgaaagacatataagtcaagttttagtgtagttttatgtttgtaagcactattaggagtctctgaagtcttccattatccctcagtaggacattattcctcaactgctctcattttgttttccacgtatttctgttatgtcattttgcttcagtggcagtgatttgcattctttctttcctatttgacagccttttataggagggagggctgcatctagttcatctatattccccttaatagtgagtgcatagtacaggatggaatattaaattaattaggtagtgttaaagccaaaatagtaagtgtatgaaacactagttttaaacactctggcctctctcagaccttattcataatatttattaataaaattcattcttttgaattccttggtgacctcttatgtatttagggagtatattttcacttgtattcacatatacaattctagtccattgcccttcctggaagctaagtcactgatacatcttctttagaactaataaagaatcatataaagactgcatggatggggcagttgaggggaaacacttgatggacagtctctaagagctgtcaatttaatgtattttgttgctattaacagtcaaatagaacaacataattgttcctttactgatcctctaaccacatacattttatatacttattattaacccaaacacacatttctctattccaacactgtagatttctcttccaaacaataatacccagagaatcctgtacaaatgtagctttttgagattaggccaatgaaagtcaatgacatgatctctaaggccctttttaactctaaaactctttgatttttaaggatgtttacatatgtatatcttgagcacttcatttctttcttagaaaattggaatttcacatttttacttagaagttctactgagttcatatatgaaatcataaaataataaaaggtagaaagttctgcaataaacatggttatgcagatctctttgacatactgattttcaacctaaatgcccatcaaatgatgaatggataaagaaaatatcatgtgtatccactgtatatacaacagaatgccatttagccataaaacagactgaaatcctgtcgtttgcagcaatatggatgatctcggaggacattatgttaagtgaagtgagccaggcacagagagacaaataccacatgatctcacttatatgtggaatctaagaaagttgatttcatagaaatagagagcagaatagttgttaccagaagctggggaggggagggagaaggaggaaaactggaggggttggtccatggggataaagttatggttaggaaaaataaggttttgtttgtttgtttgtttgtttgtttgagacagagtcttgctctgtcacccaggctggagtgcagtggtgtgatctcggctcactgcaagctccgcctcccgggttcacgccattctcctgcctcagcctcccgaatagctgggactgcaggcacctaccaccacgcccggctaattttttgttttttttagtagagacggggtttcaccatattagccaggatggtctcgatctcctgacctcgtgatctgcccaccttggcctcccaaagtgctgggattacaggcgtgagccactgcgcccggcccaggaagaataagttcttatattctgtcacaccgtagggacactatagcaaataacagtgtattgtgtatttcaagatatctagaagagcttttgaatgttgtcatcacaaagaaatgagaaatgtttgaaatgatagggtaattgccccgatttgatcattgtattatgtatacatgcattaaaacatcacattgtacctcataaatgtgtaattattgtgtgtcaattataaatttaaaatcaaatgctttaaacactcaattgcagagttcactggtaaatacttcactgtaataaagcatctctcacaatgtatctctgaagaaacattctcagatttagcttttcaacctgtatatgtaaactcttcacagtgtcacagtggtaaaattaaaatagttaaaaatcatgctctagatgaaaaaactagattatagggtttactggtaaacattaagttcactgtaataaataagctcacaatgcatctctgaagaaacatgcccaaacttagcttttcaacctttgtatataaactctgccataagtcgcaatggtcaaaaccatagttagaaagcatgttctaaacatttgatgacagagttcactgattggtaaacagtttaattcactgtgagaaagcagctcaaagtgtgtctctgaaaaaaaaaaaaaaaaagaggacgtagaaggatccttagatctttacatctgaaaagaccactgaaaatgttttttgtcctgcctcaaatcttttagcaaatagtgtttttaatcctgtccacctccccttttacctttatgtgaccccaagagttttagtggattgcccaatgacttaaacattgaatatagtagaggatgaactacagttcacatatcttaatttttaatgcatcattcatcctcccttactgtagcttcctcccaccaactatactcagagtactgagtaggtgctttggaagggttaagtgatggcttgcactctgaagaaagttacgatgtaaatgaggagataagatgtgaaagtgtgtaaacataacataaatataccgtagaccttgtcattgcccaaaaccacactcactccataatttcactgttaatgtgttccttctctaatcactacctgatgcctctctatcttactctcttcaacaatccttagactctgttggacctgtgatcccttgttcctactgctttttaactgtttcttgccccctggtgtccttggttctctccttaccctgcttaaattttgtggtccatcattatcatccttctcttgggcactctgtcagttctcttggtcctttctcacttaattgtacttgtttgactaaatcctgattaaatccatctggtcatcattttggtatctgagccagtatgtaggggaagaaaacccacacccatgctgaatagtgcctctgtaaattcatgagcattaatcttcatgctgccagacagtcatactcctgtttttccagtcagcaaaccagaagccttagggttattcttcgctactgattctctcacactctaatctgattccagagtaaattccgtaggtctatctttaaaatatatccagaatctaacgacttttcaccatgtctgtgactaccactgtggtccaagccaccattatctgtcacctggatttttgtaatagtatcctaatggactctccctgcttacttcttatcctcttcagtgtattttcagctcagtgattctgtaaaaatgtgtcagatcatataactcatgtttaattagttcccatctcattcagagtaaaatcaaagcctttataagcggactgtgaattctctattggggtcagtatatttttttctgtatagagtcagatggtaaatatgttaggtttttagggccgtatagtttctcttacagctgttcagccctgttgttgtagtgtgaatgtagccataaacaataatactttatttacaaaaacaggaaggccatgggctgtagtttgctgacctccgtagatctgatgcctcctttacctctgatttcattaatctttttccttttgctcattttgcttcagttgtttctggaacctgcgagtcatgcttccagctcaggactgtcgcatttgtagtttctttgcctagaacattttccctcaagtaactggttcaatcctcaacttttaggtcttcacttaaactttctccgtgaggctttctttagccttcctaaaattgcaaccatttcccctgtccccccgcttccccactttcctgctttatttttcttgaacttatcagtatccaatatgctatatattttatttgtcttgatttattctctctcctcctctagaatataatttccttgaagggaaggactttggctcttttttcactgtcatatccctagtgcttacagtagtgcctcaagtgggtgctcaaaaaacatgtcaaatgaatgagggctgacaacaggatcaagggctgagaacaggagcactccattatgctggtggcaccagcccagctggactgtaagcgtaggccttaaagcacctgagatccagaagcagatggtatcagtgtagattaaaggtaacaactggacagagagatagcaaaacagcaagtattagctctcatactctagacacttcccacttctattggttgggagacttctagaaagtcaccaaaaagggaggggtgagcctggccacttggtaggtgggtggtattcattcagtggagtaggaacaactctgaacgtgattttcatctaggacccccaggtggttgggttataggaaaattttgttacagcagaatttggttatgtggataaaatggtcaagattattctaagtagagatagagaaatagtttaaacataaaatacataggcaggagagcacatttagaggcagtgaagaagtttctttaaatgagttggtatttaatatgagagaatagaggaagataaatccagcaatttaaactttttaaatgagaaaattggaaggcattaaaagtttttaagtagggaattgacatgatcaagatgctgctacctttgaaagtcagtttggcagtactctacagggaggagctagggagaccataaacatttaggaagctgctataaattgtaggctttaagggcctgaattcagacaaacacattaggtgtgaaaagcacaaagtgtctattttcttttatagctattatgaggaagaatcaatgggactagctgtgagtggcaaaggaccagaaaaggtttgaagataactgatttatttaacttatatgcctaaggaaataatactgcatccttttttaaaccctgaatgcacacatttgagtttctcctataatgtattaccttcatgaattacactgacataattttgattttactcctaaaagaagcttatagaaacaaaacttttaaagtgaaatcattactgcaccagtagagagttgttagtcaattcagagagaaaagctaatcagctctaggctggatagtatttattttttaaaatttaaaaattttttttttaagacagaatcttgctctgttgcccagggtggagtgcagtggcatgatctcaactcactgcaccctccgcctcccaggttcaagcaatttctggttatttttagtatttttagtagagatggggtttcaccatgttggccaggctggtctcaaactcctgaccgcaaatgatcctcccgcctcggcctcccagtggatgttatttgttacccttaaaacttgttgcttgttttgaaaaaaggcccagaagtagaataaagaaccatattgttgagatgtttgcctgaacaaaataggttgtatgggaagggaaataacattggttaggtaccagggagctagctgatgggagtgttataagctcagtgtctgtgtgtttggtcttaatttgaaggagaataacttaagaatcatgtagaggatggagttgtaatgcagaagagatgattgggatggcttcattttgaatgaaaaacaatgtaatctatagggtgttctattaaatgaaaatagtaaaggctgaaatcaaatactgctatgttgttacaaagcaatagcagcttgatttgtgagtaaccttttctgtaaagtcaaatatgttagaaatgagcaattgcctcagggttcaaagactgaagaacttatcagcaaggctgaccagaagggttttcttttttttttattgagatggagtctcactctgtcgcccaggctggaatgcagtggcacaatctcggcttattgcaacctccgcctcctgggttcaagcgattctcctgcctcagcctcccgggtagctgggactacaggcgcgtgccaccatgcccagctaattttttgtatttttagtagagaccgggtttcactgtattaaccaggatggtcttgatctcctgaccgtgtgagccaccacacctggtcacgttttctttaaacagtattaagaagtacagataatatagaggcagagaagagagcttcaaatattgtcgtatttacctaactttagtgctgtttgaaaggtaggtagtgaactttagaaggccagttattgaaatatttgttacttaaatagtagtctcctattcctaaatcattttattatgtattttaaataataaaatacaaaatggatactactgtattgaacagctcctgaatattattactagtgtcaagaccaaccatctccctctgccagctttgttcttgaaaacagaatgttacacattttaatgtggtaagtgggccaagagagttctaaaaggtacgtttttaaaattcatccccaatgtctaaaaacacacattaacttctttttcttcttccttttctgtgtgaaatttgagtaaacttactgttgatttgcttctcatagaatagtgttgaccttttctcgtagttgcagtgacctatatttaagttaaagcttgagctggctagtataagaaacaaaatttgctttccattagttatttaaatatagttaatataagaagtaaatttatggccgggtgcagtggctcacacctgtaatcccagcactttgtgaggccgaggcaggtggatcatgaggtcaagagaccatcctggccaacatggtgaaaccccgtctctactaaaaatacaaaaattaactgggcatggtggcacgcgcctgtagtcccagctactcaggaggctgaggcaggagaattacttaaacctgggaggcagagattgcagtgagctgagatcacgccattgcactccagcctggtgacagagtgagactgtctcaaaaacaaaaaagaagtaaattcattttcatttgggtaattaaatatttcatatataccaactgatactttttcattaggctttgcttataaactttaaatgttataatgatatgattatttttaaaaacctgaaccccccctacttccctgctggaagaaaccatacctgtagcagcactatgtgggagacttgtcttgatggatgagaataattcttaattaatcttttttcctttatttgttataggaagtgctttagatcttcaagatttttacttttgaggaaaaaattatagaactttcagagaccaccacaatcttcctttcatccttaggaagaacttacttaactacatatcaataaaatagactctggagcatagtttccagttctgaccttacatattgtcactaactggcttacattacgtgtctaggcttcaatttctttgtctctttaaaatggaataatagtacctaccttacagagtaaggtttttaaatgagagcattcacagcacagcgcctgctccataagtactcagtagaggttaattgctattgttattgatgtgaatattgtttaaaatctgattagagtcaaaaaggattattagaggaagtggccttaagactggttcttcggaaagactatgtgggcagaggtattcaaagcagggagaacagcatgtgcaatgtcagggagtcatcagaggtcagagaaagcttgtctaagaaatgagatgaggctacgaagcttgcttggagccagattctgaaggaccttgtgtatcttacatgggaatgtgtacttcttgttgaagtgaccaagagggaactaaatgagacatttcagtaggagactaacaaaataagataattctcattgcagttggaggatggactaaattatgtttaattgttgttaagaatgtggaaaatgatctcgttgtctggcaagttacacaaggaatggagaagagggtctaggcaagaaaaatatttccgatgtaaataagatttgattacgaattggaaataatctttcttgtttttaaagactgcaaagaaatgagtctcaacaatatccctttgaaagttatgcagagattaactttatacctttacatttttattaatgttttattctatttcattttatttttagagacagggtctcactctgttgcccaggcttgagtgcagaggcatgatcatagctcacttcagcctcaaactcgtgggctcaagtgatcctcctacctcagccttctgagtagcaaggaacacaggtgcatgccaccataactggctaattttttaattttttgtagagacagggtctcactgtgttgcccaggctggtcttgaactcctgcctcagcctcccaaagtgctgggattacaggcctgaaccaacatgcccagcttattatttaattttttaaaagatcatacctttacatggttgaaaacccaaaaatgtatgaaaaggtagaatgaaaaaattattcttttctttatctttcatctgcctagctcctataaactgccccttctttaggtaaaatgtctattaatttctttgcaaccttcaggaaaaataattatgcatgttctctttcaagaaaagaatataaaattaaataagtgtaagagattttagaactcatttatactgcataaattttaccaagacaatcatttttgaaagtttgaggctgcttagcaataatcaattcatattaatgtttattatgtcagtagaatgtggtttgttcttttaacagtagtattgatactgtgatggaataatctataattttatactgaattcaaaacatttagcagtgtcttagtggtaagctgctgtggctcatattgttcctgtgttgccaatgtgggaaataaaacaaccttttaaatattgtgtttgtgcctctgtactttttggagtcagagtcagtgcaagtacatacgcaggagtaaataataatagatatagatctatttatagtaacttgtaagatcttagaagtaaacttatggtacttaagaaatttgcctgggtatggtggctcacacctgtaatcccagcactttgggagcccaaggtgggaggatcgcttgagtccaggagttcaagaccagcctaagcaacatggtgaaaccctttctcttcaaaacgtacaaaaaaattagctgggcgtggtagtgtgcacctgtagtcccagctaatcgggaggctgaggcaggagaatccttgagtccaggaggctgaggctgctgtcaactatgatcacaccactgtactctagcctgtctcaaaaaaaaaaaaaaaaaaaaaattcattggtgctgcttcttgtttggtggaaaaaaaaaaatccaaatatgagcttagtacatctgtgcctacaatttgcaagaattttggctgcagtctaggccaataatatatcctctttatttagaaggagttgactttgctcaagcagttttagcattgtactattcacttaactatgcatcatctgtgtgcagcctacatttctctttatcacaaattgcctttacaaacaattgaggtttactaattaaatatcgagtattctcatctaacttcattttcttcaagtagcgtatgtcagtgaggtaggaattaggggcaagatatatttggctaacttcaaacctaagatggtgtgcatgtaataatatatttttgaggtgtttttgcactgtcatcatactgactagagtcagattcttagttggcacatccaggtgctccaactttgtgtgacctagatagaaaacatatggaggtttgtgtgtatttttagcacatgttaagctttcggcctaagggcaagatttacaaaaaccttcaggaagtgaaaagaaaatctctgtttttgaaaataacatagaattgatgaaacggtagagaaagcaaactgaatactgtattctggattcccagtattcccagttcttattcatcacattttatagtttagttttttagtgatgggtcctgttttgaaaatgaatcttagttgcccaatgagaagattttacttgttggcagaccgctattatttattgctagcccaagtgtaactagtttagaaaatgctcttaaattagcccctcgatctgatgcaataaaaattgcctagtgtgaaataatgctcccagactcctagcatgtttactttaaagtgaaatcacattgcatagttctcatgtttcacagctttttctaggaccgatttcctgaagtgatctttttacggttgtgtatactaactattcagcaggtcaggcagtgaaatagcatccttgcattaatcagcagctaagatttatatctgtatctaaggcatctaatataaactaaaataaacaagatgatgtttacattagtaacactgcaggctttttagctatattcagtgcaggaattttaaaacattagttttttgaaatatttccttgaatgctttattttaaaaatgtcaatatcagagagttagcattcctttaaagaggtacactttttgtgaataagtttggtgtttttttttttttctttttagggagggggtcttgctctgtcacccaagctggagtgcagggtgagccactcccacctcagcctcctgagtagctgggactacaggcatgtgccaccatgcccagctaattttttattttttttttatagaaacagggtcacactatgttgcccagtctggtattgaactccggacctcaagtgatcctcccaccttagccttgtgaataagtttttatggttcagctattctttgtcataaggaacttctgatgtggaaagtatgaagcaggggacatttcatttcctgtaattgcagattattcagaaccttatttacttcctttaattttgaacattgttccttaaattattagctgttggctggcttaaaactagagccataatagcagaagccagtagtttgcctttccagagtgcatgtgcacgcaaagattacagtctggcagttcttcaaaaaacatggagctaccatgtggcccagcagttccactcatagatctatacccaagagaaatgaaaacatatgccaacataaaaacatgaacatgcatgtttatggcagcatcagttataatagccaaaaagtagaaacaactcaaatgctcattaactcataaaaggataattcaaatgtattatctacaatggaatattattcagccatttaaaaggaatgaagtactgatataaataaacttgaaaaggttatgctaagtgaaagaatccaatcaaagaccatatattgtatgattccatttatatgaaacatcctaagtgggcaaattttatatagagagaagatagattagtgattgaaaagggataggagtcactgatgatggatataggttttctttttggactgataaaattgttcaaagattaaatcatgctgttggttgcacagctctgtgaataataaaaaccattgaattataaatctaaagtgggtgaattgtagagtatatgaattataccttaaactgttatgttaagaggaaagaaaagcaaagattggtttggatttccttaggtcaagtagtagacaaaaagtgtaattttaacaggtatggtggtgtgacaactagcagccttatctctgaaaacaaagagctagttttcaactctactggggttacttttccctagggaaaaaaaaatgtgtttatttgctcattcctttaacgaaagtatttagtatttagtgggccttactaggtgtctggtactgttcttggtaccagagactcaacactcaacactgaacaagctgaactcatcatcttcctgccaccaatcctgctcttctgagtttcttatcttgttgagtgttactaccaccattccagtttcccaggtcagaaatctgggaggcattcttgattcttctctttttattccctctccacatggagtcagtcatcaagcccatttcgtaccctttagtctgtccgttttctcttttcctcctaccagagtgttggttctgttaacacagcccagtaattctcagccgcagtatattaatactagtaaagtaccaaagtttgcaaatggtttatcttaaaaagcaaacgaaaaaaacctaagggaataatcctgtcaacatcagtttcactgacttgcattccaccgaacttttgcaagaggaagagaaagctgtagcatgatagctagtatattaggaattaattacacatagtcctcaggtcacctatcggaatattttttgaatgtgaactttcagttttgcatgtctttcgtaaaagctgagagtctctgagttggaggaatacaatcacttttttttttctttttttgagacagagtctctctctctgttgcccacattggagtgcagtagcgcgatctcagctcactgcaacctccatctcctgggttcaagtgattctcatgccttagcctcccaagtagctaggattatgggtgcccgccaccatgcctggataatttttttgtttttagtagagatggggtttcaccatgctggccagctggtcttgaactcctgacctcaagtgatccacccgccttggcctcccaaagtgctgggattacaggcacgagccaccacacctggcctatgatcacattttataaaaatcatattgctatagtttcagttctcactaagtcattcttgccaaagatctttttctaatatctatctctgatcatggtattttcccaattagatttatccagtgactctacattgcacgtaagggaaactataaacccctttgcacgatgtgccaggtcattcgtgatttagcccctatctgtctagtttcatctctagcaaggcattctctctatatgttcatgatttggcatgtactatcctatttgtcaggaatgcacttcttgtgatttgtcttagagacaaactcctgtcaagtctgattgtacttgtggcttctctgtgcaactgacttaggtttcttctatgatgctcccactgtgctatgtaatagtagtttttataatgtattataattattttaagattttgctttctttttatatttttagctcctttagagctgggaccttgtccttttatctttatattcccagattttagtatggaatctggaacaaaattgatgctcaatatgtatttgttgaacaaactcaaaattagttactttaaaattttttatttaaccaaaatatgttatagtatgagacgaaattaagggattaaaatatgcttatggtgactctacatcccatttcctggagcaattccaaatttaaatagtctacttcattggccttgaaatgtaattaacaaaacacaccataattttgtttagaaatgcaatatacacattgaacctataccttatatttaaaattgtatacaatttatttttatactttgatttcatatacttgttaaaagaaaaactttagataaactaaatttaacagtgtttatttgagcaaataacagtttacaaatcaggcagcccccagagccagagtaatttcagagcaagtccagggctgctgcatggtcagatgttatttctggacaaaaaaaaatgaaagtgatggacagaaaaccaaagtgaggtgcagaaacagctggatcggttataacttagtgtttgccttatttgaacacagtttgaacaactggctgcctgtgattggccgaaactttgtgattggtacaagagtaggttacagcctgttgacacatccatttaggttacatttcactatgtatggagaaacttataggccaaatgtaaaatatacaaggaggcaactttaggctaaacttaatttaacatactttatgtcttttttcttatacaggtcactttgaaagcaataatagtgaaaagttgaaatttaggatggagaaatacctgaattattttttagctctgctattttgctgtgcattatgatactaattattgcatatctgtatgaaaatgaatgcaaatttttgagaatttataaatccttaggtataaggatctgcataatatgattaaggttgttaccaagaactatattctcaaaaatattcagactttaggatgctagaatagtagctttcaatctttttggactttactattctaatgtgctttttttgagttgagaaccccagtgtactccttgccctcctaaaagcagattatttatttgaataggataaaaataattttgttttgtcttcactggtaccctcaattggagattacacagcgtatcacaaggccatgggggataatcatacatgaaaaatgcatttgtcagtcagaccctttactttttgagaattcccaattagagtctggagttggttctaaattgttgttgtcattgactagacaggggataaatattggcaaagtaaaaggagtgaatgtttagagccaaaaagattgagtatagatcttggttccatgacctactatttttgtttctttgggtgtaacaatttcttttgagtttcagtttcctcatctgtaaaatgagataataatacctacctgaaatgattgtgaaaataaacagtagtttctagaacagtagtacctaacaaagaataaggttttcataaatttcagctcttatctgattggtatcaatacaactctaggaataggtaaaagatcttcctgttaaactaaatgttgagttatttgtcttactgagtagttgttacactatctctgctttcccaagcaggttgctgtttgagactctaaaaacaaagtggtttgcagatggcacagatcagcaagcagagtcattgattattgtcaccttttccaggagagtgcattccttcatttctattcctgatgtgctagttagagaacatgagtctgtttacttcacctttcatcttattatacgtaatatcattaccactacttcctgactacatagattcctggttatggttaaggagttcctttggccagaatcctttggtccagtctcctctctctttctctgttatagacttctgcctcttttagactgtaggaaaacaagactctcccaagagtgtgctggacatcattggttttcaaatggttaaacaatgcaacttcacacatgtagaatgggaagcagaattttatacctcctccataatcatcaaatatttaaatcactgttattttgctttcaacaaaagacctcctttctgcattttagaacaaaggggagctgtctcagcctccagccactgagtctccaaacctgcttgctagtgtacccattcttccccttcagtttcctggtcaaatgtgtcctattcctgcctcgttatttccctgtctgcttgcatttcccagccagactttctgaaacacttgtttcagaaaagtccttttttttatatcctccccatagtcactatccaaattggttccatttacttctctagaactgttctcacactcttgattgccgtttagccagccacgtctgttcctaccatactcactcaacattggaaacatatgatgactactttcttcaaaaacgtccttattctgtgtaccacactttgctgctgctctttctgcctctgtgaccactccttataggttccttttcttcttgtgcctgcccctttaatgctgatattgatgttttctcccaagccctttggacagtttcctccagacttaggaattgctaagtgaatttgttgaattctacctgtactgatgatttctcaagggatttgactgtaattggaccttgttgaactgaagaaattgcagtatgtcaaatctgattatgtacttcacagccaaaccttggtctagtctctctggaccatgattgtcttaaaatctaccccatgttgacctaaaaggaagaagctgaggcagaattaatattgagagtttatttgaaccagtgttgaggacagctgcctcagacacacttccaaattactttggggagtgctccattaggcttctgttacaagcaggtttttaaaagcaaaaagggagacaaagagtgagttgatagagttgtttgtcaggaattttgattagtaattagctatacatcattgagctatagggcatggattatggtgtctggtgtgtggcattgttaggtcagtggctacttgtggcaatagcaagcagttttcaataaatacttagctcaaggggggaaattactatcattttaatgcctctctgggcctgataatttaaaagggctcacattttgcagatacaaagtatttatatatatatatatacacacacacatatatgtgtgtgtgtatatatatatttttttcttattttctttttttaagacagagtcacgctctgtcacccaggctggagtgcagtggcgtgttctcgcctcactgcaacctccgcctccccagttcaaatgattctcctgcctcagcctcccaagtagctgggattataggggcatgccaccacacacagctgatttttgtatttttagtagagacagggtttcaccatattggctaggctggtctcgaactcctgacctcaagtgatccgcctgcctcagcctcccacagtgctgggattacaggtgtgagtcactgcaaacaacctattgtttctctctcatctccaacatactcgcagtgaaaaaatccagcctcattattcagcttttatgtttacagattcagttaacattttgtgaattctctatttcaaaggtacaaaggtaattttaaattatgatttaattaagaatgctctttccgaaatttttatacctgtttgactgtttatgtaaatcctgtaacatagctgatcatcctcagtaaaacagtaataccttacttgaagcagcaatttgtttttaaatatacacggaagtctatgttttgaatgtgaggattggaggtggagagagaatcgatatttagtgaaactgttttatgccaggcacaggcatatgtgcttgtctccatatggatttttatcttccaacaactctgagaaatcttgtaaagaggagaaaaccaaggtaaagggaagttaaatagatggtacactgcaacatatacagcttttaaaattcagaaccagagtttcttctgtcagacctcatagctcatgaatctcttctaagtgatactgaaattttaagctgaggatgaatgcaaaatataggaataaaatactgacttcttgagtttagtaaatctaaattgtattaaaagttatctatatcatttttgtccctaggcagttatttggcagaaaagcagagtatcagatcacaagatggctctcatgtcagttctggggactgctgttatgaacaatatggaatcctttcagtaccactctgaagaatctcaggtatactgcaaaaacattctcagataattctgatttactcatgaagctgttcacatatttccctttgggggagttacagtggcaagaggttagtcttttaatattttaatcaaatatgtgtgtaaggtaaaacagtcaatacagagcttatgttaaacctctttccccagccctgcttccctttttatcttttctgtttgttgcttacattgattttcaaaaaaattatgttcaatttagaatcttttctgtttactttctactataaaagaaaaatagttggctgggcatggtgactcatgcctgtaattccagcactttggaagtccggggcaggcagatgacgtgaggtcaggacttcaagaccagcctggccaacatggtgaaaccctgtctctactaaaaatacaaaaattagccaggtgtggtggcacatgcctgtaatcccagctactcgggaggctaaggcaggataatcacttgaatccaggaggcagaggttgcagtgagccgagattgcaccactgcactccagcctgggtgacagagtgagattccatctcaaaaaaaaaaaaaaaaaaaactgttttcccccacctttcccattccaaatatgtacttaaaactttttcttgatctatcagtttagatagtacttttttactccctaatactggatgacgttcttaactcaaacttttcttcttactccttcctctttcagtcatatcagcaatagttttatattttcaagcttaattatatatataatttttttcttctttctttttttttgagacagagtctcactctgtcacccaggctggagtgcagtggtgggatctcagcccactacagcctccatctcctgggttcaagtgattctcatgcctcagcctccctagtagctagaattacaggggtatgccaccacacccagctaatttttgtatttttagtggagacatcatttcactatgttgcccaggctggtctcgatcctctgacctcaggtgatctgcctgcctcagcctcccaaagtgctgggattataggcgtgagccaccacgcccagcctcataatttcttatgtagccattttttaagtcttctatcttttgtctgaagattgattctaaaagttgaaaacttgtatggactataaaacaatcttcgttaaaagcccagtattgtagtgggattacattttacctctaaagatccattgttgtatctcttatgccatgcaaatgagaatattcctagagccctgattaaatggaatctctgttcttgtactcccatcagttgctcaaaatttatcatgtttttctttgcttaataaatggactatcttatgtagtttttcgctttttctgggattttcaaaagtttttttttaatgaaaaagttttcttcatcatgttagcaataaaatccaactcttagtcatcctaactgtagttggtaatccagttcattacgtctttttgaagtcattgttcttagaccccacttatttcttatttggatcatatcttaggccttctgcacaactctcatcttcagatatctttttataggaatgatggttggttgcattattactggtatgtcatgccttcctctttcttggcacttatactcatttttcttttttttctttttgagatggagtctcgctttatcacccaggctgaagtgcagtagcgcagtttttgcacactgcaacttctgcttccgaggttcaaatgattctcctgcctcagcctcctgagtagctgggactacagccacaacacccggctaatttttgtatttttaatagagatggggtcttaccatgttggccgggctggtctcaaactcctgacctcaagtgatctgcccaccccggcctcccaaagtgctaggattacaggcgtgagccactgcatctggccccatgctcatttttctgaggcatatctttaagtaacttccacagaaagaggggacatgagaggtaatttttcatgtctgtggctgggcgtggtgggtcacacctgtctcaacactttgggaggctgaggcacttggggccagaagctcaagaccagcctgggcaacatagtaagaccctgtctctaaaaataaaaatgcaaaaattggcccggtgtggtggctcacacctgtaatcccagcactttgggaagccaaggcgggtggatcatctgagatcaggagtttgagagcagcctggccaacatggcaaaaccccatctctactaaaaatacagaaattagccgggtatggtggcaggtgcctgtaatcccagctacttgggaggctgaggcaggagaattgcttttgaacccaggaggcagaggttgcattgagcccagatcttgccactgcactccagcctgggcaacagagcaagactccgtctcaaaaaaaaaaaacaaactagtcaagcatggtagtacgtgcctgtagtcccagctacttgggaggctgaggtgggaggatcccttgagcccaaaagttaaaggttacagtgagctatgatcatgccactgcactccagcctcggccagaaagagaccgtgtctcaaaacaaacaaatgtaaaaaataagtccaaattttcatgcctgagaatgatttcatcttgcactttcgcttgttgatagtctggcagacatagacttttagattgaaattaatttttgaggtcttgagtatttttttactatccatttttgctaatgggaaacaatacattccacttcttttttttcttttttttttttttctgagacagtctcttgctctgtcacccaggctgaagtgcagtggtgcaatctcggctcactgaaacctctgccccccgggttcaagtgattctcctacctcagcctcctgagtagctgggattgcaggtgcgcaccaccacatccgactaatttttgtatttttaatagagatggggtttcaccatgttgaacaggctggtcttgaactcctgacctcatgatccacccgcctcggccccccaaagcgcccatttctttttttctagatgatatgttttcttctatttgaaagttcttaggatctgtcctttatccttacaaggatgtgtctaagtgtgtgtcttttattatttgtttattgtgctgagcatttgatgtggatcttttgaatctgaagggtcatttctttctcagccccaggttatatacttccatccattatcacttcgataatttctattttttatgaacctccctattgttattaagacctcctgttaattttctcctattgttttttctcaggtttcccgtctttaattttttccataagttttgagagatctgatttttaaactgtctatggatttttttttaattatgtttaatttccaagagtattttttattgcttttttatacatactgttttatggatacaaaacttgggtctctctaaagataattgtttttgtttttaaattatttgttcctttaataatttctgtttattaggaggtcagttttgttttacttgtcaggtctttttcctccagtcctctaattctcttgtctttctccatgaataggaaatctaattgggaacagggtgtttgtggctgggcttattcactgtcaggttccacttgagtgttgagtaattaaggtcctaattctgttcctggagttgtgctaagcagttggcttcttttcttctcttccattttttttcataatttgttgaaacctcctctgctactatgtcccttcccattctctttgtagtattgagttcttaatattgcttatcattttattaaaatcttggatggaagcttgtactcaggtaatgcttgggattttcttggccgggggaaaattcaggccaaccttagtggccagctacagtgttagccatgatgtgacatgggtcctatttttcagagctccctgaagagttgttttctagttttgacacactccagtgctacttcaaactggttacggtcgctgacttgggatggcaagggtactgtctgaattctgctggattcctcgtagcttcgtggtactttgttgcctacagtggtaacccaggcagcttatggcaggagatctagacttgatacctttaccatcatgccctggatattctagctatcataatttagtctgaagactagcagtgttggcatcacctggaagcttattgaaaataaagaatcctgggcttcatcccagatcgactgaatcagaatctgcattttaacaaggtccccaggtgcacattcaagtgtgaaaagcactgatctagactttggtcagctatgatttcatgagtgaacgagactattgcatgaatcagtcctgtacttggaaatcttttcctcccatctgttttgagacgtgttgccagatctgtgcttacccattgaatttttattttcaatgggcaagcacagatagaattgcataaagagtcctagtaatccatcatagatatgagaatttttgctgcacctctatgtggtttttttttcatggtggattgagggaatttggtaagcatgtgttaatgttccagttccatgggctgtcagaatgataaacttttgagtgtctctctggtgagagtgatcatctaaccaaatccctcttctgttattgcactgtgtgtctaaggtgttgtatttatgttgccaccagctacccattatcactccattctttctgggcttatatggttgaaggagaatggtcctgtatcacagtttctttgagccctttctccatccctggccaaaagcaatcttaagttatttgccactgctggttagtggttgtcctcactcacctcacttctgtccccattatatgcctttaagttgtgcaacttggccaccaaggcctcttgactagtctgggatgacagtgctattggccattaaggaaccttggatgtggagaatctttatatatctcttcccataatgtgagggtaacttttttttttttcctcctgcagggaccccacatgggaagaactaattattggtggtgatctcaacagggccactgctctggtggcttttgtgaggcatttcccatcgtgactttgtgggcttgatggagctcctgaagttatcctttttgacatctgtcttctctttgaaatttccatctctgcattagtttatgctaagttctgaataaattcctcatcattgcctgattttaattctcaaaactatatattttgtttctaggatttacaatttatttgttttcatattcttctcttctaaacttgatttatagctaccaattctaatttctttacctttttttaagtgtacgctacttttcttttttaagaagcatgttacatatactaataatttcaaagtccttttcatattgctctatcatttctgctttcttgagacaaaattatctaattctctgatatttcatatgctttgaaaatttaatttcaaaatcatcttgaatgcaggtttattgtttttgttgctttgtttttgctttccccaacttccacttctttcccatagtttggcagataattcactcgccagccccaatttgacaccaggtatcatattagtaatgcatgcctcatcctgccaagcttttacaggccccttttcttagccagtttggctcagccttgttcttggtttggagttgtctctgttctttcttgtgactctggcaagcagctccagacagtggccacggtatttttaaactttttttttttttttttttggagaagaggtgctatatgagcccccttttttaaatggaaagacagatttcagtcccctgtcttgaatggggtgttttcagtccttatttctgtaccagaatttaatttccagctgacacatcttgtttctgatcctagaccacataggacatttgaccttagccgtcactccctgttaaatgttttgcagtcataacatctttaactacttttatgtgggtggccttttgaaaatttgtattttatctatcactgttatatatttgcagttggaatggcagagaaggggatttcacatgaacttgtttcactgtcctgaacaaaagtgcttaaattactactgtaaaaatgtaacttcttggtgttgtggaggtttactgaaagaggagaaggattagtgttaggagaccagccagggttacatcaatataatcagggttaagaagaggagatgggtttaacagactaggtagctggcagagcccttatcatagtaaaggagtataggatgagctagcaggatagaagtaggatgaaatattttaccaagttttgaatgtggtgagattgagaatatttttgtgacagccagttgaagatggtaagcactggggagtgaaataaatagcagctatacagctatatcttagcatcactggtgtatgggtagttgttgaaactataggtgtgaatgaaattaggaagagtaactagagagcaggaaaaagggggctgataatggaacttggggaccatcatcatttatacgggataaggaaaaggagagaaaccagcaaaccagaatgaagaggaggcattagagaggaagcagaaagaccaaaggagaaggatgaaacaaattcattcagtgagacacttcccagatgagagaattgtgagggtgtcgggctgcagggagtcaaataagagaagggctgcgtagtgtccctttagtgtcccttggagttggttattgaagtagaagcctgcttatacgggattagagatgaagggaagagaggggcggaccatagttgagaagcaattagggaggagaggtatttgtattttgccttcaatttttgttatgctttttaggaaattgaggaatacatttgggtacagaattttgtaaagtcttatctaattttcaattttgttgcactgatttggtgtctcaagttatttttccatgaactggcctgattttcactttttacagcattttatgagtctactgttttattttactttgccatgtaacttaaacatagtttgttcttaagattatcctaaaccatttttaaagctcagtatctagaatagtaattattaagtggccaaccaaggtggtgtgaaaggaaatcactagcaatattacatatttcttcttcattttattatttattcttatcctctcagggcagactttttttaaagtcacaaacccaataagtctttcagaggctaaacaggttctccctgatgcccagcaggtgctttaagaagggtctcatgttacctggtaaattatacaaccatttttaaatgctgtgaagttttgcagttaattaagtagtatcattttataatggattatacagattaatttattttttcaaattggcacaatttggcattgtgacaataatgcacttagtgttctaaaactggtaatgcatctccttaaacacttatttccaagggcagggatagccatagacataggtggtggcttacaggctatgttaataaggagccccacggttcctgcttaactaaaaatagtacccccagtgacttgcttgtttttctcaacctaagctaaaattttactatgagtgttccttgacagattaataacacatctagttctagttgtttctgataagagattttaagcctatattttaaataacttaacaaaaatcacatagctagtggtagaactgggattcaaaccttgtcaatctggctctgtcttatattcttaacagtataggatgttgtctttagctgtgttcattaactaaagataaaagtgggagcatgttctctgcttcctatcccttcaatatctttctcttctctctggtattcttttctagtatccttcttcattttctctttcttctttatacatttgtaaagtagagaaagatagcatataaatattcagtaaaatttttatagaagagttttctgaacaaaaatgaagctaaagtacaacagtgcaatcagtatttagccctgaggaagttaatacagagtaaaagagtttttttttttaactcagaaatgaaaacccagtaagattggctttatatagcatactcagaatgaagatagaaacagcaacttctttataggaaaagatggttaaagacaaaaggacaaacagccagagaaaagtcacaatgtgaggaaagaaacttttaaaagacagaaaaaaggttgagtatagattgaatgctctatgtcctatgacagttaaatatctgaaagtataaccattcatgaagattttataaatgccaatttttccttagagttgccaacaaaaagaggcagacagcaccagtgtagcatgctttactattttatttaaagttaatacttaagacatgattatcaggaagtatatggctttttagaccttaagatgaaaatctgttttttaatttttttatacctttcaaagtgttatatatagccagacccgtggaactacattgttgacattgcatattctgtaattattatatagatttatctcagtggatttcttccaaagtgtgatgcagaccactctttcactagtctttcaacaccagaaagaagtttcatcttcataaacagtcgaccagtacatcaaaaagatatcttaaaggtagtatgctttagaaaaaaaaaattatttgaattggaaatttgtcacattgtaacaaggactgcttccaagaatttgctctaaaataaaaaaaaagaaatacaatgtcatttattaaacattatgcatgatagaaagacatatgatgtctctcttattcttcctggcaattctggactgcattatcatccccatttatagtgaggaaacaaatgttcaatgtttctcttaggccacatagccaggaaattagagagttagtagttttttttgtttttgtttttgttcttttgagatggagtttcgctctccaggctggattgcaatggcgtgtcccgtgatcttggctcactgcaacctccatctcctgggtttgagcaattcgcctgcctcagcctcacaagtagctggtattacaggcacccgccactatgcccagctaattttttttgtagttttagtagagatggggtttcaccatttggccaggctggtctcgaactcctgtcctcaagtgatccgcccacctcggcctcccaaagtgctgtgattacaagccagagccaccatgccagagttttgatttgaaccctaagccttcagaacttccatgacattgtgatgtttaattattaagccagttttattgcatgtttgtacttgttttgaatgcttgtgcttcatttaggttcaaggcctccaaaggagtattacagataatgcttttcttttcttttcttttctttttttttttttgagatgcagccttgttgttttgcccatgctggaatgcagtagcatgatttcggctcactgcaacctccatctcccaggttcaagcaattctcctgcctcatcctcccaagtatctgggattacatgttcctgccactatgcccggctaatttttgtactttttagtagagatggggtttcatcatgttggccaggctggtcttgaactcctgacctcaagtgatccccccaccttggcctcccaaagtgctgggatcccaggcatgagccactgtgccgggtcatgataatgcttttcctaataagcagttgcatctactcaatttctcagttgaatttgctgggttttattgtactttttaattacatattattttttcttttatttattacatgtatttctagttaatccgacatcattacaatctgaaatgcctaaaggaatctactcgtttgtatcctgttttctttctgaaaatcgatgttcctacagctgatgttgatgtaaatttaacaccagataaaagccaagtattattacaaaataaggtaactcttttcagataattttttcttatgctatttataaacatatattactgttttcatataaaaagatttgtttatatttatcttttttattatttaaaatcttgtctattattttcataatttcccctaacatttgttaatttgtatttttaggaatctgttttaattgctcttgaaaatctgatgacgacttgttatggaccattacctagtacaaattcttatgaaaataataaaacagatgtttccgcagctgacatcgttcttagtaaaacagcagaaacagatgtgctttttaataaagtggaatcatctggaaagaattattcaaatgttgatacttcagtcattccattccaaaatgatatgcataatgatgaatctggaaaaaacactgatgattgtttaaatcaccagataagtattggtgactttggttatggtcattgtagtagtgaaatttctaacattgataaaaacactaagaatgcatttcaggacatttcaatgagtaatgtatcatgggagaactctcagacggaatatagtaaaacttgttttataagttccgttaagcacacccagtcagaaaatggcaataaagaccatatagatgagagtggggaaaatgaggaagaagcaggtcttgaaaactcttcggaaatttctgcagatgagtggagcaggggaaatatacttaaaaattcagtgggagagaatattgaacctgtgaaaattttagtgcctgaaaaaagtttaccatgtaaagtaagtaataataattatccaatccctgaacaaatgaatcttaatgaagattcatgtaacaaaaaatcaaatgtaatagataataaatctggaaaagttacagcttatgatttacttagcaatcgagtaatcaagaaacccatgtcagcaagtgctctttttgttcaagatcatcgtcctcagtttctcatagaaaatcctaagactagtttagaggatgcaacactacaaattgaagaactgtggaagacattgagtgaagaggaaaaactgaagtaagtttccagagcttgcatgtgacttgaatgttcagctatttccattctatatgactcactgtttaaaaagaatttttttcacttcttatttatggaaaagcagatcagaaaatacctttggcttggatagagtaccttttttggtaacactttttttttctgctaatttaggttttttgttggggcgggggcttgtattattttgttttttttttgtttaagccttaactgctttctgatattattaaattttttgctaaaggttttccattcatcttctcaatttcaaaccaccatttatcttctattttttttttgttttatgtttaataacttttctgttgtagaactttttaaaaaagcttttgcattggaacagttgtaactggtgtttttaatatcttaactattccctttcttaaattggtctccaaaatatgtaatacaacacaaaaaaatttgtattattggcgattcaatttagtgttgttcatttatactgtttctattcagtataacttaaggcttgcttctaagatgtattatttattataacttataaactatagtgggtatttttattacataaataggtgatttgatctgtctttgattaaaatagtatttgccatatttaaattagattttctgaataaatgttccaaaataatatgatgaatgtttttaattgacttaggacacttaatataaacacaaaatattatgttctggtgatctaatccagcagaaaatgagagtgaaattatacctccaatcatatacaggtatctgagtatctcaatattatgtcaaatgtgtggaaaaaattttaaacgtaatccatcatctggagtttatatttggtgataaactacctagatacttgaccaattttttttttcattctttccttagcttattcagtcttataaaaacaatatcaatttaaaatgataaagaccactattaacaccaaaatgaaaagcctccataaagcttttctcttcagccttttttgtcatctttttttttttttaagtgggaatggttattatattttgttcttttggaaatatccacaaaagtagacattttgaagtataaagccattaccccatttcaccaccaatcatctcatagtcagccctattagtcctgtttcatccatacttccattcactttctttccctttgtttattattctgaagcaaatcataggcatatcatctatttcagtatgtatctctaagagataaagatattcatattttaaacataaccataattgtcataacttttttaaaggtatagattccttaatatatcaaatactcagtgttcaaatttataattgtttcataaatgtcagatttttaaagatttgttttgaattatgatgcaaataaggttcacacaattgtgattgtctttagttttacctaaatgacacaactatgcagtttaaaggtgaggggacttaacttttaaatacagtaagcccacaaaagttgaattgcattgcccagggaaatgaattgagaattgtctgagaataggaaaaaaccatagatgtttcaagttctcatggaaatagggacagtgtacaagcttatgatggaaacttatcttgctgactgttcctttgcagcctcacaacagcaggtatcattccagttgctttttggggaatgtctgcattgtttctccttgtgggtcccaaggtgtcaggttactaggattatgattaataggcctcatctaaaaatccatttaccatcaattaccggaatattccaggtaatattctggaatcaagcttactttctctcacattgccataaagtagacaaaagaggctttgatggtcaagacctctgaagcttcacctggattctaatcacagttctttgttagctttgtatttaaaagtgtggacagtctctcatggattgttgtgaggattaaataagatattgtgtgttatgatacaagatcaattactaacacatagtaaatgattgctcacaatgtcaatatgatcagtttttaatctatgaaagggaatttttctgttgagaagaacatttctcatttgttgagtcaagattaaattgaatttggaggccagaaatagaaacctatgaagaaaatataggtatcttgggatcagagttctaattgtatgtcacagagtgctgtgttagaacctttcagagccagggttcctgggaccatgatcagctgagtctagttgcatcatgattagtgagaaggtagagcaaaaatgatacaacacccaagaatcgtactagctaccatttctcttcctgtctttatcttggagttctgtccatgatcctaaattctctaaggtatattaagagatatgagagtagacgcctcttctatagaccttcagtccatccttttcttccttcttctttttttcttccttttttccttttcctttcttcttctctcgattcctcctttcccttcccttctttcaactaggaaatattaagggttttctgcatataaggcctgaggtactctagctagtcacagataaaacatactttcccaactcatgaatggtgtaggctagtaaggaagattcagttaaacaagaatgtgatgagctttaagatacaagttttaaatataaggaattaggggaaaacttggcagttggacttaatattatctgtgggacaggtaatgcttccctgcatagaaattagccagaaggattttagggaattgtgtaggttggaggaacagtatatgagaaggcccagaagctagaaggaacatggtgttattaaggaaataagattctatgacaggaacagaatatgagggagtatgtgtaaagaaagttgggggaaggtgagggatggataatggaaggttctcaaagctataacaaagagtttgaataaggagtaggatcaggattgttcagttttctgatgagagcttgggacagattttggagtcagggagttactgacattgttttagttcttcctttctggagtttgtttgttgttttttgtttttttccttcctcgcctttcttctagtggattaaaatccagatttgggccatgtgccctaccactggggtctcactcagttgacgttagcttgaacttttcatttgcagtagttatgaatatattgctatttaaactaaaaaaaaattgcaactagggtattatgaaaatgataaactttataactaaatgcaatgtttagtcgcaagaacattatttgacttgacttctggtcaaatcaggattaatattttccattcaagttactaaatcccttcttgacattaagtacaacagtagcagctgcttttacttaacatttacttaatattcctttggacataactttttatatttcccaaagatgagtaccatatgtgaaaatttgcacattataattaattacaaatggggacctttgttttgaactcattttaccactgcacaggaaaaatctttaatttgaatgtctaagagctaaaaatactatttctaggacctgttgaaagtaaactattgaaaatcatgtgttttgtatagctaatccagaacctcagattctaagtagaaaataactttaaaattgtgaatatagcaaggtaagtaaccaaaggagccatttttttaatgtagtttacagtgaaataaggtctttttttaacactcttattcaggtaacatttcttcattcagcagacaggtactgagcacaaactacatgccatgctgtgatctcctgtcttttaaatctcacttttaacagcactgttctctcaataatatttttatttcttcacattccatatttttccttgagattattatatgcagataatgaaattcagttagtgtttgaagagtatgagactagaaataaccttaattctctagtcccaagtttaaaactttcttaaaaagtaatcttttagcaaagttacttaatttccaaccattactcgcccctttgttgtgagatttgtgtttcttggtagaaaataatgagagcaaaacatttatcaccacttactctgtgctaagtaatattctaagtacttggcacactttaactcattttatttctcacaacaaaactgaagtagatgtgtattatccataagttacagttgagcatgagacacagaaagattaaataattttcataggtttacagaactactaaatggcagaaccaagccaggctgtcttcagagtctgtgttattaatcaccacactttgctgaacaaattacagtagtttccaattctgggtatgtactggaatcacctatggagctctgtgacagcagctgcccaatctcaacctaggcctagagaattagaagctctgaggatgggatccaggtatcactttttaagaaaaggggtgacataaccgctgtgctaggtctttggccctggaagtttcatttttctcatattgttgacaaaaagatctcttaactttctacccagtgtaatttttttttattcttgagttcttagaatctatccagtataatttttcgaacatccattatcttctacctttgaaattgagttaaattagatggtttgggtgtgtttaatttatccaaatttgtcttttcattgatgactaaaatgagaattaaaaaaactaacaattagctaatcacatactttctgttttgtgattattgtagtgactataatttcactagcagttaccaaatgaagtattatatacaaaaaattttccttaatgttgttcaggaaattgtttattccatgttgatgttaaagcagatatataaggaatgcttcagatctggaattgatccatttctttattcatcctctctttttctgattgtttgtggccccacactttcttaaatggtttttttaactgggtaaaatttacctaatgtgaattgcagagatgttaatggtgtaatttgatgcattttcatacatgtgtacacacacataaacatcaccccaaacaaaatagagaacatctccatcatcccagaatggttcctcatgccacctctcagccagtctccacaggcagccactcttttgagttttgttacactagtttggttttgccagtacttgaacttcacatgtgtataaaatcatgtgatgtatactctttcatatctggcttcttaggctcaacaaagatatttttgtgactcatccatgttgttgaatctatgtgtagtagtttttttttttaaatcaaagaataatattcagttgtataaatataccaaaatttgtttaatcagtctccagttgatggacatttgggttgtttccagtttggggctattatgagtaaaattgtgttgtttactttccaaatatttggggcttttccggatattttatttctaatttaagtgtttcatggatagagaaaatgctaagttagatttcaatcttttgaaaagtaatgagaattaaagcccagtatatgttctgtcttgacaaatgttccatgttcacttaaaaagaatcaggattctgcagttgctagatggtagtgttccaaaatgtcagttaagtcttaagtaggtgataatattgctaaaatcttctatatctttgaggaatttttttttttttttttttttttttttttttttttttgaggaggaggatctctagttctgtcagttactgagggaggagtatatactgttgcaactctggcttcttatgcttactatttgcatggtatatctttttttcagtcttttagactatcctcgtctttacatttaaagtgtagacaaagttcgttgttactttttaaattcagtttgataatctttgcctttgaattgcaatatttagtccatgtaatataataattgatatggttgggtttaggtctgccattttcctgttttctgtttgtcctagctctattttgttcttttgttcctcctttttggggggagaggagccctttagggttaaaagaatatatttcagtatctaattttaatttctttattgagtttccattagtttttgctttggtgattacattatgcatccttataatctacttggagttaatgtaaaaaccctgtaagtataatttcacttgtatttggtgtcactttccttaattgtgcacatatactggcaactaattctcatcttaatctgaaaacatctatttcatcttcatttttgaaggactttttttttttttttaatgatatagccaaattctgggttcttttgccactgaaaagatttcactgttggccaggcgcagtggctcatgcctgtaatcccagcactttgggaggccaaggcaggtggatcacctgaagtcagaagtttgagaccagcctggccaacatggcgaaaccccatctctactaaaaatacaaaattagccaggggtggtggtgcacccctctaatcccagctactctggaggctgaggcaggaaaatcgcttagaacctgggaggcagaggttgcagtgagctgaaatcgtgccactgcactccagcctgggagacagagagactctgtctcaaaaaaaaaaaaaaagatttcactgtcatctggctctgcattgctctttacaatatccattatttttgcggtttcctatttgtactgtttttttcctctttattttcaggattttatcttaatctttggttttcagcctattatacctacctgtaaatttatctaatatacctacctgtatattagatataaatatatctaatatacctacctgtaaatttctttgcatttattctctttggaggtttgctgaccttcttgcatctgtaagttgtatttctccaaatttgctgattatcaaccctaatttcttcacattttattttctttcccagttttccattgtttatctgggactccaatgacatatatattagattgtttgttttgccttaggtcactgcaatgcttttccagttgtcttcacttttctgtaaaaacaacacattttatcatttctattgatctgtcttgaactttactgaccctttcttttgccatcttttatctgctgttaagcctacccggtgaatatttaatttctgatattgtattttttaggtctagaacttccactgtattttttttataatttccactaatctgttgagattcccccttctattttctcattatgataatcttttaagaccttaaacatttattaaacctgtttttaagtggttttttggtaatcttgacatctgggtcatcttgaggttggcttctactgaccactttttcttttgaccatgactctcattttcctgttttgttagagtgataacttttgattgtatagcaggcattgtgggtgatatgtttaaaactctggattctgttatcttcttctgaaaagtgctgatttttgttctaccaggtatttaaattactgacagatcaccttgagcttgtagaggttttgttttatattttgttagggagaagctgtttcaattttgttcttggacccagggcaacttccttagtttaggacgtaggttttttatcctaagatgtggccctcttccagttttaactgaaagcccaaagtgttcacccggccatgaaactgtggaattcagattccaaactttgtttccctgcaatgggcagcagctgaaatctctgttcagctcatttagccttctaatggttgtttttctttgggttcccacacatggaattttctgggattttctttctcaattttcagttgttctggaagcagacagctctgtgtcctggtgactcaggctaataagagtgcaactttctgactgagttctggccaccctgctccccattaatactgaggactgccctctggttaaaagtcctataaatgtgggtctctatttttttcacccctcaaggagtgaatccattctaatttcttcctgcttttggctgttcttcagtgcctactttaaataattgagggttttttgtttgtttgtttgtgtgtttgtttgttgttgttgttttttctttttggtgtttttttttggtttttttttttttgagacagagtcttgctctgtcgcccaggctggagtgcagtggcacgatctcggctcattgcaacttctgcctcctgggttcaagcaattctcatgcctcagccttctgagtagctgggactacaagtgcacaccaacatgcctggctaacttttgtgtttttagtagagacagtgtttcgccattttggccaggctagtcttgaactgctgacctcaggtgatctgccaacctcagcctcctaaaatgctgggattacaggtgtgaaccaccactatgcccggccaataattgatttttatattttgttcagtgtttgtcatagttatatgcaggagagttagtctaatacatgttcctttgtcattactatatctggaacaccagtactttatttttataaaatttacttcagatggttaatatatttctgattatgatctcattagttctattttatttctattcttagatatgaagagaaggctactaaagacttggaacgatacaatagtcaaatgaagagagccattgaacaggagtcacaaatgtcactaaaagatggcagaaaaaagataaaacccaccagcgcatggaatttggcccagaagcacaagttaaaaacctcattatctaatcaaccaaaacttgatgaactccttcagtcccaaattgaaaaaagaaggagtcaaaatattaaaatggtacagatccccttttctatgaaaaacttaaaaataaattttaagaaacaaaacaaagttgacttagaagagaaggatgaaccttgcttgatccacaatctcaggtttcctgatgcatggctaatgacatccaaaacagaggtaatgttattaaatccatatagagtagaagaagccctgctatttaaaagacttcttgagaatcataaacttcctgcagagccactggaaaagccaattatgttaacagagaggtatgatgatacaatactttttaagagtaaaaatatttattataatagttcatactagattaaaatcgaaggtagaaggttgggaatgtttcctagtaaggattagtggtatttatttattttaatcttttaaacatttgatttctaggccgggcgcagtggctcatgcctgtaatcccagcactttgggaggccaaggtgggtggatcacgaggtcaggagtttgagaccagcctggccaacatagtgaaaccctgtctctactaaaaatacaaaagttagccgggtgtgatggcacgcacctgtagtcccagctacttgggaggctgaggcaggagaatcgcttgaacctgggaggtggaggttgcagtgagctgagacggtgccattgcactccagcctgggtaacagagcaagagtctgtctcagaaaaaaaaaaaaaaaaaaaaaaaaaaaaaaatatatatatatatatatatatatatatatatatatatatatatatatgatttctaatctttaatggaattgtttagaaatagtatcagaatactgtagatagttcacttctacatttaataagtatgaagctcatttctctggtacattagtgacttctctagggtaattttgaagttagattgccatgtctttattccattatgtactcattgttttgacattttcaaacacataataaaatagaagtatacgatgcatacctttatcagtaattatccaagactttgccacatttgctttacctttctatacagtatatacacgtacattttctttccttcgcaaaattagtttagaacaattccccctcctatatctttcaatatctctctctcaaaaaatggctgttttctcaactaaacacaatacctttttcataccttaaataataataattccttggaatttttcctcattatctcaaaatacctttttttccagttttttaaaaaatttatatttaatttgtatctaaacaagatccacatactacatttggttatcttgtttatatatcttaaaaatcactctattattgtagattctgagtcatttgttcagtggaatgttctgttgtctgtatttgctttcttatgttgttcaacttctctcccctatgtttaattgggggttaattaaacatggagggctgaatagatttagattctattttctgatgaatctacttaataggttggctatatgcttcatatttcatcacatcaaaaggcactatcactaggttcaggtaatgacagcctgtctttcactggaaagtttcccatcaacctttccatgcaatggtgccaatcattgatgatttttgcctgaaataattttattattggttgtaatatagggtatttccttttcttattctatatgagcaaattgctttctgtaaaaataaataaccttggatgacaaagcctggggaaacaaaaataaaaaagattaaaaaataaataatgactaacctattaacatttcccttttttaacttaatatttctttttcagtcagacacaggtagaagagaatcatgacaaaaataataaaaacctgaagtttaaaaagataatttgttccctaggacacatcgttagataattctgtttcagaacttccaagaataaagcagaaatcatttataaaatgtgttaaaactcttgttaaagacactgccatcattggaggagaaaaaaacagggacagaacacagaaaaacatctgttaagtctgtctttttaaataaggaaacagcaaccacattaaccaaaatccagtatgtttcatagtattctcttgagattggcttaggaaactgtcagaggaacaattagaaaatagtgtcttaggctacattcaaacagtttaaacatctgatggtgcttttctctttcttacctaaaagagctagggtacatctgaatttttagacttgactgcttttctgaatggcattttgtaaacttcatttaaatttcaaaaatctttttgagctttttcaaatgataggtttttaaaaatatttttctatgtgatgttctgttcttcaaaaaacaaatacattaaaaactattattgtgggaccatattggcctgaaaaaaaaatctttcttaattgagcataaacaggaataaagattaattcaaaatagtttttcctccttcttttggaatgtggcatccccatcacagttaatgatgtaagtttttcaaaactgagtcagggactagtttatcccacaatgcgacaatgtgggcagggtaattgtaggttgggctcagttttcttgccagagttctaatgctgtttgtgtaacttacctctaagtggaataatttaggtacctataaagtaagggctcaataacaataaccttaatgatggctaatatttattgaacatttactgtatgataggaatttggcaaagttttttcatgatcttcacatcaactttatgaggtagataatatccacattttatagctgaggaaactgaaatgtaatggttaaataacttaactaggctcacacggacagtaaataagctgtatgtccaagattacaatctagacagtttaactgtggagcctgcaccattaattgctatacagtatcataatcatcaccaccaccaccatccctactgtctctcagatcgatttttaggatattggttagatgaaacagagtacatgtgatatatagccaaagctctcttctctataatattagctctcacagccattggggtcttcaaccattcagagctgataagcaaagatatcagcgtactggaacacagaacagtgccttgcatacatacctaggacaatatctgccacaaggtaggcactcaaatattcattgaaggagtggcaagatggtaactattcacatcaaccccgacagacacctttttgcaatgactataacgcgtcctgaccaagcctaaaaccaatatgtgtggttgatttgtaccctaggtgatctttggcttcctcaagtttttgcaccactcagaatcatttcatataccacctttggcaaacatgccagacctgcagtagactgaaggaagctctcccaagctctaaattgattaatttattagttcctagaagaaagagattacatgtttatctttttgttacagaagaaactttgaatagcagttgaaaatttggcagggtggaccacctaacttgacagtgtattattgtgtctgttttgaaggaataaaatggaattatttataaagttttcatttgtattagagagagccatttttaaaatttcacattcaatttgtaacattctagaagacagattatcttctttctgtatactgtgtgcagtaggtatttaataaaatattaacagaaatgtaaaacagtgatttctcatagggctacttatacctttgtattttggttaatgatgataacacttgtcaaagggccctaggattaactttttcccgtaaacccccttattttgtgtttttaataagttaaagggccataatttctttttcagtctttttaatggatctcattatttagacgttttatataaaatgacagcagatgaccaaagatacagtggatcaacttacctgtctgatcctcgtcttacagcgaatggtttcaagataaaattgataccaggtatgatagtgtggtttaatattttctgatgtggaaaaattagtcttgttccaagagttacatttgggtttcatgatttacagatatggtggtatatttttgtctcactataagtacagtgtcagctatgttaaaacatttttttcaaaacatcacctctgcctgaaacaagtaagtttggcatctctttcagtccaatgctttgcatttgcattttcataactaatcaaatagttttattgtaatttttgtcatcctttgacacaatattcaaactgcctgctttgtttaaattattaaaatactcctttaaatgataaaacacaaacatgtaggatattggaattgcctaacaaaaatggacatctttgcttttcaaaaaacatttgcttgttttgccaattagacgtgtaacatcagcagttgtactatatggagaatggatgatttggttccatggctttggtaaaagactgataaccctctttgctcagtatggaaattcattgggtggatttaaaaagaaaaaagaaaatccatctggctagagacttcagttttcctggctggccccttctctgttcctttatagtttccatactcaactgccttctgccctatcttctgttactttctcttcatctggtatcagagaggtacattggaaccatgaggaaggactccactgtctcccttcctgcctctaaacttgtcatgcccaaagtatagaaaaacagagctcgaccaaaatagtgtttgaagatttttaaaggaatgctttactgagatatgaaaataagtaaaaacaatgtacaaaagcatggagctgggtatatacagaaaatactttggtgtcccaaacataaactaattttacttgatttttgtgatttttaaggatacctaacctaagcttcttacctcctacctcaattctattagtccaaatcccagcactgccatttaaaaacaatgtgttttggggaaagtcacctggcctcactgtgtcttcattgaaaacaactaataattattgaataattattatgtacagggcactattctaagtattaaatgtattaatttaatctccctaatatccttgtaaagtaggttctattactgtccccattttacagatggaaaaattgaggcacagaagttaagtttgctcaaggggacacagttattggtaaaaccagaatttgaacctaggcaatctgcctttaaagcctagctcttaactcatttattatattgccttcctgtcaaaatttagatatttactccaggaagtattggtgagcattaaccaaagtaacaattaaatcagtgagcatggtacttggcaatgggagatgctcacatattctcttttcttaccatccattagccccctttagcaggcttgcagtcatctgttttagtcttcctagaaatatttcttgctcagggtccctggcatcttaaaatttatgtgaagtgaatttacttgaagcaagggatgggtgggggtatatgtgttttattctcaacttaatctgtttttctaattatatggcgttggtggcaggtactggtttttttcatgaaagatattaaacaggccaggcacggtggctcatgcctgtaatcctagcactttgggaggccgaggtgggtggatcacctgagatcaggggttcaagaccagcctggccaacacggcgaaatactgtctctactacaaaatacaaaaattagccgggcatgtggcaggtgcctatgatcccagctacttgggaggctgaggcaggagaatcgcttgaacccaggaggtggaggttgcagtgagccaagatcacgccactgcactctagcctgcatgaccgagtgagactccatcttaaaaaaaaaaaaaaaaagatgttaaactgcaggttgttgttgttttaaggataactgtcctttcttacctgccactcaattccaagagcatttttttttaactacccagtaagtttatatctcacagatgctttcagctcttagcttgtaagtagtatttttttaaatcttattgaatgcctaatactttccatagcatcaaagatgcaaaaatgattaagtcacctgtaaactgacttgatttgattggaattaactttacttagattatcatcagcattatttcccttgtcaataacagagcaagttaaagatatttatgttttctttcttcatttctttgtttttttatttttttaattaggttgtattttcttaacagttctgtcttgtgtgagagtattgtattttactaactttgaatcaacagtttgcctgtagtcacagtacttctttggataaggataaaaacatttgaaagagaaggaatacatctggctttgagagagaagattctcaatgtgactctaagaactttgcatgctaataggaatagctttttgtcctgcatcaataagaattccatattttaggaagtgaaaacttgtcaaaccacttactcatttgatgtattttccctgaaaattggtaagcatttcacagtattttatggaaacttttcaagggttattgttacatagttccaatgtctctaacttttccatatctgaattttacaaacacagaagttaaaatattgctcaatttccttattcgttgccaagtaccttttacccatttccactagtaattctgtgaaatgtgtatcattttccagggcaaatgtagttagtattagacttttcattctaatcatactgtaaaagatttaaaactaccaatagtgaaaaatcacttagactgatatttttggcaattttcatatctatataaatagttaaaagagatgtgaactagaatattctgctactgctttttgcctaccacacacagttttgagtttcatttacgtttcccctattgctcaaactcatttcgtttccactgttagttcgtttgtgtttctataaaggaatacctgagactgtgtaagactcaggtagacctgagactaaaagaaatgaccacaagccttccttacaaagaaaagaggtttatttggctcatggttctgcaagctgtacatgaagcatagtgccagcgtctgctttccttttacatataagttccaagtttaagtcatttctttgctctgatggtagccatgccacttcttgaatgatttgctgcttaggaacttctttcgctagatagtgaaattaaatagtgatgacctgggtcatcactcttaagttcaaacttctaccgatcctaagggcagaggtgtccaatcttttggcttccctgggacacattggaagagttgtcttgggccacacataaaatatactaacactaataatagctcatgagctttaaaaaaaaaaattgcagaaaaaatctcatgatgtttaaaaaaatttacaaatttgtgttgggctgcattcaaagttgttctgggccacatgtggcccacagaccacaggttagacaagcttgccctgcggcatggatacagtgcagccaaaatccttgcggggacataaaaaggatgacctttactccagtttccaataaattcctcaatatcatctgagactttgtgagcctttcactctgcgtatttctatcagcattttagtcacaaccatttaaccagtttctaagaagttctaaactttccctcatcttcctgtcatcttctgagctttcaaactcttccagcctctgctcttacccagctccaaaaccacttctacatcttcagttatctttatagcagtgccccactcctcagtactaattttctgtgttagtttgtttgtgttgctataaaagaatacttgagactaggtaatgtataaagaaatgaggtttatttggctcatggttctgcaagctgtacatgaagcatagtgctagcatctgcttctggtaagggtctcaggaagcttacaatcatggcagaaggcaacaaggagccagcatgtcacatggtgaaagagggagcaagagagagatgccaggctcttttaaacaaccagctgttgtgtgaactaccacagagacctcactcattaccatggggatggcaccaagccattcatgatggatctgccccatgacccaatgcacctcccactaggcccacctttaacagtagaggtcacatttcaacatgagatttggaggggacacacatctaaaccatagcatctcacttcattgaactctgtatctcatcccttaatgcttgataatataatattatatattattctccagttgttctctgggaaaaatgtttaggataccatctctgtagtctaccagcattgcatctgccaaccaggtcaaggatgtagtctgtaattgggaacaggtaagggattggattattgaagtctcaggatctgaaactcttcaagttatatcacatctctttttttaaattaatccattgatagctactacttatccaagattggactgtctcttttcctttaattccaggtagcattatgtagacttcatgaaagaacactgttacaccgatacagccaaagaagacacatctttgctatgttccaaaaatatgcattctaaagccaaatctgatgctttgaaatatgtgctgttatggattatgtacccagttatacatccaatcctttagctagtttctagttttattttattttattttattttttgagatggagtcttgctctgttgcccaggctggagtgcagtggcacgatctcagctcactgcaacctgtgcctcctgggatcaagtgatcctcccatctcagcttccctagtagctgggactacaggcacgtaccaccacactcgtctaattttttttgtatttttggtagagacagggtctcaccatgttggacaggctggtctcaaactcctgatgttgtgatctgcctgcctcggcctcccaaagtgctaggattgcaggtgtgagccactatgcccagccatttagttttattttaattactaagagtaatttaagtaacagttaacatgtcagttttatttgtcctattaaaatattttgaacaaacagtattttcttctaattaataatatctccataaattactatgtgactgcttttataattcgtaagttaaaatcacagaaataattcaggcgtttagatattgaaatggtagggtagaatttgaagagcagcagttgttaaaacacttaaaccagttttattttcataaatatcatgggactccattttctctccaaagcaagaaatgatctaaacaaatttaaggaacagaacagcaataactgggattaagttaaattatataaagcacatgtggtgtcagtgagcacttatgacttaatgtgagaccctatgggaaattactatttgttctccaactaaggaacaaaactttgtcctgactgtattaaatttgaatgagggttcactaaatgttttaacagcaatttttgtttttaatggacatgttctggaatatgaacttaactatgtgtttttattttttttctttcaggagtttcaattactgaaaattacttggaaatagaaggaatggctaattgtctcccattctatggagtagcagatttaaaagaaattcttaatgctatattaaacagaaatgcaaaggaagtttatgaatgtagacctcgcaaagtgataagttatttagaggtacgcattattttatatatatgttattgtatacaggggtcccaactcccgggccaagccggttaggaaccaggccacacagcaggaggtgagcggcctcctagcgggcatcaccacctgagctctgccttctgtcagatcagtggcagcattagattctcatggaagcacaaaccctattgtgaactgtgtatgcgagggatcgaggttgtgcacttcttgtggaacaatttcctgaaaccatccccacccgccaactggaaaaactcttccacaaaaccggtccctggtgccaaaaagcttggggactgctgctgattctatatatagaggtattatagattggccagactttaagatacttatttcttaaaatagtaaattatttccaaatagtagaatattatctgtaagttttattatgtatttgcaagaagaacactattaaaaaaaaaaagaacactctattaagtttcacatcatagactgactgtggtaaactctatcatggattcttaccataacattttcttgggtacatattgaggaaagactttataaatgagatattttgcagtgaagttcttttttaaaaacatttcataaataatcccctcagaaggggtttaaactaatgctacctttatattacatacttgtctaaaaagtattgtaatataattctaagtcctgatctcatcaagaggagtagaagggaaggaaagtgaaagatgggaatctttgaataagcggaaattttcatttttgtgacagtattcaccacaaaagagaaatgtaagagtgggttaaaagaaaaggattaaggaaggttataaactttaaaatataagatagtagcaggaaaacaatagtgtttccatctatatatcttgttctagatatccctcaagattggtattatttaaaaaacaaacctgaactctaatgaagtttttctccctttttaaaaatgagccatttttgtttacagttggtagtgtgcctgctgtattctgaaggtcggacttccttaacaggaaagtctgcttgttaaaccttctgaagaatgtattcagtaatgttctgtgaatcctttaggaactttgtcatgtggaaattcccagcctattgtgcgggtagcttaacattgatagtttctagagacttcaagggaatattttcttgtgaaagagttagtatgaacttaaaggttgagggagctgtgggttggaagaaccatgtggggagaaataagagttcagaaataacaggaataaagtaaattgggactggttttaaatatttttttgctaatactttacctttcagtatgttaaggtaatagtggtataagtgttaagaaaaatgggctaggaaaaaaaaagagagaacttaaaccacggggatgcttccatttaaggtcaataagatgaatcagagagaaaggaaagtgaaaggagaaccaagagaggggtggatgtaaaagtcaaggaaggaagtaaatttaagaataagtagtatcatgttctgtatagggtaataattgctagaagactatcagatatggctactagatgacattggtaaccttgaagagaatcgtaatggcaaagtacaattgtccttgtatatactcagtggattggttccagcaccacctgtggatactaaaatccaggcatgcttaagtcctgcagtcagccctccagaacccacatatatgaaaagttggccctccgtatatatggatttcgcatcccatggtactgtattttctatcacagttggggtcggaaaaacatccatgtataagtggacccacacagttaaaaccagtgttgttcaagggtctgctgtggtaggaatagacgacatttgccagtagttaaagagtgtagtagtggaaaagtaggcagcaagtcgtatgatagtgaatagtgaaaggaaggaaagagtatgttaaacatgtctgtgttgaactggtggaagactgacaataaaaaattgcagaggaggccaggcttactggctcatgcctgtaatcccagcactttgggaggctgaggtgagtgaatcacctgagatcaggagtttgagactagcctggccaacatggtgaagtcccgtctctaccaaaaatacaaaatttagccaggtgtggtggtgcgcacctgtaatcccagctactcaggaggctgagtgaggcaggagaactgcttgaacccaggaggtggaagttggagtgagctgaggacgcacactgcactccagcctgggcgatagagctagactctgtctcaaaaaaaaaaaaaaaaaaaaaaaaattgcaggggaaatgttccccaaaaggcaagagggaagataggatatgaatttaaggtttagaaagaagaaactgaatcaagagcagaaaacagaaaaggggaaaaatgaaaataatatttttacgtaaactttaaaaaaaaatttcttaatcattagaacctgtgaaattttaggggaacttgagagaagtcatgttgatatatgtggtgaaagagtagaagttacctgctgagagtggaggggttgtgggaaggagttggtaattttagtacagtaacaaagatctgaaaataagagctgtaggtactataagagaaggttaattagagaggaataagaagatttccaggtgtcactgagggatcttaagagttaacatttgtattggatccagccaggacagttttatgactcaacgatgctcagtagaatttgtccaagggtaaatcaaaacaccaattcctcaccctgtcctagagggtgatctggcctctgcctaatttccttttcttgttcctcttttttttaacaactatgatgcacccacactgaacatttagttctttctcttctgtctgcgtgagatgcttttctttgcccatgatctttccattaaggtttcttatttattaatttttatttatttattttgagacaaggtcttgctcaaaagctggagggcagtggcatgatcacagctcactgcagtcttgaccttcaggctcaagtgatcctcctgcctcggcctcccatgtagctgggactacaggcatgccccaccgtgcccacttttttttttttttttttttttgtggagactgggtctcactgtgttgcccaggctggtctcgaactcctggcctcaagcagttctcctgccttgtctcccaaagtgttgagattacaggcctgagccactgcacccagcctggttccttatttaaattcaagcttaaagtcatctcctcaagtaatctttttccaactctacaatcactctatcatgtggcccagtttaattttacgcattatttattgactaaaatgttctgtcttttgtctgttttctgtttctctgcactagaatgtaaattgcacaagagcaagtcttgttttttggttcaccactacatcccgagagctgacaacatagttgatacttaataaatatttgttgagtgaattcataaaatgaaaataatcaagattctgtcttcctttttgccaggataacatgttttcagcttcagggtatatcatggtaaaatgtgtgactttccctttggacagggagaagcagtgcgtctatccagacaattacccatgtacttatcaaaagaggacatccaagacattatctacagaatgaagcaccagtttggaaatgaaattaaagagtgtgttcatggtcgcccattttttcatcatttaacctatcttccagaaactacatgattaaatatgtttaagaagattagttaccattgaaattggttctgtcataaaacagcatgagtctggttttaaattatctttgtattatgtgtcacatggttattttttaaatgaggattcactgacttgtttttatattgaaaaaagttccacgtattgtagaaaacgtaaataaactaatatagactattcatttgattctcaagaaccaaccatcatcataattatgagttgtaggctcaaaattggaaaataggtagtatttttgggtggttatttactaggtcctctgtgcagggagaaatcaaacatcacacatactggcatatctgacaaacagtgtcaatattttttaaagtacaatggagagtcagagtgggagaaaatgagaaaacgaagtttagaggaagaagaaaaccagaaatccttcctttaacttcaatttagggggtaacagattagatgttgctgtctctttattatatggtaattattggatttgggggtcaacttttgttggaatacatgggaagacctagatttttaacagaaaacttaggggaatttttttttttttaagactctcgctcttgtcacccaggctggagtgcaatggcacagtcttggctcactgcaacctccacttcccaggttcaagcgattctcttgcctcagcctcccgtaactgggattacagccgtccaccccacacctggctaatttttgtatttttagtagagatggggtttcaccatgttggccaggctggtctcgaactcctgacctcaggtgatccatccacctcagcctcccaaagtgctgggattacaggtatgagccgccacaccgggccattaggtgaaaattatctattgtacatatgccctttcaaaaaccaggtcccacagtgcaccaaaatacctttataaaaagttgaaacatgatttttaatgaacatatttgttgtgtaaaataagacatgttattctggatacgatgtccccacactcacaccatctcccataactctcaaagatcatctttaaattcctaagatccttgtgttaagtacaaattgtgaaacctggattctgccttttcttctgccaatatcatcctattttgcatgacccaaaatactgcttcccctgactctccatttccccttttataaatgtgaggtcctgctctgggagagctttctgggagtaatccttttaaattaactgggtaaactgagggaagagaggctcacagaagctatcaaagatgaaatttgcatcatacatttgcactcaccgtaagtaaaactgtagactcattttttagccaatatagtctgtactggtcttacaactatcttgtagatgaagaaactcatttctcaccagttatgaattgtgtcaaagcaggttggtaggaatggcagtaggtatttaccacttatttgctagacaggttaagcacttaccttggctaatctcatttaatgttcacagcgaatttaaatttgtagttactgttgagattctaatcccagagctcctgttcttaaccaccattatactgcctgccatgagaaatgggccctaaagagttatttgggtcaactaaacataggtagttagggagtataaaacactccctgacaccactttaacgaatgctggagtaaatcaactttaggatgcaactttttttttgagacaagagtctcgctttgtcgcccaagctagagtgcagtggggcgttggcttcctgcaacctccggctcccaggttcaaacgattctcctgcctcagcctcccccgagtagctgggattacaggcgcccgccacccgccaccacgtcccgctaaattttgtattttttggtagagacggggtttcaccatgttggccaggctggtctggaggtcctgacctcaagcgattgccc

SEQ ID NO: 13659 - DNA, 23105 bp, Human
tctcaaaaaaaaaaaaaaaaaaattagtcaagctacataagatctatgtgcttctctttatgtatatttcaattaaaagtttgaatttaaaaatagtactaataataaataggctagctgcatataattggaaaggcagcttatgaacccagcatcaatagctttcagttcttttaggattgtttaagaaaaggttacatcagctggccaggcgtggtagctcatgcctgtaatcccagcacttgaaagcctaggcgggcggaacacatgaggtcaggagttcgagaccaacctggccaacgtggtaaaactctgtctctacaaaaaatacaaaaattagctgggggcacctgtaatcccagctactcggaaagctgaggcaggagaatcacttgaacccaggaggtggaggttgcagtgagctgagatagtgccactgcactctagcctgggctggaaggaagaatttgttaaggagcgacaagagcaaaactccgtctcaaaataaataaataaataaatataaacaaataatgttgttacgaacattcttgtacagctttatttttttttttttgagacggagtctcgctctgtcacccaggctggagtgcagtggcgcgatcttggctcactgcaaactccgcctcccaggttcacgccattctcccacctcagcctctccagtagctgggattacaggcgtccgccaccatgcccggctaattttgtttttgtatttttagtagagatggggtttcaccatgttagccaggacggtctcgatctcctgacctcgtgatccgcccaccgtggcctcccaaagtgctggtattacaagcgtgaaccaatgctcctggcctgtttttttttgttttttttttttaagagacaggatcttgctatgttgcccaggctggtcttgaacccctgggctcaagtgattctcccacctcaccctctcaagtagctgggattacaggcatgaggcattgcactcagcttcttgtacagctttcttgtgtgtatatccaggagtggactttgctgggtcatagggtatgtgtattttcagctttagtgattatatttatatatatatatatatatatacatatgtatatatatacatatgtatatatatgtgtatatatatatatgtatatatgtgtatatatatatgtgtatatatatatgtatatatatttttttttccttttttttttttttttttcttgagatggagcctcgctctgttgcccaggctggagtgcagtgatgtggctccagtggctcactggagcctcaaactcctgggctcaagtgatcctcccacctcagcctccctagtagctgggattacaggcatgcaccaccatgcccagctaatcttttttctttttctttttttcctttatttatttatttatttattgagaaggagtctcgctctgtcgcccaggctggagtgcagtggcgcgatctcggctcactgcaaactccgcctcccgggttcacgccattctcctgcctcagcctcccgagtagctgggactacaggcgctcgccaccacacccggctaattttttgtatttttagtagagacggggtttcaccgtgttagccaggatggtctccatgtcctgacctcgtgatccgcccgcctcggcctcccaaagtgctgggattacaggcgtgagccaccgcgcccggccccggctcctgctcctctaaatattagaggcaagcctcgaaccggagctccgggatgcatgccaatctccggttgcgcctgcgcgtcgggctcccgtggggtccacgcatttcctacccggcccccgcgaacaggcgtaaagctctttcttcagtgctcgctctagtgcgcgcgcccggacggcgcctgcgcagagggcaaggaacctggtaccccggtgcggtcccggcgcctgcgcgctgcggactgtggggcttctcggcccgaggcagaggaacagggaagatggcggctgtggtggagaatgtagtgaagctgtgagtggtcgtttctttctctcctagggcggcaggttttgtaaagggcctgggagtagggggcggtgggggaagggactaggcggagagagggacatccccgggaaagccatgttgcgactcctggtggggagggcaacaggagactccggagaagacgttgcgcttctttggaaacttgtggaggccctggtgggggcacactggagccccgacgggcggcatccctgcggggctgtgtggcctcagcgttcctcggggctgacggtttccagagcatggcgccctgcctgcacgcgagactcaccgtcccggtcctctcccgagacgcctcagtccggaggagcggggccgaggcccgggcggccctacggctggcccgccgcccaccccgccccgtcccgtcccgttcgctgcagcaacaggctcggcggcccctgcggagtgcactgcggggctggctgtttcagttccaggcagccccgtgatgtttgggaggatcttgggtggcaggtacctaagactacaaatattcttgggaagaatttatcgaggagcggatccagaagggaaggaacttcaggggagtgggccttggccccgtccagtagcagccatcaaaaacctgcaactggaccgaagccgttcaggacagcttagcctaaaggggcatctaggtgggcattcttcctattatacgataccattgtgctggtcagatttcaagcaaagttaaagttaatagctgttggggccatggacgctggcctatgaactgcttcctgtgagttaaagatgctttgggacttgatttattcctacagaagaatcagaatgagttttagattgggttaatgcatggtgggcgaatagagcttcttttaatgggtatgttgggcttggtgcaagggtgggaaaattgagtggtgtctagctgtccagtcagggtttttgcattttgactggatgacgaggtaaaggttcggtaactcttctaagggactcacagcttctcatctgtctttgtcgtggcctgagccccactcttcctaagagcctttttaaagagtaagttgcttctccctcctgcctgaagccttttctttgagaatgctttcccacttccattaagctaagtgcctttcctcctcttgtggtttgtttttttttttttttaagttgctttctgctctatcctgctgtctctttcagccacccctcctcccaacactattgtctttctctctgatctgcccactccagtttccccagctctttcttcaggctgacatttttctcaatttagaaatgacactgttgatctaccatttatccagttatccttcctgactcagatgttctttctttgtttccctgcgtctttgttgacttccctcatcccattgtaaggggatgttttacacaggtttctccaaaaataaaaaggaagattctcattgtactgggggagtatcagacttgcctaggttttgggagttaaacgtagtgaggttcttcgtgttggaagattttcctcagagaaatagggttgccagtgctttcaagttgtgtcataagtgaggggttgcccatttaaacagagcgtgacatcttgtttctctttgaaaaactgtagagattgtgagcatcaccagccactaattcctgaatgccagtaatgagaaaccaactctctcctcctcatttctagctgcacagggcctcagatcacaattaatacgtactcccacagaattatccctttaagaaggggcttctattcttccagttcatttggagatatggcacttctcttgattatagtgtgcctagtcttctgacagctgatgttatacattgagtacattgaggtcaggaccactagctcatcttttctttttttttatttttttagacagagtctcactgttgtcggcccgggctggaatgcagtggcacgatcttggctcactgcaacctccgcctcccgggttccagcaattctcctgcttcagcctcccgggtagctgagattacaggtgcccaccaccacacctggctaatttttgtgtttttagtagagatggggtttcaccatgttggccaggctggtcttgaactcctgacctcaggagttcacccgcctcggcctcccaaagtgctgggattataggcgtgagccaccacgcccggcccctcatcttgtatgacttgcatcttgtcctgggaaaagaattttcttatttgtaaatttctatcccttccgaatgtgatgtcagaaatgaaagtcttggctgggtgcagtggcttacgcctataatcccaacactttgggaggttgaggcaggcagattgcttgaggtcaggagtttgagaccagcctggccaacatggtgaaacctcatctctactaaaactataaaaattagttaggtgtggtggcgcacacctgtagtcccagctacttgagaggctgaggcacaagaatcgcctgaacccaggcggcagaggttgaagtgagctgatatcacaccactgccctccagcctgagtgacacttttaagactctttcttaaaaaaaagaaagaggctgttgggcgcggtggctcatgcctgtaatcccagcactttgggagtccgaggcgggcagatcacaaggtcaggagattgagaccatcctggccaacatggcgaaaccccactctaccaaaaatacaaaaattagctgggcatggtggcgtgtgtctgtaatcccagctactcaggacgctgagggaagggaatcacttgaatccaggaggcagaggttgcagtgagccaagatcgcaccactgcactccagcctggcaacagcaagactccatctcaaaaaaaaaaaaaaaaaaaaagaagccgggcacggtggctcatgcctgtaatcccagcactttgggaggctgaggcgggcggatcacaaggtcaggagtttgagaccagcctggccaaggaggtgaaacccgtctctagtaaaaatacaaaaattagctgggcatggtggcgtgcacctgtagtcccagctactcaggaggctgaggcagaagaatcgcttgaacccaggagagatcacaccactgcactccagcccaggcgacagagcgagactccgtctcaaaaaaagagagaaagtctttaagcgttcttactaggaaagtaaaataatagtatagctgtagctgctgattggttttgaaactttctaggcaaaatctagaggcagggcgcggtggcttacacctgtaatcccagaactttggaaggccgaggtgggcggatcatgaggtcaggagttcgagaccagcttggccaacatggtgaaaccctgtctctactaagaatacaaaaattagctgggcgtggtggcgcatgccactcgggagcctgaggcaagagaatcgttggaacccgggaggcagaagctgcagtaggcagaagctgcagtgagccgagattgcaccactgcattctaacctgggcggcaaagcaagactctatctcaaaaaaaaaaaaaaaaaaaaaatatatatatatatatatatatatatatatatatatagagagagagagagagagagagagagagagagagagagagagagagagaacaatgttaatgttaacttgacatttcttggtatcggagccttaagtttttgttattgcttttttttgttttaagagacagagcctccctctgtcccccaggctgaagtgcagtggtataaccttggtttactgcaccctcaacttcctaggctcaaatgattcccctacctcatccgccccaggggctacgtggaaccacaggcatgcatcactaagcctagctgatggtttttttgtttgtttgttttgttttttttaattttattttttttgagacagagtttcgctcttgttgcccaggctggagtgcaatggcgcaatctcggctcaccgcaacctccgcctcccaggttcaagcaattcttctgcctcagcctcccccgtagctgggattatggtcatgtaccaccacgcccggctaattttgtatttttagtagagacagggtttctccatgttgaggctggtctcgaactcctgacctcaggtgatccgtccacctcagtctcccaaagtgctgggattacaggcgtgagccactgcgccaggccttttttatttttattttttaacgttttgtagagatgggatctcactatgttgcccaagctggtctctaactcttggtctcaagagatccaccagccttggcctcccaaagtgctgggattataagcatgagctactgtgcccggcctcccttaagttcttaagagctcactgtcatgctgtcttgttctctcttcatgagattctccccccacacttcagtgtttccttcccagcccttttacccccaagactgtttgcctgccttatgtagctcacaagagccctgacagaacatctctcattcattccccgcaaaactgtttccagcctccttgctctgactttgcagcactcgccagcctggccctgccttccatttgacttccagtgtccgtatcaattcccatcagcagaaacaaaggagctgccgcactcaaccttgtttatccaattttattctgtgtggtgaagacgtggctgcctcctaaaggcgagcccacagaggcaaggctgccttctccattctgctctccaacgtgagattcgtgcctacctcagattacagtcattacagctcattgaatcacgccaggctatatttgtggcattgccgtctctgtgtgtcgtatgtgtcttttttacttgctgggcacatgctaagttatgcagtggtctattgtggctgctcactgaaggaccctgtcacattctagagcagggtttgttggtgtagcccgagttacggacagaaaccacagagacttaatctgtttgctgtctcatccccaggctgtttcttgtaaaatcctgatatgtcaaagctcatttggtccaacctcctcaatctatagaagagtaaccaaggtccacctgggctgactaagtgtccatgttcgtgtgacttgcaggcaagccaggtctttttactctcaagtcaagtctgactgtatctcagacatcgtcatgagtattagggatactatgagaaataaatcaattctgcccttggtttaagattgattgacgccaggtactgtgacacatgcctctattcccagatacttgggaggctaaggcaggaggatcacttgagccaggagtttgtgtccagcttgggcaacatagtgagaccttgtctcttaaaaaaaaaaaaaaacaagattgattgaatataagatcgagtttgttaacctccattaccaaagtccttgttaaaccctgcaagatgagaacaagataggttctatatacacgcttcttagaaccagataactcctggcactgtgcagttttccagttttccacttaaagatttacccttgattcagatttcaaattgagtcttttgagaccaagaagattttttcctatataattttattttgtgagaatggagaagaaccctaagatgggccttagagcaaacaagtttcttatgagtgatggtgctcaataaaagcttcaaggaacttcaggtacttgtagacatcttccataaatgtaaaattaattagttgattaaaaacctagttcaaaattcaaaagatataaaaaggcatatggaaggaagtggcctagtcacccactttttctccccgctgacctgcagtttcttttccattttgttacataaatgatagttttatttgacgcttctcagcagtgtaccttgctttgctttttgtccctagttaacttgaaattgtttaatatcagtatgtgaagagcttccttcttatggctaagtagaatttcattgtatggatttaccatagtttgctaaatacattttaataagtcccctagactttgaactctttccctctggagcagaccttggggcaaggatgtgggagcatgtagtttatttgggaggtgattctaggaaagagggaataaggaggaacttaggagggactatcatctgcttcttagcctcataagggttaagagaaatagcatcttaactagcacaggggtgggcttgtgagacacgtggagtgaacattctttcacctctttgggggttaaacttaagtctgattagacatatgatgaaatcatgtgttcctgatggtaatttatttgtaaagtaattcctcatgatggcctagaaaaggggcttcgtgtcccatgaggcagaagtggaggcaaatagaacggaagagacagccacccagtcccttgagccttctagagaagcagatggcaggggagaggaatagctcagcaccctatgccccccgctccaacatacacgcctgatttctatcttccctgcagccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggtgagggtccagacttgggagaaggggactcaggagcataaggaggaagaagcctcctcatcttaggtgatgagacagttgatagggttttccctactgccttccacctatggatgaatatggtcttcctgtgattagaaacccagggaggatgaagcagatgtttgataccagcatctttgttttctgccctgctgaggccattgtgtgtctggagaactatgtgttagccaaggccctgaagcttatatatctatttttcttttccacagactattccacctaaccccctaggccctcactgtcagaatttctcccttgctctagaactcaaaggggggcctacttaattagaaagtgtttggtattactttctaatactgggttagggcctgacttctatctttcttcctgccacaggattggcctccggacagctgtactcctaccctgcccggcgctggcggaaaaagcggcgagcccatccccctgaggatccacgactttccttcccatctattaagccaggtaaggcacatacttcctgagcagaggcgtggcctgctgcatggtgagagcctgctaatcactgtgatataccaggcccagtactagatcccaaatatactcaaatgaatatgatgtgattctttcctttaaggacctcagtctagaaggggagacaggtaaacagataagttatggtgccaagtgaactagggtgtcttaattcctgggcgtgcagagaacaaaagatagtgacagacctttggtaagccccagcattatgtggactcagagcagtctgctttcagcccttttgagccttgctttatcctgaccttgcttgcagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaaggtacaggattatccctgtggctaagggagctttgatggaaatcagcctcctcttcactgggggccacctagtttctagaactgaaacagaagctggagtccaggaagcaggcccctgcagttctgttcttacttcagtccctgattattgtcaggtactgactggcttctctgttgcttctaactatagactctcattccttcacttttatcacagaaggttattattatacacatatataattttcattaaaaaaattaaaataggccagatgcagtggctcatgcctgtaatcccagcactttgggaggccaaggcaggaggattgctcaagtccaggagttcgagaccagcctgggcaacaaagtgagaccccatctctacaaaaaaataataattaaaaaaaaatagccaggcatagcagcatgcgcctgttgtcccagctactagggaagctgaggtgggagaatcacttgagcctatgagttcgagactgcaatgagtcatgatcatgccactgcactccagcctgggcaacaaaaaaaaaaaattaaaaccagaaggtgcaagaatagtacaatgaaataccacatactctttacctagatttatcaattccacattttgccacatttgccttatctgtctttgctaaactatttgagaggaaacttcaaaaacttttcagtctaggcaacatagcaggaccttgtctctactaaaaataaaaataaaaaattagctgggcatggtggcacacgcctgcagtcccagctactcaggaggctgaggtgggaggattgcttgagcccaggagattgaagctgtagctctgcttatgcctctgcactccagcctgggtaacagagggagaccctgtctgggaagggagggaaacaaacttttatccctaagtgctttactcttttatcacaaaagtttgtgtcacagttttttggtccctgaggttacacagtgaagcacacttagtctctgccaacagagaagataagaatacatgtaaaaataacagctataaatatgccagcattgggttaagtgccttttcatgccctttctcctttagtctgtacaaccttatggggtaggtcctgtgttccccatttcacacagaggctgaaacaaagcagtttaaaaacttcccatgggtcgggcacggtagctcacgcctgtaatcccagcactttgggaggccgaggcaggcggatcttgaggtcaggagatcgagaccatcctggctaacatggtgaaaccccgtctctactaaaaatacaaaaaaaattagccaggcgtggtggtgggcacctgcagtcccagctactcaggcgcaaacccgggaggcagagcttgcagtgagccgagattgcgccactgcactccagcctaggtgacagaacgagactccatctcaaaaaaaaaaaaaaaacttcccatggccggccacggtggctgacgcctgtaatcccagcactttgggaggccgaggcagttggatcacctgaggtcgggagttcgagaccagcctgaccaagatgaagaaaccccgtctctactaaaaatccaaaattaatcaggtgtggtggcgcatgcctgtaattccacctacttgggaggctgaggcaggaggatcgcttgaacccaggagacggaggttgcggtaagccagtattgcgccattgcactccagcctgggcaacaagagcgaaactctgtctcaaaaaaaaaaaaaaaaaaaaaagcttcccacaaggtcacacaaataagcaacaacattttaatttaaactaggaggcgagtgtcaggacagaaccaccaataatgtgctcccagggtggccaatcagaggcaggagagggcatggctgcttgtggcatcagggcaaccttttggaagcatgctatttgatttggccatgtggcatggtggggaaagcatttcaggctaaggaaataacgtgaagcacaggggaaagatatcccaaagtatggaagggagcaggagcaggattatagcatgcttgaaaggcgttggtgaggaatgaggctggtgtgggtgggaccacgtcacagaggaggttctgggtggccttggccagtctcatcataggggagcttttggatgcacatatttctacccatgctaaccctcctgtccactcagcggatcctagaaccagatgacttcctggatgacctcgatgatgaagactatgaagaagatactcccaagcgtcggggaaaggggaaatccaaggtgaggggccagcgtgctgcctgcatcttgggacagggtggcctagggaattccttattttatttcaagtgagattagcggccacttccaaaagagtctaactcctcaggcccagctaccaaaataagggtgtctctttgctcttcttggcagggtaagggtgtgggcagtgcccgtaagaagctggatgcttccatcctggaggaccgggataagccctatgcctgtgacagtgagtgcctcacaagtgggtgggtagaccttgccttggacccagctcctgctctggatatgagaggagggagggttgtgtttttgcccagagtattaaaacaaacctgggctcttgtcctgcctgctgactgcttccgtctgagacccctgggaggcctgggtccctgctatatgacgggtgggacctgcatgctctgggaaagatttctgccatcctctggggtagggttgcttgtgggggccacagcaggcagggttggcctctcaacagatggcctgcaggtctcctggcctcagttaagccagggccccaggggtctgacactgagtttttcaacgtctgttctctttttctttctgtctgccttgccccacttctgtccctccaccctgggagcaccatcgccgctggggtttctctctcgtttgctctgctttcctgctgctgctgctcctgtctcaagtgtatcaaggccttcttctcatgacttttctttctgtctttcagatagtttcaaacaaaagcatacctcgaaagcgccccagagaggtagctctctcaacttttcagacttgtggttttcctttccctttttccctcttcccttgttcctcctgcctttctcatttcctgggatgctagctttaaaatctctggaatggcatgggggtaggagcagtggaatttctgctgtgctctactcctcaaagtcctgaaggctgcctttaccactgcttgtttcccacaaacctgctcctagagctgctcggcccagtgcatggggtggcttcagaagcattatcaggagcccattacaatcagacccttccgctccctccccagaccaggcagctggtggtcagctcatgttccccactgccccaccacctcctcctgccatcctctctccccactcctttcctgctggcccccttgcccttcttggtattacttctcaagatgacaaaatgcctcatggggatctgctttccttgctgattggcaggcctggacagggcaattacatgggagtgtgcttgaatttctttggggaccaactgcccaactggcttcattgataggctatccccaagaaacccatcccctgcttgtttacccacattcaggggagatgggctccatggtgtgtggggtagcatgagcctcccacatttactgaggggtaaaaaagtttggagtcttatccacttttcccccttcctgccaccccaaagatataggaatatccttccctttcctgacctggagcgtcccagactgttagtatatcccagagcaactaactggtgatggggcaagggctaagccccccaaaagtcaacatggaagagcagtggtggccatggggttggagttcaggagggaaaagagccccagaagctagagagccccacggcctgatgctcctggctgaggggaagtggccgtcactcaaggcctgtcccagagtggagctgctaggggaagggatggttgccctctgcctcaggtggagcccccacagcttgcagggatggggacatggcactcttgtatcctaacacctttctctgcaatcttcttcccactcagtttgtggaaaacgttacaagaaccgaccaggcctcagttaccactatgcccactcccacttggctgaggaggagggcgaggacaaggaagactctcaaccacccactcctgtttcccagaggtctgaggagcagaaatgtaagctgaggtgtcagaagtggtgggcaagcagaagttggcctggttatgaaaaccactccttgcatgggtgttgagtggctcagggacccccatgggtgtcatcaaaactctttctctctgtagccaaaaagggtcctgatggattggccttgcccaacaactactgtgacttctgcctgggggactcaaagattaacaagaagacgggacaacccgaggagctggtgtcctgttctgactgtggccgctcaggtactgcttcccgtgaaggctgctgctttgcccagtccccaaggggctcttggcttgctggcctctagggctgtcataaccagcccacctcgcttttcctaaccaagagaagatgtagccacaggcaggagctcctctcttccccccgcatttccgactgtctgtctcactcacttcccccactacagggcatccatcttgcctccaatttacccccgtgatgatggcggcagtgaagacataccgctggcagtgcatcgagtgcaaatgttgcaatatctgcggcacctccgagaatgacgtgtgtatccccgccccctcctcagcatggctccttctgggcttttactgctgtttgcacagttccctctaaagtgagctttcttttaaaaagggagcaggatccctcccacatgccacacgcccctccctagcatctcagtcagaactctgatttgttgccagatatatattgagtgctgattttatgtcagacactgttctagtcactaaagatgctaaagacaaacaaggtccctgcctcatgagatttacattcttacaggaacaacaataagcaaggatgtaaatgagatttgtataatgtgccatgaaaaaaacgaaatcagtactgtggcagagaataattgcataagtgatttattttgatggtcaggtatggctcttctgggagggtgatgctggtgttgaaattttggtgataccaaggagccagtcaagatttggaggtagaggaatcccaggaaaggagcagccagcgccaaggccttatgttggacaagccagatgacagggcatgggagagtatggtgggcaatgagatgagagaggcaagcactgccagatctctggggcctcgggttttattctaggtacaacaggacactgttgaagggttttactcgggaagtgacatggttatttatgtatttatttatttactttttttttttgagatggagtcttgctctgtcgcccaggctggagtacagtggcacaatctcagctcactgcaacctctgcctcctgggttcaagtgattctcctgcctcagcctcccaagtagctgggattacagacacgtgccaccacacccggctaattttgtatttttagtagagatggggtttctccatgtttgccaggctggtatcgaactcctgacctccggtgatccgcctgcctcagcctcccaaagtgctgggattataggcgtgagccactgcacccagctatttatttattctttatgtatttatttatttattttgagacagagtctctctgtcatccaggctggagtgcagtgacgcgatcttagctcactaaaacctctcccttcaggctcaagcagtacaatcctcccacctcagcctcccgggtagctgggaccacagatgcacaccaccatgtctggctacttttttatatttttggtagagacagggtcttgccatattgctgagctggtctcaaactcctgagctcaagcagtcctcccaccttggcctctcaaagtgctgggattacaggcatgaacccaccatgtctggccttgtcttatattttattttatatttatttatttatttcaagatggagttttactcttgtcatccaggctggagtacaatggcgcaatctcggctcactgcaacctctgcctcccaggttcaagcaattctcctgtctcagcctcccaggtagctgggattacaggcgcccgccaccacgcctggctaatttttagtagagacggggtttcaccatgttggccaagctagttttcaactcctgacctcaggtgatccacctgcctcagcctcccaaaatgctggtattacaggtgtgagccaccgtgcttggcccttgtcttatattttaaaaagatgactttgggtgccgtgtggagggtagactgtagggacaaggatggaggctcatgcctgtaatcctaacacttgagaggctgaggcgggaggatcacttgagcccaggaattcaagaccagcctgagcaacatagggagatcctgtctccacaaaaaaaataaacacttagccaggtgtggtggcacacacgttagtcccagctacttggcaggctgaggtgggaggattgcttgaacccaggagtttgaggctgcagtgagccatgatcacaccaccgcactctagcctgggcaacaaagcaagaccttgtctcaaaaagaaatagtcactgggcacggcgtctcacacctgtaatccaagcactttgggaggctgaggtgggaggattgcttgagcctgggatttcaggaccagcctgggcaacgtaaggagatcttgtctctccaaaaacattgaaaaattagctaggtgtggtggtgtgtgcctatagtcccagctacttgagaggctgaggtaggaggatcacttgggcccaggaggtcaaggctgcagtgagccgtgattgcaccactgcactccagcctgagtgacagcaataccctgtctcaaaaaaatataccatagagcttgggctttagggaaaaaaaaaaaaaaaaaaaagtggaggtgatttgatcaattaggagctctgaaaggacccaagtgagaaatgacagtgactggatctgcggtggagaggggcagcatggtttcccacataagattctcacatctgttcttacctgctacctacccctcttggaaatagcagtgtcctgtagtggcctgaggcacatcagttattcagtccccatcctcttccctcttgcctacttcaggaccagttgctcttctgtgatgactgcgatcgtggctaccacatgtactgtctcaccccgtccatgtctgagccccctgaaggtaagttgcccagatcttttactcagaacaattactttattagttacttggaaaatactgagttctatgttctttatgttatcacttacatattcttccaaattagggagtaaagcaccttgccttggctcagtttagaatgccttcctaacatttcaacttaaagggtttagtgtttgcacattatcagctacatttacaacagaaaatcaacagcccagaagaaagcagatgctgagccgagatcaggcacccagaaggaatgatttattttcttccaaccagtccagaaaactcaagtggtagattatctgatgtgaaacttctgcagtcaactcttgaaatttgatagatttgagcatttatttcctatcccttccccttctgaactgggaagggacttgactttggagcctgaatgggtcagtctgcttctccgataacttactgtaataatggtccaaatttattaaagctattcactgaaaccagtggtggcaccaagaattggttgcatctccacaagtccccttccagctggatttctgtacataaacacctcctgtacagaaattgagtagcagctgggcgcggtggctcaagcctgtaatcccagcactttgggaggccgaggtgggcggatcacgaggtcaggacatggagaccatcctggctaacacggtgaaaccccgtctctactaaaaatacaaaaaaattagccggctgtggtggcgggcgcctgtagtcccagctactcaggaggctgaggcaggagaatggcgtgaacccgggaagcggagcttgcagtgaaccgagatcgcaccactgcactccagcctgggcgacagagcgagactccatctcaaagaaaaaaaaaaaaaagccaacagaaattcagtagcttactcagaacacaaatgcccaggagctgttactgtgcacaaaggatgtgggccagcattacaggcaagagaaagtgtttcattgtgtgatgtaagctgacttgtaacatatcggtcaaactgctgtcacccctctagagaatgaggcccctgacaatgtctaagagtcctttagcagctgtaggggagtactcagcttctgtcaggcccagtttatgaatctgctttggggagaagtcgcatgtttatgttttgttttgttttgtttttttaaaccatcaaacagatgatctatgttacagaatggctttcctattaaagttctgtgggacatcgaggtagtggagagctgcaggcccgagtgtcctcactgtagtgttaaggcagctgaggggcaacccctagaagtatcagatgttctaggtcagggtcagcaagctacaagctaaaacctatggaccacatccagccacagccagcttaaatagcttgcaagctgttttgttttcttttcttttctctttttctttttctttctttcttttttttttttttttttgagacagtgtcttgttctgttgcccatgttggagtggagtggcatgatctcagctcactgcaacctctgcttccccgggctcaggtaatctggtaatcctcccacctcagcctcctgagtacctgggactacaggcatgccaccacacccggctaatttttgtatttttagtagagacggggttttgccatggtgcccaggctggtctcgaactcctgggctcaagtgatccacccacctcagcttcccaaagtgctgggattacaggtgtgaaccactgcatctagcctgaagaaaatccccttaaaaatataaaaactggctgtgcactgtggctcgcatctgtaatcccagcactttgggatctcttgagcccaggggttcaagaccagcctgggcagcatggcaaaaccccatctttactaaaaatagagaaattagctgggcgtggtgctgtgcgcttgtaatctcagctactatagaggctgaggcaagagaattgcttgaatctgggaggcagaggttagagtaagctgagatcacactgctgtactccagcctgagcaacagagcggaaactcttgtctcagaaaaaaaaaaaataaagggagttaaaaaaaaaatgcatgagactgtatgtggctcacacaccctaaaatatttaacactctggctctttacagaaaactttgccaaccgtattgacctttgggttagaaaggacttacatttttgagtcacctgtttctgaagagctgataaaagccctagaataatgtccaaatgcgcataggtataattttgcttatcatttcaaggcattaaggactaattttattcaaaaaaaattagaagaattcagccatagtcaatattaataaacaaggaatgacccaattgtttttcatataagggacaattattttgtgttttttagtgaaactacacaagtcttaaaactgaggtgcttgacaaacttctgtcttcccaggccctcttcctactcccaaaacttctgatttaatagggccaagagggcctgggcatcagtattctgaagtcctctagatgattatttctttcatctccatagaggatgatatttcacaatatttgaagacttagaggtttatcccagctcaggaaaccatggaactttcctgctgcagagcatccctcgtcctacctgtagctgatcctgctatagagatggggtatcaagagcagaggaattgcaagcaggtggggattgtgtgggacccatcctgaccccattttgcctctctgcaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagagccctctgctggatggtttatctcctgcctttctccattaagaaggccatttcatcctaagatttccatgatggtggtttttttttttaatgttttgaaatacagcttttttccccccaaattaaaatttttttgtggaaccccaatatgtaaagcgaatataaaattggttattttgttttgttacataaattcaagtttataacaattctttgttataaagaacaatgaagctgttttgatcaatacaaaatttgggttaaaatcaactttaacatctatttttatgtttcagttgatttggagaattctcctagtcttggatacatagatggaagtgatgacaggtttataacagttgaccttgcaatctcagacatttaaaacaggaccagaagtttatataaatataattaataagcaaactaatgacatcaccatgggacacacacaaaagttcttgcaggagcagggtctgtgtggcttcagttgcctgcagcgctcccaggccagagcaagtgctctaggatctgaactgcccgcagtgcagccctgcagcctttcccagggcacgttgatgtgcacacagtttccctgaaggcaaagtgaacatgtggagagcttacgtggcagcgcgtatgtcttcagtgtgtgttttagaagtccaactgttgtttttatgtttttaaaggaaagatttgaatcaagcagttatgggccccctgaagtatccttttttctagaacattctgaaagtcatccttgcctatgggaagcctaggccggcctgcactgttatgttcaataaataagcagggtgctctgggctggggattgtgtgaggagcagagcgcagcccgtcctcatgcttttccactgaagtaggccaggcagagagggagtacagcaatggatgcgctttggcagctgagtagtccgagagccagaaaagaaatgtggaaaataagaacgctgtagcaggcctaggtgaggaaatttaggaagggtttgcgggaggtaggatttgagatgggtcttggagagttggacagtgtcagccggtaggacgggggtgcggacggaagcctgtgaggaaggcagaggatgcggagctgtgagcggagggagcagcgaggctggagagcagctgggctgcgggtcaagacgtctgcgtttaattcgggactgaaggttagcagggaagggaacgatgccagatcttgagtttaagaacttgaatcttgtaaagtaccaaatctaataaaatactcgtcctaaatcattactggcccaagcatgcagtgtttccgtggccgacagactcgagccagcgctgtccatggtaaccagcttttgtgtggcttaaagcttgcatccattttctcctttcatcgttttcccaaaacaattccgtgagggctgttagccctgcttggtagacgaagaagccgatgcggtctagggtcacggccagggaggctttgggacgccaagtcagctcggcggtcaccacaccacctacagggctcgtcgggccctcggggtcggcggctgctggaggcgcccaggggagtcctgctggttcctggctccgcctcccgcccctccgcgctagaagccccgcccccagaggggctcgacgaaccgccacttccgcaacgtccaatgaaacttagccgggggagggacggggcgccactgaggaccaatctgcttgggccggggcggggctgcggcgggtgggtgcagaggggccgcaccgcggacttcgcagccgggagagagcccggcgcgggcggcgcgcacgggactctgctgtgcgcgcgcccgcccgcccgccgtccgcgcaggccctcggtccgctctgccctcggggtcgtggcgcccatccctcccctgttctgctgtcgccgcccggacaggggctcgggagccgggctgggggcaggggctggagccgcgggaccagcgcctgaggtgggtgcggagcgggaggccgg

SEQ ID NO: 13660 - DNA, 20482 bp, Human
ccccggggcccggcctcacgctcacgccatggcctcccccagcgggggaggggggctcggccgcgcgagggtgcgagcagggggcggggccggccgggacagtcagtggtgcaaggcccggacgcgggggtggggctgcatcaggggcggggtccgggtccccactcctggcccagaattgctccgaggggccgagccggcaggcaggcgcggggcacgggccgggtacccgtcggcggcatccagaggtggtcgtggggtgggtgctcccggggtgcaggcgacagctccctagtctccggaccagggagaaccccaggatctggggtccactttcggggtcgcaggtcacttgcttggggctccgcgctcgcccggcttctgctggtgccggcctaaggaggaggccggaagaaggagccgcgaaccgccagcctgcagtggcgcatgcgcccaacgattccaattgggacccggaaaaggaaaacttgacggcatgaatgcgcaagcgcagaaaggtgatggcgcggtaggacgcgaggggtgccctttgggcgtgcgcagactccaggactaaagcaagttcgagcgtaaaagcgtttgggcgcatgcgtagacccaggcgttgccaacccagggtagacgactgggcggaaccaaagagacagttgagtagccattgggtaacggcaaagtaattggcgcacagctcttccaatgagttacaggaggcggggaaaaggtggaggcgtggactcccctagtagcagcgagagttctgcactaccgaagcacgcccctctcggcccgccccctttaatgctggacctcgtacgtcacgaccgatttcgctcccagcggcgtctacttccgggtcagagctcagacctagggtgtagagaacaaccttccgtaacaggcaggaatagtcgaaataggatagcgtcgtctttcttaaagtgacaggctcaaagcaattggggcagccctatccagaagttgtgagggcgactcagctattctgaatccaatcctgggcaaagttctggacaagtctcaggtttctgccaatggggaagggatatgaagaagcggattgtttcccaggtgaggagaagaagagagccttaggcaatccactccaagagcttgaggtgcagccagttccgtctgtcctccagtcttccccaccccatccaactagctctacgaggcagagctttctcgtcctcatatcatatatgaaaagaatggccgggcgcggtggctcacgcctgtaatcccaacactttgggaggccgaggcgggaggatcacgaggtcaggggtttgagaccagcatggccaacatggtgaaacccgtctccactaaaaatacaaaaattagccggccgtggtgccacgcgccggtagtcccagctactcgggaggctgaggcaggagaatctcttgaacccgggaggcggaggttgcagtgagcttagactgcgccattgcataccagcctgggcgacagagcaagactccgtctcaaaagaagaaaaaagaaaaaaaaaagaaagaaaataatgaggctcagaatcgatggatcgcacagtcccacaacttcgcagccaagaccagactcgggttcacccccttcccaagtgtggttctgtaaccccgttttgctgccgccgatgcggatgcagagggcagagatggcccatccttagcagagaccaacctccaccctaggcagcagagcacgcagctgggggcttttctttctagatctcaaaagcctgctgtgatgggggatctggttctgccctttccctctctgcctctcctggcccgcctacccgggaactccccgcctggagcctctgggaggggagcggtgcaggccgcccgcgtcatctgatgctgtttcctgcaggagggagaagagcggaaaaaagtgaaactccaccctccacctctgcctcccgcccccggggccaaagtacaaagggaggaggaagaagggagcggggtcggagccgtcggggccaaaggagacggggccaggaacaggcagtctcggcccaactgcggacgctccctccaccccctgcgcaaaaagacccaaccggagttgaggcgctgcccctgaaggccccaccttacacttggcgggggccggagccaggctcccaggactgctccagaaccgagggaagctcgggtccctccaagctagccatggtgaggcgccggaggccccggggccccacccccccggcctgaccacactgccctgggtgccctcctccagaagcccgagatgcggggggccgggagacaacactcctggctccccagagaggcgtgggtctggggctgagggccagggcccggatgcccaggttccgggactagggccttggcagccagcgggggtggggaccacgggcacccagagaaggtcctccacacatcccagcgccggctcccggccatggagcccttgaagagcctcttcctcaagagccctctagggtcatggaatggcagtggcagcgggggtggtgggggcggtggaggaggccggcctgaggggtctccaaaggcagcgggttatgccaacccggtgtggacagccctgttcgactacgagcccagtgggcaggatgagctggccctgaggaagggtgaccgtgtggaggtgctgtcccgggacgcagccatctcaggagacgagggctggtgggcgggccaggtgggtggccaggtgggcatcttcccgtccaactatgtgtctcggggtggcggcccgcccccctgcgaggtggccagcttccaggagctgcggctggaggaggtgatcggcattggaggctttggcaaggtgtacaggggcagctggcgaggtgagctggtggctgtgaaggcagctcgccaggaccccgatgaggacatcagtgtgacagccgagagcgttcgccaggaggcccggctcttcgccatgctggcacaccccaacatcattgccctcaaggctgtgtgcctggaggagcccaacctgtgcctggtgatggagtatgcagccggtgggcccctcagccgagctctggccgggcggcgcgtgcctccccatgtgctggtcaactgggctgtgcagattgcccgtgggatgcactacctgcactgcgaggccctggtgcccgtcatccaccgtgatctcaagtccaacaacagtgagtttctgggggcatggttgggggtggcatggctctggtacacacctgctcccaaccttccactgagcctagcttagggtctactgcaggtaggagctcccaccctagggggtcccagctgaccaggggtgcccatgggctcaagctagcccccaaacagagccccaggcacccagcagagtcttcctgcgccagcttcagaagtccttgaccccagcctgcagctgcggtttggacgagttaagaaattggtatctctcaggtgggccataagcatcctgcccagccatggctcccacctcaaggaagtcctctggaagctcgtgctcctcatcttctcctcccctaaattcatgttcgtggagttggtgctctgtcctcccctcccgtcgtcatgggcagctcctccagaacagatatctcagagagggaagccctccttggcagtcaaggctaaggccagggctggaattctggcctagccctccctggcttcatgacctctagctggttactccaactcggagcctcaatttcagaatctgtaaaaagggagagtgaaacagctcaacagcttgggcaagcccgacctgcgatccccaacccacagcgggtcctcagccatggagatggacatttgagggctggatcgccaagagggcctagcctgaaatcagtgcttgggatgggagtgctgggctaagggagactccatctcccatcatttcaagcccccgacacgctgcccatcatggcccaagagaagtgagtgacagcttcagagggtttcctggtgcacgcagcatttagagagagaaggcatggaagcaggacccagcacacagcagggaccaggagcaggggcctcctagagcccagagtgcaggctggagagcagcagtaggaaatgcaggaggggccaggctcagtgtggtcactggaaaagcatgagacattcttagaggggggtcaacgtggatattttgagcctcctggcctgggctgaccatggacaaggggcttgcaggaaacagagtgctgagccccagatatccaagttcttgccaggactgggggagccaggagaggcctgccaaccatcctacccactcttctcatccctggtagggtgcggttcccacctctcagcctcaaccctgggctctaactatctagggacccccgctacctgccccaatctgagggggattccccgaaggcacagggggaggggactcccatcttctgtttttcctccgttttctttccagaaaaaatggaacaatagcccaggcccctgctccccaccctccccactgcttcctgcgtttcctgctgcccctgagccggcttcctgtccctgctccagcccctgctccctccctagcccagctgcctgcaggggaggaaagagcttggggtggaggacttgcgggaggaaggagcctggaactgctcccctactcccctctagttcccctgcttccctctcagagtctgggaggtggtggtaaagggcaggcaaggtgccctcagcctccctgagcctggcatttaacctcggagaccccagtcctaggcccaagttgctgtctgcaggattggggtggggggagtccctgggctggtggggggcacaggcaggaaacaatggcatgattttcctggacaatgggggccttgtgaggaagcctggcggggagaggagggggaattctccaggcccacgagtcacaggactgaccagccagcccggcctgggcctgacctcccccagttctccccaaaaggactccccctcccaagtgggagacctggcccaggcctcccagaaaggagaagtagggaccacgggaggaaagcggaagaggtgtgagctgcccaggccactcccaagccccacagaggccagcccagggagggagctggtggccaggtccctatcagaggccagggagccctaaaggggcactgagagcttcccccagtttcggggtctctggcccattctcctctgggtgacccctgacctcccatgcctgggatctacatcagacaccagaacagcagttcgagttgggacagttgaaagcacagagaggagcttggagagaaagcagaggatggggcttagcagctggcagagccaggagcggggaggtagcagaaagaccacaagtacaaagaagtcctgaaactttgggtgagttgttgcccctctctgggcctcagattccccacctgaaaaaggtggagagtggccacccggcctgagatactggaacagcactttgccagtctggggtgccacaagtggctagagacaggccaagaagcagcaagtgttggtcttcaaaggggaaggtgggccctggcaccaggggaggtgcccatttccactccacccactgccccagcctgctgtgtttcccctttggaatgagcttgtcgtcgggggcttgctaaatgctcaggtccccgcctccagcagccagaccagaggctgttttgaagttggcagtaaggagtgacagaggagggagaggagggcggagatacgataagtgctttaggacaactggcctttaggatgcttctgccaggtggcagcccccatgcaaaaactttaaaagtgtggtcttgtttcatgctcgtgacagccatctgaggagggttttgttgtcatcctcagcttgatgaagtgttcaggactcagctccaaggtctggctcagaggagtgggtagattttgagaccattctctggattaggaaaaattgcaggaaaatctactgggcatgccgggatagtaaaggtggtcatggagggcacctggacatcaggtagagctgctgaaccaatttgtctggcctggagttgcaaatgtggaagatgccagtggggagagggagctggtacctggaagaggctgagtcagccaggggcagtgggcagaggttgaggagaggtcatgctctgagaagcaccagcgccgaaatggctgaaggtggaggacacagaaacagagccaagcagccaggggctgtgggggctgaggacggtggggcagcggggacagctggcagcagtgccagatgcctcctcaaggcccaggtggcctggccagcagcaggatcagggcttgttgctttaagccctgaaaaatgagcaccctggttctgccacctcctctgggaagtcttccctgactcaccaggctgtattaggtgcccttcccatctgccccaccccctgtgccctatgctgcccccatgacagccgtgtcacacagggcaggagagctgagaggtgtgccctgacatgggtccagaaacatggttgacttgatattgcttctcttccacagtgcagttggctgtaacctgaaaagtagaggggcccttcagacccttcatgactctatgactttgtcctctttctattcctcgaaaacttctctcatttgagccattcctgtcctggtgagagatatgcaagttgctgcttctcctctttgtaccaagtacggtggccccatttgggttaaagccatgagcccctgccaagtctgaccatccacgcctacatttaccccaagctcctcctttgtggccaagaaccatcactttcttggaccccaccctttctcttcccttccagctgcattggtaggtatcttttggagtctttgctttgggagtggctgcacttgccacagtgtgatgtgggcactaggggcctgtggtacctgctgggcttcttttctcaccaagagcttccctcttgctccccactctaaggggggttctgattcacgctcctgcctcaacaaaatgacaggagactcacagatctctcttgaaatcaaagccataaatgtccagagctgccaccttgccagttttgcttcagtgtaatattagggaaaagctagaacactggtttcagagccacacagaccaggttgtaatctctgctgtatttgttgtatgacctctgccaagtcatttccctgcttggtttcctcatctgtgaaacatgaaaaatattatttagctcataaatggttttgagtgctggggttgagtgtgaaatgtttggcctcggccaggtgcagtggcctgtaatcccagcactttgggaggccgaggcgggcagatcacctgaggttgggagttcgagaccagcctgaccaacatggagaaaccctgtctctactaaaaatgcaaaattagtcgggcgtggtggcacatgcccataatcccactactcgggaggctggggcaggacaatcgcttgaacccaggaggtggaggttgcagtgagccaagatcacgccattgcactccagcctgggcaacaagagcaaaactctatcttaagaaaaaaaaaaaaggaaaagaaaagaaatgtctgacctcaagtaggtcctcaagatctagaccaagtcacctctgtgcccccaggacccagccaggatgtccgtcagatgagtttgctcccagctcttaccctgtccccaccacctgatcctggagcatccacaatctggcccctcttctctagttttgctgctgcagcccattgagagtgacgacatggagcacaagaccctgaagatcaccgactttggcctggcccgagagtggcacaaaaccacacaaatgagtgccgcgggcacctacgcctggatggctcctgaggttatcaaggcctccaccttctctaagggcagtgacgtctggaggtgcggcccttggtggggctggacgggctgctacggggctgcagagggcagaggtggctgcctaaatctagggctgggccaagtccagggacagggacccaaaccacttggctcctagttgcttttgggtgaagtggcagtaagggggtgggggttgggagagaaaagggaacacagacctgttgtctcgcccacagttttggggtgctgctgtgggaactgctgaccggggaggtgccataccgtggcattgactgccttgctgtggcctatggcgtagctgttaacaagctcacactgcccatcccatccacctgccccgagcccttcgcacagcttatggccggtaagaggacggggagggcaggtgaggtacagagctccctggcccaggacacatccacccacggaccccttcttattctgtccccgctgcacgccgtgcccctagactgctgggcgcaggacccccaccgcaggcccgacttcgcctccatcctgcagcagttggaggcgctggaggcacaggtcctacgggaaatgccgcgggactccttccattccatgcaggaaggctggaagcgcgagatccagggtctcttcgacgagctgcgagccaaggaaaaggtgcgaggaatcaagggacccagcgttggaacgagtgtctccccgatctccctggggcagagtcggggcgggcgctgccgggattggtgccaggctgacctctccaccatcgctgtctcgggcgcaggaactactgagccgcgaggaggagctgacgcgagcggcgcgcgagcagcggtcacaggcggagcagctgcggcggcgcgagcacctgctggcccagtgggagctagaggtgttcgagcgcgagctgacgctgctgctgcagcaggtggaccgcgagcgaccgcacgtgcgccgccgccgcgggacattcaagcgcagcaagctccgggcgcgcgacggcggcgagcgtatcagcatgccactcggtgagggccgggccccggggcgtcccccgccattggctgcgggggtgggggtggagccaggcctgtgtgctcaccgcgctgggattggtttagggtgttgtgggtgggcccgtgagatgaaggctgggaggggtggagccaggagtgttttttttctgtctgtgggcgggttctggcggaagtatttgcatgtcggtctgggagtgggaaggggtggggttcacgaaagttctgggaaggtctagtgggcggggccggccggcgccagggcatctccgactcagacgagtagctttccttatccagacccaggggctcaagaaagcagtgaggctggtcacagtctcacagccatcgtgccgctccctatgtggcctgggagctggccttgggcccctgcaggttggggtcctggctctacttcatcacaaacctgaaccctgctccccccaacccaaatcccagacttcaagcaccgcatcaccgtgcaggcctcacccggccttgaccggaggagaaacgtcttcgaggtcgggcctggggattcgcccacctttccccggttccgagccatccagtgtaagaaacttcacctctcatgcccctctccgccccccagctccttattctctgtcagaccttattcttggaggcggagcccactcactatcccctcttcctccccgcccccaggctccctgccttaggtctagcctgttacctctgaactccccaagcagcattaattttacttatttttttttagtcaaataattgtatgacactatgtactactaattttctaaatgctttgctaatattaatttcttgcaataattctatttggtagttatttttgttgttaatttaagttttatggatgagaaaagtgaaaaaagtaacttgttacacagttaataagtggaagagccagaatcaaactcaggcagttggtgtcagtgtctgtactaattactaagcagcaaacttcagcccaagggctagatgagatgccccaccccactgttggccccaagacccaaacccatctatcttgcccaaagctcaccctgggaatggtacagggcccagcctgctccccatactctaaagtttatccctgaagcctgactgtgatgatggagggagaataaagattatctccgatttcatcggtttcccctgcagtggagcctgcagagccaggccaggcatggggccgccagtccccccgacgtctggaggactcaagcaatggagagcggcgagcatgctgggcttggggtcccagttcccccaagcctggggaagcccagaatgggaggtgagtacctgagtgccccccagacccagcatcatttgctttccccaagtcctgaaattcctaaagcacccctccttgccctcccatcaccaggagaaggtcccgcatggacgaagccacatggtacctggattcagatgactcatcccccttaggatctccttccacacccccagcactcaatggtgagtggccttcctcccccggcaggatctggctgagctccttccgtgggcaccttggggaggccacaataggctagtaggcaaagcaggagtcctgccctggttgctctcattctagagactaggaaaccaaggctgagacaagacagagccgatcctggaacccaggtctgacctacaggcccacgatcaagcggcatacagcccaggcctcggctcggggcccagagtctcatccccttgctcagacctggcctgcaagaagcctcttccctggccccatggcagcccctgtgcctttagcaggctccagggagaaaagaaagacaggaagcccacctggcatttggtacccaagggaagctggacccagatgggggaaggaatcagcctgtgtggggtggagccaaacaagtgtcagccacactgtgcttctcagagccccttctgggagcctgtaggtgaagaagagaatgagaaggccgagcaggcaggatccaggacccattctcaccacatccaggatagctcggggcctttctgttctccatgacggtaactgccctactgtgccaggcattccctccaagcattgatgaagaggggctactattaccccattttgcagataaggaaactgaggctctgagaggtgaagtaacctacctcaaacccccagctgaggatttgaacccagagaggcttcagctccaatgctctcgtagtgagctcagaagctttcacttgaagaaagggcttctcacgtatagactgcttaggaagccagagggtcaggcagaaggcagggctccagcattgcagggaggagggctcactcagctcaacactgcccagctctgagtgaggccagagagttatggcctcccttgcctgtgggtccctgtgccaacctagggaccatcctcagagcccccacacctgctgctcacagccagaatgtaggacccgcttagctgctctcagaagagtcctgttcagcaagccgtttaaactcactcctcccatcccacccagcccatcgcctcttccattccctgagctacacttgatagttgtaacaacagctaacctttgttggttctcttctatgtgccaagcagttctgtgaggggagtagtagtattggcctgcattttacaacagagaaaactgaggcacagagagattaagtggtttgatgtaaggcaaccagtagagcagggatttgatctgctcttgcctgtctgaccacagaggcagagccctgggcctccatctgccccgccatttgctactccagcagctgcactgcccccagcatctgtcctgcagggactgaactgagagctggaaggccaaggaggcttcttgaattcacttgctctaaattgtaccaggccagatgggccaaaggagaacttgagagcctgtcaacccaggtgtgtaggctgaagcaggtcctgactgttccacagaactctctggccctcagctcccagaagcaggggcacaaggggcctgggccccatcgttctcaagcttgccccatgtttttttatccaaagaatttgttaattatttatgaagagaaactacttattagcccatatattcatgaatagttcaggtcagtgacaaacttctaagtaattcaacccaaagaaattcttcatattccaaaatcactttgcattctgagagatagcagccttcctcatctcctcgaagtatttcatggcatcataacttctgtagacatctgtgcccatagaaatctgaaatgccttctttcttggtccagcccctgcaaactgagagagccgcagcccccagggatacagtgaatgctcccacaatatgaaattgcagatgtgtggccagaaggccacatgtctgaggtttcatgaaagcactggaaaccatggtagttactgttcttgataagtatgtcggcctcaacaccagtgcccttcctggctgatgaagaaatggattgccacttgccctgaaaggatgtcagctgcccagctcagtggctggctgagcatctggttcccctagcccaatcccacactccacgcatcatctgggtccatgaaagtacatgacattgacctcacagccaccccccgaaacccagctaagaatcaaataatggggcttcacagaggtcccagaccctgtgagatggtccccggcataagccataccactggagagtcacacacaccctcaccctgtccccagtgggctgttctggtccctggagagctggctgcaaggagtggcacattggcagggtgcactcagctacgctgatagcaactgccctgtgaagcttgttgccttagagccaataactacgtggctgtgtcctccctgtgagacctcacggaagcagtttcgcctctatctatctatctttgggtcaagaatagtcacgcagctttctcctaaacaacagagttgctaactcttgctgccaggaagcttagaggcagattcaaatcctagctggattatgttgaccaagtcccttacccttcagaacctcagtttctcaggccattgactgcaggaacttctgttcactctcattttgtctgctggaccctatcttctcttccctttgtctcatttctgtcttttatttttttaaagatagagtctcattctgttacccaggctggactgcaatggcatgatcatggctcactgcaaactctgcctcccaggctcaagtgatcctcccacctcagcttcctgagtagcagggactacaggtgcatgccatgcttggctaatttttatattttttgtagagatggggttttgccatgttgcccaggctgggctgcgcttaagtagtccacccaccccagcctcccaaagtgctggcattacaggtgtgagccaccacacccagcttgctcttgctattttctttttttttttttagaaggagtcttgttctgtcacccaggctggagtgcagtggtgcgacctcagctcacttcagcctccacctcccacgttcaagcaattctccctcagcctccccagtagctgggattacaggcatgtgccaccatgcccagctaatttttttttttttgagatgaagtgtcattctgttgcccaggctggagggcagtggtgcaatctcggctcactacaacctccacctcccaggttcaagtgattctcctgcctcagcctcccaagtagcagggattacaggcatgtgccacaatgcccggctaatgtttgtatttgtagtagagatgaggtttcaccatgttgaccaggctggtcccgaactcctgacctcaagtgagccacctgcttcagcttcccaaagtgctgggattacaagcgtgaaccaccatgcccggcctaatttttgtatttagtagagacagggtttgaccatgttggccaggctagtcatgcactcctgacctcaagtgatctgccctacttggcctcccaaagtgctgggattataggcttgagccaccactcccagcctctcttgctttttttttttttttttttgagatggagtctcactctgtcacccaggctggagcgcagtggcgggatctcggctcactgtaacctccgcctcctgggttcaagcgattctcctgcctcagcctcccaagtagctgagactacaggtgcgtgccaccatgccctgctaatttttgtattttttagtagagacagggtttcaccatgttggccaggatggtctcgatttcttgacctcgtgatccgcccaccttggcctcccaaagtgctgggattacaggtgtgagccaccgcacccggccaactctttcttttttttaaacatgatttcccctcttctgtttaaactcactgtaaatgatcagttcttcacctgcgaagtgggggtgataatgataacctcgtggttggtgcaaggattataaaaatggattcttcatcaaacaagaatttgcttttttttttttttgagacggagtctcgctctgttgcccaggctggagtgcagtggtgtgattttggctcactgcaagctccgcctcctgggttcatgccattctcctgcctcagcctcttgagtatctgggactacaggcgcccaccaccacgcctggctaattttttgtgtttttagtagagacagggtttcaccgtgttagccaggatggtctcgatctcctgacctcgtgatcatcccacctgggcctcccaaagtgctgggattgcagatgtgagccaccgcgcctggcccagggatttgcattttaagagccaggcatcaacatgttaaacactgccctgacctcatatgatgaagcaggcagactcataaacaagtccagtagcacctctatgaggcataacgtgagcaataactgtgtaggttcagggagattctgggagggcttcacagaggaagtgacatcccagttggtcttggatggtgcataagaggtcactgaaagccaaggtgggaaaggtcagccacccagagtgaatagtgtgtgcgcaggcatgcagctcaccatacccaaggaaaaggcaacctggctgaactccgagaagagttgagagccgaggagtctcaggactggggctgcggacaggggccaaggcacatgggtcagtagatgttgattgaatgaatgagtgaatgaagctggaagtgatgggtagtttttaagcagagacctgtctttaacaggtttgcattttagaaggattcccttgtcccttcagtggcagtggccggggtgggagttgggtgaggtaagaggcagagagtctgagtaagggttggggctgacagaagggactgtgagctaagtcctggttcatagtagaagctcatttttcccagccttgtatttctccctcccgacatccaacctgctgctgcactccaggcaggaggggaaaggcagagggacaaggccagggagggcttcagaggaccagccaaggaggccagactttctcctagtgacagtggagagccacagcagtttctagagccaaggagggatctgacaaaatcagggcttgtgagagcccatcctagagtcccttgtccttaatgaggggttccccatccctgcccaagtggtctagaatggagtcaggccaaccctagactggaaggtaggacactagtgtcttgaaatctagggcagagtctggctgggaaatggtggagagcaaaggttctactgcccttgcctggggtgaggccggctccacctttcactggctgtacagctccgcacaagccctcaacctctctgagcctggaacccctggggcatgagaatcagacaacataatgcccctatgccattcagctcaggcctggcacaaatacatactctgtaaattagctgtgaccttgggcaaggtactgacccctctgaacctcattttcctcctttctagaatagagacagggatttatgccctcagggctgccatgtaccttagagttgactgtgtgcatcttataagctacagctggagcgggggtgggtgggcagaaggggcagggctgccaagccaggaagctggtgggcacagagcacagggcgccggtcccagtcagtgggacctgccatgcccctgggcctggaggttgcccctggcaggccacagaggcccactgtgacctggccccagcctgcctccactgggactgcccatccatctttcgggtctggggtcgctggctgccattgggctttgctgccgcttcctccacctgcactgccctcccctcccagtgcccatcttgtgaaaggccagaatgtgggtatgtgatggggaggccatgggacctgtgggaccagggaagatgctagtagagggcagaactcagtccttgttccaagaccacggagaggtcttgggccctcacccggaatatgcaccagccacaccctcacctgtgccgcctctgcccgcaggtaaccccccgcggcctagcctggagcccgaggagcccaagaggcctgtccccgcagagcgcggtagcagctctgggacgcccaagctgatccagcgggcgctgctgcgcggcaccgccctgctcgcctcgctgggccttggccgcgacctgcagccgccgggaggcccaggacgcgagcgcggggagtccccgacaacaccccccacgccaacgcccgcgccctgcccgaccgagccgcccccttccccgctcatctgcttctcgctcaagacgcccgactccccgcccactcctgcacccctgttgctggacctgggtatccctgtgggccagcggtcagccaagagcccccgacgtgaggaggagccccgcggtgagtggcctgaagccggcctgcttcacatatgggagacgggggttcccagggagggaggagtggctggtggggacatgcaaggaggcaaggccgagaccacagtcatcagctggaccctgaaccaggcattcggggtactgaagacgcatgtagggagcagagttctaagttcagctatcaggtggtccaggcaggtgggggcgatgcctgctgtgaaataaaagaagtaatcgggccaggcagtggtgcacgcctgtgatcccagcactctgggaggatcacgtgagccttgaaaggttgaggctgcagtgagcggtgatcatgacactggactccagcctgggcgacacagcatacatgtaatcataatcgtagcaaactcctggctccttacttgtgccaagtactgtttgcaaggctttcccgagatggtctcatttagtcataacaaccagagaactaagcgctcctggatgcccatttttagatgaggaaatttaaggcacagagattaagggacccacagctcccacagctagtaagtggcagggccgggatccacatccaggccagcctgctgcagaggcctcactcctaactattacaaaaaacagaggcaccacggagcaggaagggcggtggaagttgagtcaagtaggtcactgtgcacatggggaaactgaggcccagagcaggacagtgtcttggggacctcagcagttgggggttgcttgaccctgtgcccctcctatatcctcacaggaggcactgtctcacccccaccggggacatcacgctctgctcctggcaccccaggcaccccacgttcaccacccctgggcctcatcagccgacctcggccctcgccccttcgcagccgcattgatccctggagctttgtgtcagctgggccacggccttctcccctgccatcaccacagcctgcaccccgccgagcaccctggaccttgttcccggactcagaccccttctgggactccccacctgccaaccccttccaggggggcccccaggactgcagggcacagaccaaagacatgggtgcccaggccccgtgggtgccggaagcggggccttgagtgggccaggccactcccccgagctccagctgccttaggaggagtcacagcatacactggaacaggagctgggtcagcctctgcagctgcctcagtttccccagggaccccacccccctttgggggtcaggaacactacactgcacaggaagccttcacactggaagggggacctgcgcccccacatctgaaacctgtaggtccccccagctcacctgccctactggggcccaacactgtacccagctggttgggaggaccagagcctgtctcagggaattgcctgctggggtgatgcagggaggaggggaggtgcagggaagaggggccggcctcagctgtcaccagcacttttgaccaagtcctgctactgcggcccctgccctagggcttagagcatggacctcctgccctgggggtcatctggggccagggctctctggatgccttcctgctgccccagccagggttggagtcttagcctcgggatccagtgaagccagaagccaaataaactcaaaagctgtctccccacatgtagcctgtcacctttcttggaggtaaccaggtgacccaacctatcatacaaccctggtgtcctgatgccccaacaataggcagttggatgccttgtactgcatgcctctcctgggaccaaatccaccagccttggtcagtcattcaaggctcttctcggccaggtgcagtggctcactcctgtcatcacagcagtttgggaggccgaggccggcggatcacatgaggtcaggagttcaagaccaacctggccacatggtgaaaccccatctctactaaaaatacaaaaattagccaggtgtggtggtgcatgcctgtagtcccagctactctggaggctgaggcaggagaattgcttgaacctggaaggtggaggttgcagtgagccaaaatcacgccactgcactccagcctgggcaacagagcaagactccgtctcaaaaaaaaaaaaaacaaaaaaccataggccgggcatggtggctcacgcctgtaatcccagcactttgggaggccgagacggacagatcacaaggtcaggattttgagaccagcctggccaatatggtgaaaccccgtctctactgaaaaaaatatatatatatacaaaaattaaccaggcgtggtggcaggtgcctgtagccccagctacttgggaggctgaggcaggagaatagcttgaacccgggcggcgaaggttgagtgagccgagattgcaccactgcactccagcctgggcgacagagcgagactccatctcaaaaaaaagagtagtaagttccacccacctcccagtatggtgacttgccatggcatctggcacccctgacagttctcttcacactgccatgggggctctggcactcccacaccataccctagggcagggtccctccctcggcctctgtccattctcttcacactgccatgggggctctggcactcccacaccataccctagggctgggtcccttccttggcctctgtcctcagcccctctgacgttagaggagttggaacccaggctcccccttcccctctcccaggtgccccatggcagcccagactctgtgtctgcagttcaggggcagggagtcaggagggcaggcacaaagcgttctcaggaagaactggcaatcgggcgcaagggtatcatctgcccgggtgctctgggcaccctggagtcctctccccacctcccacccccacctgatccttcccagctgccaccattcctctcccaccacaccacccaggccaaaatcactccatccatgacgcctacagtagcccagcgtaggtctccctggaccacatttatcctcaagggcctgtgtccttatccccccttcacccccaactctcccctgccacagccagccctctgttcctctcacaccccaagctcattcctaccttcactggcctcttactccccagctgaaatatcacctccttagcagagctttcccagtgagataacccccccgctccccgcagagctctcccatcacccagggtgtttccttcatggaactcatgacaatgtgaggttgccatgtttctttgctaagaggtttcttgtgtaaacaccaggaaggaaaggacctgtgcctgtcctcttccctaagcacttgaatgaatgaatgaatgaatgaatgtggtatgggtgcctgagtgagcaggaccttgaataagtgtgaggtcctctctaggcttcagcttcctccgcctcctcccctcaccgcagccgccttcctccacccatccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtc

SEQ ID NO: 13661 - DNA, 14097 bp, Human
gcaagaggcagcgcacaggctgggtgcacacatgcacagatctcacttccaagcgtgcagagctcagcccacaaggagcggggcttgcacagaccccctccctcatgccctcctactccttcacacactatagcccaggcccgagcgctgaatgtgcccagagcttggctcatggagccaggggctacacccgtcacacacacacatagctagcgacactcacctcattcttctcagtctctcagcagccttgggaggggacagaaataattaaacccaatttttttctttgtttttttggagacagtctcactctgtcccgcaggctggagttcagtggcgcgatctcggctcactgcaacctctgcctcccaggtttaagcgattctcctgcctcagcctcctgagtggctgggactacaggtgcgcaccaccacacccggctaatttttatgtttttagtagagacagggtttcaccatgttagctaggctggtcttgaactcctgacctcaggtgatccccccgccttggcctcccaaagtgctgggattacaggccacagccaccgcacccggccagttaaccccattttagagatgagaaaacagaggctcaaggtcagcatgggagtttattcaggagaaatcaaggtagaagcacctgggctggggagccgactcttgcttggttctggaggccccagacgaagggtgtgtggagcccctcctccacccccctccggcccagccccgcatgatgttgctggatgctgcatgaagacccaccattagatgcctgtacccccagtggaggttccccagctccctgtcctcactgcctactccatccagggcttgcctgggtgtggcttccctcaagttctcacaccaccatttgcacctgcctctggcgtcacgtttccgcacttagcaggtccctggggctttgggtgtctcaatcttgcatcctgtgagaccttgaacctcagcccaacacccaccccccaaaacctacgcacacagacagcagtgggcaggtgcagccctgcttagggcctggagatgggcagacccaggctcacatcctagctctgacacggaattgcttcaggcaagagcatctcctctggacctcatctgaccatctgtcacatggggttcagacctccctgtctgcatcagtgagaccaggtaggcagaggtccctatgggtccctgtcattgtgactcctcttgcccccaagcctgggcacagtagcctgcaagaaggtgagttggcctgtccttcagggcagggtgactggggtcccatgacagctgctgtgaccccagcaccttcctcaggatgtgggggcctggcagagggctgggcccacagttggggctacttcctgtgctgaaggaagtcctcttgccattcctgctgccctgccgctgcctccctgggaacccatgtgtccttgtggtattgaggccttgaggtccagggcactgagatcagacctctctgggtgatcagctctccagggaccctgaaggaagtgggaggggcagggaggaaggtctctggggacaggacgtcctccctttgttaagtgggcaggacccagacaccagtggcccctgggtttcccgtcccagccaatacaagtcatctgtccggttgggctaggtcctggtgggacccttactctgggcccaggccaaagctaaggtgtgtgggtggcgactgggggaccctggcagtcccagggctgcccaggctccaggaccctcaggaccaagacccaacagcccagcctctagccttgcccagctaagctggggagggggctggaaactttagccctaggcagacaaggaagtggcctggaaagcggaagcagctttgatggtctcggagggggccggaagccaacacgggtggtggaggaccaggctgggggcctgggttcctgttttctgcccaggcccctctgagcagccccctcctccttcagggcaggaactgctgccacaacctcaggctgggcaccaaacacccgtgcccgccaatgcggcccagcccccggagagtcaggcccacagagcatgcccatgtgggccggcggtgtggggagccctcggcggggcatggcccctgcgtccacagatgacctctttgcccgcaagctgcgccagccagcaaggcccccgctgacaccgcacaccttcgagccgaggccagtccggggcccactcctgcgcagcggcagcgatgcaggcgaggccaggccccccacgccagccagcccccgtgcccgtgcccacagccacgaagaggccagccgacctgcagccacttccacccggctcttcactgacccgctggcactgctggggctgccagcagaggaaccagagcctgccttcccaccagtgcttgagcctcgatggtttgcccactatgacgtgcaaagcctgctctttgattgggctccgaggtctcaggggatggggagccactcagaggccagctctgggaccctggcttcagccgaggaccaggctgccagctcggacctgctgcatggggcacctggctttgtgtgtgagctcgggggtgagggtgagctaggcctgggtggaccagcatccccacctgtgccccctgcactgcccaacgcggccgtgtccatcctggaggagccacagaaccgaacctcggcctacagcctggagcacgcagacctgggtgctggctactaccgcaaatacttctatggcaaaggtgaggaaaggcagttccagggagtggaggaggggggctgaagaagaggtccctgtcacctgcagtgcacacagtagggctcatgaactgtccatttcctgtaaagtccctggccctgggagggctcaagagctgagctggggtcctcctggacctactttcaaccaccttcttaaggctaatccctggctcctcacccccagccagggctggtccctctgcctccgtattggttcatcctccatctggttcaacctgccaggctggggagagattccctatgggcttttctgtggggtgaaaactcaggcctcaaatccctgcatccgtgaaccttgttcgcaccagcactgcggagagagggctccaggacatagaagggagaatgagggcgtggtgggtggagccaaggcaggatttaggcctgggagctggccgcgtgggtctaggtctgggtctgggtccacctctgggtcagggttgagatcaagatattgagctcggggctacagaggggcgggacttagtctagggtcaacatttggtggtgagatgaagcctagggcggggcttagtgatgcgcgtggtcgagcgggggcggggctgccagagggcgggaccaatcgttttcttcggcgcggtcccccagaacatcagaacttcttcgggatggacgagtcgctgggcccggtggcagtgagcctgcggcgggaggagaaggagggcagcggagggggcaccctgcacagctaccgcgtcatcgtgcggaccacgcaggtgggccgggatcgcgggatcaggacgtgggttgcctccccgacaccttgtatgcatcctgagtgcccttacaccccttcctcagctccggacactccgtggcaccatctcggaggacgcgctgccgccggggcccccacggggtctgtccccaaggaaacttctggagcacgtggcgccgcagctgagccccagctgcctgcgcctgggctcagctttcacccaaggtaccacggacgctgctcacactggatgagcaagtggtgagtggcgggccgcggagcccccagccatacagctggccccagtctgaacccagcctgcccagctcccaaacccctagccttgaccctgatcctgggctgggtggtgaccccagaagagctggcttttcagagacagggcatcagagttcatctggagccttgcgtctcaaagtgagctctgtagaccagcagtatccacatcatgtagaaatgcagattctggggccccaccccagaccatctgaatcagagtttgcactttatttatttatttatttatttatttatttatttatttattttgagatggagtctcgctctgtcacccaggctggagtgcaatggtggaatctcagctcactgcaacctctgccttccgggttcaagagattctcctgcctcagcctcctgagtagctgggattacaggtgcatgccaccacgcccagctaatttttgtatttgtagtagagatgggggttttaccatgttggccacgctggttttgaactcctgaccttgtgatctgcccacctcggcctcccaaagtgctgggattacaggcatgagccactgcccttggcccagagtctgcattttaaaaagatatttgcagccctagatgccctggtctgactcaccccactggtcctgcagttcccgcatcattcctggccaatttcccccacagcccctgctgggtttcctctaacatgtggtgctcacagcttcctggagcggctccttccatcccccactccatgctgaaagctgcccattggctgagtcttctcctctgtatcattcaacccatcagtcattcaacaaacatttcttagacctttttggtgccaggcctcagactggatgctggggacaggtctagaccaggtgctttgcttgagtagctcacagctgggtgggagaaagagacccacagagaactgctgaaacacaggagcagtactggaacactgaaagggaatgttgagggctgcctgggccacgacggtagtgatgagagcccttccttggccagggttttccagcatggagaacacaaaagggctcaggcccggataagcaggtgttttctggtcagaaggaataacttgtgcaaaggcttggagaatgagagcatggcacattaggcagtcagttcagcgtggctggggttgggattgtggggaggggcgggggagaagcttgcatttgttcccgtggacactggggagccatggagggatacggtgcagatctgagaggggcagctctctggctgcagcatggggactagactgtacggggcggggatgccaggctgaaggctattgcagttgcccaggctagacacagtggcagcgatagtggaggtgaagaggaggtgacagtccaggaaggactgggtagtcatgtggctgactggaaggggtgaagtgctaggatttcccagcttcttggcccccaggagtggtggtttaaggaggaggagcagggtgggggagtcacagcaaggtgagacattaggcagccggagaaaaaggcccggggtttggtaggccggtctgaatgggaggcggagatgggggtgtcatccttgctgcagccagggagggggaggagcatgggtggagaagaggcccaggcagaagagggcggggttcctggggccctaggcaaggtgagtttccagctatccccagtgccacctatggctgagagggtaccaggatgaggccacatctggggaccatatggggagtggggggtgcagggggttgggaggaatgaaatcgaagtggggactgtaagtgcagacaagtttagttgtagaaaagggaggtgaccgctggaggggagcctgtgctgtttggaggagttcagagcaccttgagctgggcatggttatccagttatccgcagagggaagagccgggaagagggcacagaaatgggagcatggggggcagaggtggtgcctggcctgcaggggctggggtgggggtgccttggattcaggggtgcagaggacagtccagccttgagataaggaggatgataatgtgtatgtttattggaagggtcctttctgtgaatcaccttctctactgccacatgggaaccagcctcctcccatcccttcctacctgtgcactcccaagcacgaggagcacaacagactgtactcacctgacaggcaagggcacaagtggctcagagagggctggtgctcagccccaggccagcgtcccatccattccctaagagctggtggggtggggctgcaggggactgagacctatgccttctgtctcccacccacagctgagcttccaacgcaaggtgggcatcctgtactgccgggcgggccagggctcggaggaggagatgtacaacaaccaggaggcgggaccggccttcatgcagtttctcaccttgctgggcgatgtggtgcggctcaaaggctttgagagttaccgggcccagctagacaccaaaagtgaggcccaggggcaggaggggtgggagcagatctgtgctgaaggggtgagcacaaattgccttgtcactcctttgtccgtacaatcctggggctggggactggagagttctttgggtgagctaaggatctgagtcagggctatgagggccaagctatgggctgaaaagaggggctgggactgtccctcaaggcccaagtaccctactgcctgagctggggctaaagtggtttgggggcactacccctccaccaaacacattccagcagctcagcctcgtggaagagaggtgcccctacctccctggtggaaggggccccaggacccctgggaggtgttgtactgagcaccccctgcctgcttttcactttcccagcatgccacacatgcttgggcctggagtgacacctgtcctcctaggacacctgaccctgccctccctctgagaccacttctcatttctgtcttcattctatttcaactctcccatcctgaccccccttcactctggcatggggctggagcctgtggagggagaggaggaggggcacccagggctgaggcccttgaatctcgctggctgggcattggctggtggcatgactggttgtccacctgctgtttggggcacagaggctcctgtgtacaggcaggaatggcaagttcaagccacttagattccccttgttttctccttctgtgtccctaacttcctggccacagcggattccacaggcacgcactccctctacaccacataccaggaccacgagatcatgttccacgtgtccacgatgctgccttacacccctaataaccagcagcaggtgtgagggggaccaacgtgggggtggggcttccgggaaccatggagggccctgcatggcccatgacgtttgagctttggccggagctctgttggccccaacagcccgcccctctggtggccccttcccaaagacagaaacaccctaggtcttcaccaggggcagtgggggagccattggtgccttggctttctcctgcctgaatgaggaggggtttggggcacagaagacctcatcacgagcccctactatccaacccctagctcctccggaagcgccacattggcaacgacattgtgaccatcgtgttccaggagcctggcagcaagcccttctgccccaccaccatccgctcgcacttccagcacgtgttcctagtggtgcgggcacacacaccctgcacgccacacaccacctacaggtgggcaccggagtggtcccaggtctcccgtgggcatggagtcctgccgcccctcactaacgcctccctccccgcagggtggccgtgagccgcacccaggacacccctgccttcgggccagctctgcctgctggcggaggccccttcgcagccaacgccgacttccgggccttcctgctggccaaagcgctgaatggtgagcaggcggccggcacgcgcgcagttccacgccatggccacgcgcacccgccagcagtacctgcaagacctgccaccaacgaggtgaccactacgtcgctggactcggcttcacgcttcggcctgcctccctgggtgggaacgccgggccgctcggggcccaggcgccgactgcaggcagcgggctcactggtgtggggagtgcgcgcggcgcccggggcgcgggtcgccgccggggctcaggcgagcggccccgaagcatcgaggtgccctgcctgctgggcatctcggccgaggctctggtgctggtggcgccgcgcgacggccgcgtagtgttcaattgcgcctgtcgcgacgtgctggcctggaccttctccgagcagcagctggacctgtaccacggccgcggggaggcgatcacgctgcgcttcgacgggtcccccggccaagccgtgggcgaggtggtggcgcgcctgcaggtgagctggagtggtaaactggggcccctgcgcgcggcggggcggagcctgctttggacccctccctcccgccgcctttgtcccctactcctgcggaagggaaagtcgaggagggcagagccagccccggggcttggcaaggccggaactggtgccctcgggtaagcgacttctggtcttcatccctcgggcggtggcacacgcggccctcggggactgtggaaagttccgtgtggcctgggacgcagtccagggggcgggcgctggcggccccacctcccggcagccccgcccactcgtcccgccccgtccgcagctggtgagccgtggctgcgagacccgcgagctggcgctgccccgcgacggtcaaggccgcctgggcttcgaggtggacgccgagggattcgtcacgcacgtggagcgcttcacattcgccgagacggcggctgcggcggggcgcgcctcctgcgcgtgtgcggccagacgctgcccagcctccggcccgaggccgctgcccagctcctgcgctcggcgcccaaggtctgcgtcaccgtcctgccccccgacgagagcggccggccccgcaggtcagggtgccggggacgcggggaggtgggagggccggcagttggccaccgcgcagtctgcgcctcccgggtcgccatcagcagtttcaggaacccagtgtggatacctttccttctggaaagaatctcccgtctcttagcccgtctgagcctgtctcttcctgtctctgtctctctctctttctctgtccttccttcctctctctctcctctctcttttttttttttttgagacgaagtatccctcttgttgcccgggctggagtgcaatggcgtgatttcggcttactgcaacatccgcctcccaggttcaagcagttctcctgcctcagcctcccttgtagctgggattacaggcatgcaccaccacggccggttaattttttctatttttagtagagatggggtttcaccaagttggccaggctggtctcgaactcctgacctcaggtgatccacctgcctcgccctcccaaagttctgggattacaggcgtgagtcaccgcgccctgaacctctatcttcatatgtagaatgggaccagttaagcgcgttgctcccactgcttaaaagatcaaatagcagcccccactatctttttttttaagtattggcacccgcccacccaacacacacactacacactattgataacttcctgtgctaagccaggggtaggcaaacattttctgtaaatggccaaataataaatattttaggctttctggaccatctggtctctgccgcagctactctgtcgtaggtaaatgaataaataaatgtgcctgtgtctcgctaaaactttatagacactgaaatttggattttacatgattttaacttatcatgaaatattcttttgatttttccactagttaaaaatgtaaaatccggaccgggcgcggtggctcatgcttgtaatcccagcactttgggaggctgaggcgggtagctcacctgaggtcaggagttcgagaccagcctggccaacatgctgaaacccgtctctagtaaaaatacaaaaattagccaggtgtgatggcaggcatctgtaatcccagctacttgggaggctgaggcaggaaaatcacttgaacccaggaggtggaggaggttgccatgagctgtgatcgcgccattgcactccagcctgggcaacaagagcaaaactccatctcaaaaaaaaaaaaaagtaaaatccatgcttagctcgcagtacagaaactggcacatctgctttagaaaagaaaaggaaaaggcacaggctggatttggctacagacagtagttttgggatttaagcaatttacacgtgttatttaaatcctcacagcacactatgaggttcgtactattatccccatttcacagatggagaaattgatgttcagagtgatttgcttgggatatacaggggcagcactggaatttgaaccatggtctggaaaaatggccagtaaccaggcagacatttttcactgttgtcaggatgccggggagctctcctgctcctggaagtgagcctggcgggctgggggtggggctagtgatgcaggacgctggggactggagaagtcctgcctgaccctgtcccaccccacaggagtttttcggagctgtacacgctgtcgctgcaggagcctagccggcggggggccccagatcctgtgcaggatgaggtccagggggtgaccctgctgcccaccacaaagcagctgctgcacctgtgcctgcaagatggtggcagtcctccagggcctggggatctggccgaggagaggactgagttcctgcacagccagaactcgctgtcaccacgcaggtgcacactcttggccttccctctcctccaggcctctgggaaagcggcttccctttctgagccacccctgctctccccagctctctgtcggatgaggccccagtcctgcccaacaccaccccggacctcctcctggccaccacagccaagccatcagtacccagtgctgacagtgagacacccctgacccaggtgagcagaaaccaggctctggagcccaacagcacagtggtgacagtgggcatcactgaatctgtatccacttctgtggcacaggacaggccaggcagtcccagtggctctgaggacaagggcaacccggcgccggagctgagggcctcctttctgccacgtaccttgtctctgcggaactccatcagcaggagtgagtctggacccaggagagcaggggaggggttggggggtgctcctgggcttccctagctcagcctgctccttgtgcccacagtcatgtcggaggcgggcagtgggaccctggaggacgagtggcaggccatctcggagattgcctctacttgcaacaccattctggagtcgctgtcccgagagggtgaggccaccagggtgctgcggtaagcctgggcagtgctcttgccccctttctgacctgcccacctgatccctttgtccccacaggacagcccatcccagagagtggagaccctaagggaactccaaaatctgatgctgagtaagctccccaactccccacagccgctttacctgcccacatgacccccccttcgtgcctgtctgctggggtggagctctgtcctgggctctgctgccacatatgcctagaagaccagcggggcccctctcattagctggggctgggagtcagctggtgcactgccccctgccttggtcctgctgagtcttgacccccatgtcttcaggccagagcctgggaacctctcagagaaggtctctcacttggagtccatgctcaggaagctgcaggaggacctgcagaaggtgaggggtgggctgagcttggggggagtcacagggctgccccaggaaaggggctggcggctctgactcctgtctccccggcaccccaggagaaggcggacagggcggccctggaggaggaggtgcggagcctgagacacaacaaccggcggctgcaggcggagtctgagagtgcagccacacgcctcctcctggcctccaagcagctgggctcacccaccgccgacctggcctgagccgtctggaaccacctgggcccctgagggcactgtggtcacactgggccctcctcaggaactctccctgcgcagaggcgtgtcttagcactgcccccctccctagccccttatttggtggcggaagtggcctccaccccttccctgtttgtaaatattctgtggagaaaagaggacttcagggagtaaaaaagccactgatgtctgtgtctgaacatgtgtccaagacagggcagggcaaggggttttgcctccagaggccccagccaaactcctcggaccagtcaggacaggccctgggaacactggctcagagatgggctggcactcactgaggggtccctgaggccaggccactgcttggcttctctcccataacgtttatttggttctgcagggaagcaggtggccacaccccacagctaccctggccgtgcatcacaaggccctgtgcctcagtgcaggcctcactcttctctctgaagccactgagcccccaggccttgtcctctctctacccacctggccacttcttgcagggcccaattccagaggcggtggcatctccgcctcagttgactggggctgtttctatgtcctggaggaaacgggcccttgacccacttccctcctcaccagcctatggtcctctctgttcctcgcgaggccaggcctttccccgaagtggcatcatcaagtccaaacttgggactttgtctaaatcctttggtttctggacctgaggcccagatagggcagacttgcccagcatctcatgcctattccagtcccttccctaggctggctgaagctccatggtgagacctaggccctgggtctgttaacttaggtgctggcaggatgagctaggctcggagaaacagagcatctgaggatcaggaaggcttcatggaggaggtaatatgagggctgagttttgaaggctgggtaggagttcaccaggcagagacgtcagaggtatcctggtaggaccagtctggctgaggcctgctggactagagccaaggcacacccaggaacccagcgtcaaagaagccagatcagaaagggttgtgaaggtgcactagggatcctgggttagcagttcccaagactgccactttttcctggttgtggactagtgtggaaggctgtggtcactgagggtgtgtctgcagaaaactcggatctggtcttgtggttgatgtttgaagggagattgatggggtgagatctggatgtcagagctctttggctgcagggaggcggctgtagccgcagtccagtgggaggtctagtggtgacttaaactcagtgatagcagtgacagtggggagaagtgggcagattttccaggacctcgtggaaggactggacgcaagttactaagggaagaggcggcatctacggtagtggccaggtttccggctggagcccttggaaggtggcagggccagggctgacagggaaaaggagaggcaggctggggatggctgaggtcatttggaacaggatgagtttgagaggcccgaggacgtcagagtggagatgtccaggggctggtgcgcaggggagagagatctgggttggatacgaggacttggagctgctgagccatgagcatgatggggtcattcacgaatgagagaagaaccaggagaggtcttcgtgggtcacgggaggtcgcgggaccgagaaagccaagaggagggaggcgcagcctgggctgcagggccttggctccctggtttccctctgggcctcgggtcgcggacctccggtcggggtccctgcgcagctcagccgtcggcttcctcagcgttaggagccttctcaccccgcccgcttcctccccgaccccgcctcccaggcgctccccggcagcttcgcccgggtcctgacctggccaccgcgagcccgggctccgcccctcgcgtgggagttccgccgaggcccgccctcgctccaagccccgcccctggccgcccccccggagccggagccccgtggaaaacgccacttcctcgacggaattggcctgccgtctcgccggcgccgcccgtcggagcctgcacccagggccttttctgttcctaggagactcgctgaattttgggacgcgtcccgctgacgataactccttttcccctgctattgtcctcccgcgacggtgcgaagcccaaacgaagacgccatcggcctcggcggggatt

SEQ ID NO: 13662 - DNA, 9052 bp, Human
  misc_feature (1)...(9052): n = A,T,C or G
cgcagatactttgatgaaggggcgtggctcttagctgctccgagaggtacagggcggggcctggaaaggggtggcacttgtgactgaaggaggcttaggagagacctaagtgctggagcttagggatccggcctgggggtggagttcaggtcgtggaagggtggagtctcatagcctggcctgtctaaggcccctgtctatgctattctcatagccctggccgagatcctgagcgtgaaggacatcagtggccggaagcttttctacgtccattacattgactgtgagttctgggcctgaggtggggcatcagggtagggttgggggacagtctttggcattctgtcctgagccatccccactgctacagtcaacaaacgtctggatgaatgggtgacgcatgagcggctggacctaaagaagatccagttccccaagaaagaggccaagacccccactaagaacggacttcctgggtcccgtcctggctctccagagagagaggtggtgagtaggtcccccacttcaccttttctctcctgcctcctatttctcttgtctgttggcattaggggctcctggatgggcaggaggcggctccctctcaccctgacttcatcttgcaaaggatgggggccaaattgcacatgtagctcccagagtccagtagctagtcctgtgtccttcagaaggcgagggtggggtttgataattttgaggtgagggacccctcttccccttccccatcccactgccatccccgccccagaggaagaccctggacctatctctacagccggcctcggcgcaggccagcgggaagaccttgccaatcccggtccagatcacactccgcttcaacctgcccaaggagcgggaggccattcccggtggcgagcctgaccagccgctctcctccagctcctgcctgcagcccaaccaccgctcaacggtaccctcagcaattccagggaccttgctttcttctcaggtcccaccttctctaccttctgacccacctttgttggtttctctctgcagaaacggaaggtggaggtggtttcaccagcaactccagtgcccagcgagacagccccggcctcggtttttccccaggtgagttccccaaaccatctcttgttcccttcctctcttctactctctggtggcttttttcaggctcatttcacagccatcccttcttttcctactatctcggcagaatggagccgcccgtagggcagtggcagcccagccaggacggaagcgaaaatcgaattgtttgggcactgatgaggtgggtctggggagcagcagaagggaactgggtgaaaaggaagggatgcaggcagggtggagagttatttagtgatgagtttaaaaataaagaaggggtggtgggcagagctagtgttggtgggattaggagacaggcagaacatggttcaaatgagtcattggggccgggcaccatggctcatacctgtaatcccagcactttgggagtccaaccaaggctggcggatcacctgaggtcaggagtttgagaccagcctggccaacatggtgaaaccttgtttctactagaaatacaaaaattagccaggcgtggtggcgggtgcctgtaatccagctcggaaagctgaggcaggagaactgcttgaaccccggaggtggagattgcagtgagccaagatcgcgctactgccctccagcctgggcgacagactgagactccatctaaaaaatggggtcattgggtgatcttttccacatcatcgatcctttagggtttcaggttttttatctggaaattggggatcatggtacctcccccttagggttgctgttaggcttgaaggaaacctgtcaaagggctgtgagctgtggtgtcctgctgagctgtctcttacaacctggtattttccactggccctgggcaggactcccaggacagctctgatggaataccgtcagcaccacgcatgactggcagcctggtgtctgatcgaagccacgacgacatcgtcacccggatgaagaacattgagtgcattgagctgggccggcaccgcctcaagccgtggtacttctccccgtacccacaggaactcaccacattgcctgtcctctacctgtgcgagttctgcctcaagtacggccgtagtctcaagtgtcttcagcgtcatttggtatgaggggtccagggaggctgccttcccagcaccctccacgttgcccttgttcctgatcctcctctcttccccagaccaagtgtgacctacgacatcctccaggcaatgagatttaccgcaagggcaccatctccttctttgagattgatggacgtaagaacaaggttagtgcttgagaggcagtgaggcgctggggtgaatcaaatgacagcttcttcttgctcaggtaaacactgaccagtcaagccagcagatcagtccagcccatttttattgagttcctgctgtctggcaggtgctggtagccaggaatgagacagtctctgttctctgacagcttagtccatgggagagacagtcataccaatgacctctagctcccagtgtcctaagtgtcatgaaacagagggtaggttagcaggacccaaaggaggtggtcagcagagcttcatagagggttacctttcagccttggtggatgacaaagtggctgaggggatttcttgcagtggtgttctgaagagtaggcatggatgcacaaaggtggtctttgtgaaaggcagagatcattctggttgggaggcagaaaagggaggatgagggaaggctcgtacatgggacagagcttaggtgatgaagatgctgtgttaaccaccattttgtaattattaatgtggacctgggcatccaagtggcagtacccagcagcaggcggttaaaaagcaattcctgggctgggcacggtggctcacacctgtaatcccagcactttgggaggctgaggcgggcggatcacaaggtcaggagatcgagaccatcctggctaacacggttaaaccctgtctctactaaaaagtacaaaaaattagctgggcgtggtggcgggtgcctgtaatcccagctactcgggaggctgaggcaggagaatggcgtgaacccaggaggcagagtttgcagtgagccgagattgcaccactgcattccagcctgggagacagcaagacttcgtgtaaaaaaaataaataaataaaaagcaatttctggctgggcacagtggctcatacctgtaaccccagcactttgggaggccaaggtgggccaatcacttgagcccagaatttcgagaccagcctgggcaacatggagaaacccccaggtactcgggaggctgagttgggagaatcacctgagcctgggaagtcaaggctgcagtgacccacgattgcatgattgcaccactgcactccagcctgggtgacaggagtgagaccctgtgtcaaaaaaaaaaaaaaaaacccacaatgtctgaaatgcaggagaaatcgtgtgcagaagtaaagcagcaggattcataattttgctggggtaaaccctaaggcagttattttgttaaattccagaattccttaactctgttgtagagtagcagatcagttcccaggaggtgtgactgtggatgtagaatgttaggttttttaacagctagactcccaagactgttagatagggagtcagtggtcagagtctcactttggacacattagtttgaggagccgtggtcagagtctcactttggacacattagttcgttggctgctgttaaaaaacattaaaaggcagtggtctctcctggtcaggcttagaatggaggtgtgcggagcaaggcgggaaacttgcctgactgagcagggaggcactcagacaccatcacacatctggcacacaggcttttcaacactgaggagcagccctgcctaagctgcgggctggtggagtgggtcaggcccagccagggaagaacactcatcacctagcagcctggggcatagcacgaacagtgaagctcctggttgaccctgaaccactggccaggctcaaggcgggatacccagagtggtgacaagccttttctcttgcagagttattcccagaacctgtgtcttttggccaagtgtttccttgaccataagacactgtactatgacacagaccctttcctcttctacgtcatgacagagtatgactgtaagggcttccacatcgtgggctacttctccaaggtcagtgcctgcccaagctgtccctgtgccctgtcctgagccagatcccttccctgacactcacctgtcccccttctccaggagaaagaatcaacggaagactacaatgtggcctgcatcctaaccctgcctccctaccagcgccggggctacggcaagctgctgatcgagttcagtgagtatgtgtgctgcggccagggggtagtggacccactatcggtgcctcacaggcagatgggccaggctactgtgattctcaaccctggctgtgcagcccagcctctaggggagccagccagaaataacagtggcactctcccggggttctctccgttcaggctgactgccctgcttatctggggtaggttctcagccccccagtttgctccttggccagggttctaagtgccactcagctttccccaaatctgacttacgtgctcctgcctggagccatgggcagaaggttagtgagccgctggtgctgatgtatctggtaacgtgtgccatgatacgagtactggggcaaggaccagtggctaatgtccccagttgtcccctgagccttgcaggcaggtatccaaaatgctgtcagcagatagacgtaagcatgttgtccctcgctccttgtgtccagtgaggtcagtctcttaaagccagaagggactctgaacttcatcacacatgggctcttcagtgccctccccaaccctgaggccccttcttcccagcctcttactccccatcaccccccattctgtctgtctcaccactcacttggaataaccaagctctgacctgagaaacaaggaggaagttctagctgttgacctggtgaagacacagaggctttacctgatcaaggttatggtccattcgagaaattttattggttaaatgatgcccagatggggtcacatcctcagaacttctcagcctagtagcacaagtggatgcttgaagaaactcagtcttggaactcagacagcaatggagacgggatgtgagtgggaccagcaaggggctaaggtccattatgagggtgaggaagggcttctggaagtaacaaacatcccaggtccctgactggggagaatgaagacactgaccaagagatgtgaagccactcagggctgtgcagggtctgaggatctcactggggacggcctcccagcggccagctatcagcacgagttggagggaaagagccatggtgggggtcagtcacgtggctcccaggaatggtctccccgacttaggaagcaccttggtgcaccttttctccttgcatcctcacaaccacccagtcaggccactcaagtcttacagcaggtgacactcccaaggtcccagctaggaggactttgagaattcaagcattctcaggtctggattagagacaggaatctgtctccacttccttacatggctagacacagagcccgggagggcaaaggaaaattggaggccccttcttcccatgagccattttctctgcatcccctgcccataagccttcactggcctctgatcaccctcatggttgactgcagctgctcctctcagtgccctcatgccctccactgtgctcagcgcacggaaagagtgaatactcagttcttcctgagggaactgaggcacagagaagtggagggcatagaactgccaagtggcagggccatgataggaactaggcagcctgccttggcaacctgtgtttttaaatgttgcttatgttcatctgtgacctcttactcaccctctcctgctccattgctttaggctatgaactctccaaagtggaagggaaaacagggacccctgagaagcccctctcagaccttggcctcctatcctatcgaagctactggtcccagaccatcctggagatcctgatggggctgaagtcggagagcggggagaggccacagatcaccatcaagtgagcctggcgctgtctacctgggggtacatggcatggcttgtctgttcctgggctttctctctcagggctcctggggacagataaaggtcctcagggaacctgacctgtgctctcccacagtgagattagtgaaatcaccagcatcaagaaggaggatgtcatctccactctgcagtacctcaatctcatcaactactacaaggtagggaggcaggcaggggagacaggtgtgtgggatgcagagtgcagtcctctgtgggctgaccacctgctgaacccatctcctctgcccagggccagtacatcctcacactgtcagaggacatcgtggatggccatgagcgggccatgctcaagcggctcctgcggatcgactccaagtgtctgcacttcactcccaaggactggagcaagagggggaagtggtgaccagacactgcccactgcagtgccaagacggcagcaggactggggctgatagcccaccccgcccccactgcagctcccacaaagcactctaagggagatggggctgaggacagctcaaaaaggagaggacaggcctggcaggggcccactggtgcccagcaccaaggcgagctccgggctcagaccaactccaaggtcagctggccacaggcccaggcctcctctgaagcagggaccagagggagccaggcagctgtgtacagtgagaagggatccggatgggggagctctgtacagagggctggtgattgtaaaaatttcttttgtaaagtagaagttgggggtggggtgggtgctggctgcaaaaatttctggcttctcttacccctattgcccccggcaataaattgtttctatatgccagagccatgcaaagttcttggtggggagggggaaagggcccatgctggcttaggggctctaaggcgcccagactcacaggtgctgtgaagagctcctttattggggtgatggaatcggttccaaagagctggtttactgctgtgaagggatcgcagctttgaatttcaagctctggttctcagtcctcgggcacctgtgcgtgaatctgcaacaggagtcgcctctactgttggacttgtaagacagggcggcaagctggcccccatacccgaggaaggacccagctgttcagaataaccgcttctagacatgctaggaagagtggtcagggagctacgcttcccacacactacccagtagaatcctccaggctccgtctgcgcaattgtgctccccagcccatccacccgggggcaagacggaactcctcgtctactcaccgctgccgcaaggctgggccaagttaaggccccacgcactttggcatccgggccagggatggtctccagaccccacagggtgaagcggctgaagttggcagtggctccaatgaagcggtcctggggaaggggcctggctcagcatcgggactacagctcccgcccgcaccccctttcaaccctatccctttgctcacgaagtcccgctccagcggctcctcctcttggtcgtcagtcccggaatcccgcaaggggtctggcttccccatcgacaccttcttctcttctgtcaccatcacgtatcccacgaggccaggcggcaccgccacctcctctccccgtagacagcggccccgaaacgacacttcgagtcctggagcgggaggcgcaaagggcctcaggcaggacccacgctgggtcgagcccggagctgccctcccgccacctccggacggaccacgatccccaggagcccaggcgatgagaagcgcgcaggccggcgcgggggctgccgggagccgtagtccggccgcagggctcaccctcggggccctggcggatggcgggcgtgaagaagcgccccaccggggcgggcccgtccaccgcaacctcgcagggcagcagatgcagtgtggcgggtacggcgtcgcgcaatgtggcggagcgcaagtggacgcggtgcctctcgatggccgcttcgtcgccgctctccatcctccctcctacgcgacgccagggctcgcgagctgacactgaagctggcgcggaaagcgcgcaggacctctcaggaagcctccgcggggcctcacgggaagccgccgcggagcttcacgggaagtgtagtccccttaccccctaacgctttccctgggttcaagtcctagggttttccagttgtgttttgtttttttccttccttccttcccccctcccctctttcctccctcccctctctggcctgaagtgatgtacccggctcggcctcccaaagtgctggcattacaggcatgagccaccacacacagactcttcccagtttcaaccagtcttcaacctggcccacagtcgagtcccacnnnnnnnnnnnnnnnnnnnnaaagggggggagagggagggggaggatggagggggaagaatggaggggggaggaaaaggggaagagagaaggggggaagaaaaggggggaggagaaagagaagaaggagggggggggggagagaggggggaagaagaagagggagggcggggagaaagaagggaggagaaagaaaaaacgggagggggggggagggagaaagaaagggggggagggagagagaaaaagggggagggggagagggggaaagaagaggggggggggggaagtggaaagagggagaggggaagaaggaaagggggagggggggaaaagggaaggggggagggagaaagagggacagggggggggaaagagaggagggggggagagagaaggaaaaatggaggaaagggaagagggcgtaaggggaaaagggaggggggaaggggggggaaaagggggggcgatgggagataaagggg

SEQ ID NO: 13663 - DNA, 10300 bp, Human
tgtgtgtgtacatatcttttcaattatcctaggtatgtatacctaggagtgaaattgtcaggtcatgtgataacattttgaggaactgccagaccattgtccaccaacagtgcatgagggctccagtttctccgtatctttgccaacacttgttactgtctttctcgttttaaagagctattattattattactatttttgagatggagtctcgctctgtcgcccaggctggagtgcaatggcacaatctcggctcattgcaacaactgcctcccgggtttaagagattattctgcctcagactcccgagtagctgggattagaggcacgtgccactacaccagctaatttctttgtgtttttgtaaagacagggtttcaccatgttggccaggctggtcttgaactcctgaccttgtgatctgcccaccttggcctcccaaagtgttggggttacaggcgtgagccaccgcgtcgggcctattattattattattattttaagatggagtctccctctgtcacccatggagtgcagcagtgtgatctgggctctctgcaacctccacctcccgagttcaggtgattctcctgcctcaggctcctgagtagctgcgactacaggcacgcgccaccacgcctggctaatttttatatttttagtagagacggggtttcaccatgttgtccagactggtctcgaactcctgacctcaggtgatccacctgcctcggcctctcaaagtgctgggattacaggcttgagccaccgcgtccggcccctaaagagctattatttaaccttctgccccagcagctgggagggatggtggtggcagagtggcgaggagcgggcactgcgcagttcacctgagccccaggcgctcgccgcgggacccaccagcacgtcccctcctcggcagactccctccccggggtcacgtggagggcgactgcggggataagcagggatggcaaggggaaaggaagggcgggccccaggcgggggatccccggacacgcagtgctttcccgcctggccccgcccaaagacgtgggcaaacagaggccacgcccttcctgggagccagccccgcccatactccgccccaaggacacgcccccacttcgggcggaggcggaaaccgggcgggggacgctggtgcgaggaggtcgaggaggcgccttggcacccgactctggcatcccgcacgtccgacatcagccctgccctccttctcaggggcttccattcattttgtgccaaaagggaactgccgccctcgcccccaaacttgtagctttgtggatggagggtgtgggggaggccgtgtgtagtgaaaggaccacccggctgaagacggtcctgggggtggagggcaggagggagcgagaaggacagttctgctcctgggagcctctcgttcctgggcgagggtctggggaccctggatgaagttttaggatcttttacaatgacggtctggggcagagaataaaattttgcagggagcagattgagggtctggaggactgggttaggtgggctctaggtacccaggacgatctcgggaggcgcacaatgagaatctgggggctccaggattacggtgtgggtgcacaggatgaaattctgggggcgcagattaggtaggacctaggtgagcaggatgacatttttggtgagcgtctgggggcccccgggtgagtctgggggcctggcatcaaggtcggggccccaggatcgagcactgggggaccctggtccggcgccgggaggcggctcctggcggcgccgcgggggaccgggtaggggcctgtggctggccgggggcggagaagcggggggtcggggtccctccccctggcgctggctcaggaatccgccgaagggcgggcggaggcgccggggtgggccgcgccgcggcaggcgggcgggcggggggcgcttcctggggccgcgcgtccagggagctgtgccgtccgcccgtccgtctgcccgcaggcattgcccgagccagccgagccgccagagccgcgggccgcgggggtgtcgcgggcccaagtgagtggctgtgaccgtccgtgggggagggcgtgggccggagtctcggccgagtccgcggcagcgtagcgcccacagaggcccgcgctcctcggccttcgccgcaggggcgcggggcgggggcggggtggccggggcgggtgggcctgggacccgggcctgggacctgggcctgtgaggagtcggcccccagccctgggaggccccgaggcccaagcacggtcctgagcgggcagtggcgggggctgggctcgggctcccggtacagggagttgaggtgccgcgggcagaggcccctgacccgtgtccaccatctcgcagccccaggatgctcccctgcgcctcctgcctacccgggtctctactgctctgggcgctgctactgttgctcttgggatcagcttctcctcaggattctgaagagcccgacagctacacggtggggacagtgagggccgctggcctgggacaggaagggtagggaggaagagaccgggacccagggtgactgctgccggggaagtcttcctcccctggctggtggagagctgggggccattgtttggagcaggccggagggtggccaggctcaggccctagtcttggcctggccagttggaggagatcttagggtgaccactggccacttctggttcccttccaggaatgcacagatggctatgagtgggacccagacagccagcactgccggggtgtgtgtgcctgggggaccaaacacccccaggaacccggaaagggattgatagctgctttccaagggacagccccacctccaagaactgccgtgggagcccagcagcccgttctatgcccagctctgctacacagaggccagctctggctctctggaggccagttgagctaggggtggcctcatcctctcccagaaacccaggaaaccttgtccctacccctcagaggagctggatcctgtacgccttctctgaaccactctcctgtcccagctctttgtctcatcacaacctgggagggtagcgtccccaggggtgggtaaggaggccccccatcttgggctgagctagggctagggccgtggggagggatagagacccacttgcaggccgagaatgagggcaacagtgggaacagctgccccatctccagccttggccaaccctggggaggggtcctgagcaggcagacttagcttgttgagcagagtgggaaggctttgctggggccacacatctcagagaaggccgagctgggttcctgcctccgctccctccagggccagcccaggagactggctgtgcccagcaggcccctctctgcagatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtgggtgagtggggactgctctggtgcctggcttccagtcctctcaccaggcgtcttaaactcagacctcatgttcctccccagctcaaaagggccactggtgatgtccacaccctcatccagacactcatgttgtttaggacctgccgcaggtggccccagcttgtgtgccactgctccagccagctccgggcccctcccctcggttgctgcagagacactgcaggaagtctgccttccagtgtctgtcccctgggagccacaggccttggaggaaggacagtccaggaatcagtgttgctggggatgtttggacaggaccttatttcctgtgcaacccccaacatgtggttttagaggttaggggtgcctttcctgatggctccaggctggtgaactcttacgcgtgctgttgagagaaccgaatacaagtgttggaactatctgtcatgttgggtggtgtgcgggatcccaggcaggggctgagtggtgtctctcgcagatgtggacgagtgtgcccaggccctgcacgactgtcgccccagccaggactgccataacttgcctggctcctatcagtgcacctgccctgatggttaccgcaagatcgggcccgagtgtgtgggtgagtccaggaagcagcttctgtagtcccggctttgtgtccctggtctggcccttgccctagcacctgacccccattcaagccaggcttcacccccggcccctgccacctcaccctccgtcatcagacacagaggactgtagcggggagtgtttgggaggtgtcctggctgaccctgcctaattcagctcctcggacacaggattatgggtggtgaagccttgagtcccagccggctcgagcccacctgccctctgccctctgccctccgccctccttctcctgcctctatccctagacatagacgagtgccgctaccgctactgccagcaccgctgcgtgaacctgcctggctccttccgctgccagtgcgagccgggcttccagctggggcctaacaaccgctcctgtgttggtgaggctgggctgggccaggctcctgggtcctgggcagggaggtgtgaggtgggggcgctcccttcttgaccagcccaggtagagtggaggctctgggctcctcctccgctttcatccctcctgtttttcctggcacccccagatgtgaacgagtgtgacatgggggccccatgcgagcagcgctgcttcaactcctatgggaccttcctgtgtcgctgccaccagggctatgagctgcatcgggatggcttctcctgcagtggtgagagctccatccctgctgtgtactcctctgtggacccccaggccctagctatgccgtgcctcctgccacacagttctccatttgaggcctccgcctcctgtcactgtgcacccagctgcctcctgggtactcgaccccggctggctgtggagcactcccaggctagtgggggaggcacaaggagaggcagctacgtccttactgaagcctactggtgagactgaggatgtgggtgccacctgtcccacatatcaggctcacctgcatttacctgcatttgaattttgcactaggacaagtcactcctctctgagcctgtttcttcttctataaaatgggttgtcttgaggattaggtgagagtgtgatagatgggctccagcaagtctcaagctgcagtgctttaaagtgaatgaactgccacttaatgagaacctgccctcgtagtgtattccctgacacacttggcctccttcctctcaagaatcctaggaggtatgattttctccttcctctacaaaatgaggacattcatatctccctccacgtttgttgggaggattacataaaaataatcacaaagtcctgggtaaatggtgactttcatgattcagctaagagaggttaagtgacccgcccaagctcatacagccaggatgagatggggccagggctggatcccagacttcttacaccctgtaaactggcatgtaccccctatgttatgctttgctgcgggatgaggcctcactgctacctggcagcatgaggggaacaagagaaaggaaatgttctgcctgtgaagctcacagttagttggaggtgaccactgggtgctcaggttgactgtgggttgcaggaattgggcgttacagcacaagccagacccataagactcatctagtctaacacactcattttactgattgggaaaatgagattcccctagatcagctggtgggattcacacccaagcctctagattcccagtaacttatttagtgtttcttccagttctgggcagagagaagtctgtgagctgcggcagcctgggcaaactttctttgaaccctccatctcccggctgaacttgtggcttgtctcatccccctctgtcttcctacattcagtctaacatggggctgggccttcttgggaaatgtttgtgggactgaatggtgaggaatgcccttgacccggggtccccatccccatgcttcctcagatattgatgagtgtagctactccagctacctctgtcagtaccgctgcgtcaacgagccaggccgtttctcctgccactgcccacagggttaccagctgctggccacacgcctctgccaaggtacaggttgcccgggtgggatgggcaggacggtgtcaggagctggcagcctgacgcccccgattccagcccctctcccctggcacagacattgatgagtgtgagtctggtgcgcaccagtgctccgaggcccaaacctgtgtcaacttccatgggggctaccgctgcgtggacaccaaccgctgcgtggagccctacatccaggtctctgagaagtgagtcaattcgatgccaggcccccacagaaactacgtctcccagggggctttggggctgactggcatctattcagaccagcgagtgcccctgagggatgatgggaatcatagtccttcatgaaaaccagtcacaggggtagaagggtccttttgggattccctccctttgtagggtaggagaaattggggggacgggcaaggagctcatttgtgtcccccacctcggggtctctagccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattagggtaaggtttctgcaaccctcaactgacatgcacaatctaaaactgaactccaggacgccttaagggggaactcggccaggctgctatgccccacccctcccccaaagccccgcccccggaggcggggtttctgcaggaagacgggggtactctaaatgcaattctaacggttaaatgcaattctaacgaagcactcggacacgggagtttgagtcctggtactggttttccatattgatctcagtttcttcacccacaaaccaagggaatggcgtgtgcagggccctggggtcagaaagtccactccttgctagtggatctgttaggtgggagggggccaggggcggctcacagtgagctgctcacagtgactggcagccgcatgcatgggtctcagcaggagaaggggtttgtctagtaccagcccttctctttctttttgaaattgaatgctctgaagggagtctgctcactttgggtcaccaaaggtcccaccagtcccaagagccacatgtggccttgaatcgtcagttagcctgggtcagacagagcaggctggagagggtgagaagagccccagcaggagatttctgagggcaggagcctgggtggggaggagagacatcgagggtgtcaaagagctgcatgagaggctggggtggcagcctggccagggctgttcctctgcctcacggccacggggcagggaggtgacgctggggcaggggcctagcacacaggctgacacaatatatatgtccccccacccactgccctgcagcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggtgggcgggtcacactgcaggaagcctcaggctggggcagggtggcacttgggggggcaggccaagttcacctaaatgggggtctctatatgttcaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggactgttagtggttttcaatcttttcttttaggaagttttatttatttttattatttttattttcccaatgagccctctgcactcctaaggaaattttatttgatgaggaccaactggtgacataaaatagattccaagctgcaatgccccactgactccatctccctgaccagggaattccaggtgctaagcagctttgtttaaaaaccactggaccagatggtatccctggttcctgcgtatttcacaaggtccccagggctaggcatcttctacatgacacatatggctgcaaacacttagattctaattgtaccccaaaagatgttgttaaaaggctggctagcctgggttgggggacagacgggggctgggggctgtttcacggcataagctcaggtcaaggggccgtagctgcagtagagctgggataaggtcctgctcagagcaggccccagattcctgcaggaagagaggcagcgagggtcacgccctgggcctagggcagccccagtccctgccactccctccaggttccgtctcttgccctcacctctgtagacgcccacacttaatggtgctcagcagtgtctcttgttccttgggggtggcacaggcatcataggcggccaggaggctggggggcaggggtttgagtttctgaggctgacagtggcccactctgggccagcaccatgaggggccaggcagaggggtcagcatgggatggaagagttgggacactgccccacttcctgagcttggcactcaaggccccatgccagccgggctgtcctccctccctgtgggaactctggggcaaaaccagcaaaggctccaaaccttcaccctcactccccttaatggcccaaccccttctccaggaagcctcttctccaccaggtgggacgtctccctccctcctgtggcctccactacctgggacactatgtgggcctgctggcttcctccccacttgacctccacgagcaccctgggatctgtctatctctggtctgcagagcccacacaaggccaggccccctccacgaagcatggattaaggtgaattccatgcatggagggcaggggctgaggacacctaagggccctttagggcctacctggcaggggtgctgtatcgatccaccagggctgctgccttctccccactcactccgcgcacctgcatcagctgccgggcaaacacttctcgcaccgactgggcctgggttcgggaaagggctggatcagtgggggtctgggccaggccatgtctgagaagctaggcagagacagtaccttattcttgatggctcctgcgttgaagtcactgaaggtgaggagtgagcagagagggtttggagaggtcatggcccctgattcagggttcccaggggttccccaggggcggctgcgtagggtgtggccctgagggaagaagggactgaggccaggctggagctcgaaggaacaactccagccagcccctgcccagtcctcagccttggggggccagcctgagaaatggggatctcacccaccttgcttcttttggggatgcacagggcccaggcaaggtgaattccttgtgggctctgtcccgacactgggaaaggggcctctgctcacctggtagagtctctgcaggccccgcgtcaagagggccaggtaggcggctgactccttaatgtctgctgtgcgcttcacaaaaaagccatcaatgacctggggaagaggacccaagagagggaaggtggctcctggcctagaccatgaaccatggaccacaggggcccctgcctgcctgcctggccctgccctcccagctcacctgagtgttggtgacagcctgcagcagtgtgctctcaggaaggctgaggttgtggacggaaccatgctcttccaccaggtatacccggcgctccagaccacagcgcttcagtcggaactagggaagtgtacagagtggacagggagggtcaggctggatgaccacat

SEQ ID NO: 13664 - DNA, 5695 bp, Human
agcccaggcgtggtccagcttgaagcccggtgccagatgcataagccacttgcccgagagcacgtggtgggtgatggcgagctggcgcagggtacccggtgtgatgggccgcccactggtctgcagagcttcccaggctgcctgcaggccctgcacgtccccggagttggggctgtagccctgcccatacactgcaatccagcccacaggctctgagttgggtgaaccggggtccccatagcgggtaacttgggatggtgggtacttggccagccaggcatccagctcagtggcaggcgttgtgcgggcatcaaacactagccaggggtccatgtcagctgccatggcctctgcagccaggtgctcggcggtgaagccatcctcacggccacctggagagccctcctcttccagctcctcacctggttccatcctgctgtgagggaaccgagtcagggcagggtctgagacaataactacagatgccaggcactggattaaactgtggccttgagtaagagttactgtcgatgcgcctcagttgcctcatctttacaatgggataacaactgttcctgtcccgtagatctgctatgaaaattagatgcctgaggagtcagcgctccagaagggttgctgcagttattactattctccttgacttacagaaaaggaaactgaggctgagaaaaaggacttgcccaaggtcacacctgtagtgcgtggcagggccgaagggtgaatccaggcgtgggagcaaccagccccagctacacctcccggccctgccaaggcccccttttcctggcaggtatccggtgcgctggcatttaatagaggaacgcaaagaagcgcacgttcgcgcagctcccgaggccggctctgtaaggccaggcctcccaggcaggcgttatcgggcccacttaaagacgaggacgctgaagtccagagaggttacaggccgttccgaggccaatggggcggttcccagactcgaacctgggcttgttagagcctgcaggagagccaggctccggccgtgccgcgcccgccgccattaacgcccacgggcccgagctgtgctcccgccccggccctgccctgcccctcccgccgcccgcagtcacctccggccttcgctgcgttcgacgccggcccagccccgggcccggctccgctcctgccgtggctccgcgccaccgccaccgcgccccacccccgccacggccgccgccgccgccgccgccatcttagctccgcgccacctcaacaacaactttatagacaggcgcagccacagggcggagccgcgggcctcagcggccgcagcggccgcgctgtggggcggggccggcaggggaaggggcggggccgacggggaggtgctgactcgggggcggggccatcgcgggaaccccgggaggggcgggccgcggggggcggggccaacgttcgctcttctggccttgggggcgggcgggagcggcggtccagactggggagggacgcgcaccggccaggaggcttcaagaggagggcactagggccctgcgagcggcgtcttaaccggcggcgctaggactccgcgggaaacggcgggggcggagcgggcggcaccaggacccaggggaaccgcgacgggcgggcggcgagcaggcccgggagccgggaggctgcgggcggcggcgctggacccgacgcggcgagagaggccccgagatgccgagcaagaagaagaagtacaacgcgcggttcccgccggtgagcacgtggcagagcccggcaggagtgggcccggctcccgggtggcttgggcccagttcccgctgggcaggcgggcgcgccgcggtgttcgggggcctggacgccccgccccctccatgccctccccgcgtccgtgtcccccgccccctttctccggggatgccccttcctcccccagcacccccttaggggacggtggcgacggggtctgaactctgctcccccacccgcaggcgcggatcaagaagatcatgcagacggacgaagagattgggaaggtggcggcggcggtgcctgtcatcatctgtatcctgccgggggcggaccgggtcgaggggcgtgggggagggaggcagcgggtcgccctctcctgccccggagttctccttgacgctcctcagcccgggcgctcgagctcttcctagagtcgctgttgaagaaggcctgccaggtgacccagtcgcggaacgcgaagaccatgaccacatcccacctgtgagcggcgaggagccgggaggggccggcgggtttggcgcggggagttcacacactgaggaaggcagagcctgggtggcgagggaggtgggcggcagccgggacaccagcaaggccacagactggcagaggagaggctgggcttccaggcagagggagccacctgagtaaagcagggcaggcccgggagcggagatcggcccgggctccagcctgacatctggggccccttgctgccacccactgcgggtttgggtgtctgggcccctcttgagtgccagcccctcctcacctcttccaggaagcagtgcatcgagctggagcagcagtttgacttcttgaaggacctggtggcatctgttcccgacatgcagggggacggggaagacaaccacatggatggggacaagggcgcccgcaggtggggccagggcctggcatacagtggggaaggccaaggccacagggcttgggggtggccaaggagtagggagcactccgggcagatggactgtaccttcccaaaggggccggaagccaggcagcggcggccggaagaacggtgggatgggaacgaaaagcaaggacaagaagctgtccgggacagactcggagcaggaggtgagtgaggccccagcccttcgccctgcccttggtgatgggacaggcagcctcgccccaggctgaactggcaggaggccagctctcatccttttctgcaacctgtttgctcactggtttatttgtaaattggggctatgagggtctactgctgtccctgccactcccagtgatgggttcgtgtcttttcttgtcaactctgacctctgcggtgctcacaggatgaatctgaggacacagatactgatggggaagaggagacatcacaacccccaccccaggccagccacccctctgcccactttcagaggtgagcagcccagaggcatgggagggtgctggcagactccccagagccaacttacccctcttgttctccctggccccttggtcttgttgattgtggcagatttgtggggtggaaggagaataactgaggagggcttgaaggcaggagactgttctcccgaaagatcctgctccaccctgccagggcccgtgggtggggcctgggcctgccctgcgtgagctgccctgggccttggccgcatggatctggagggtggtggtgggagggtcagatgggggagggagggtcttggcagctgcccctgtggagggcacggtggggctcaggcctgactctctcctgccttctgccctgcagccccccgacacccttcctgcccttcgcctctactctgcctttgcccccagcgcccccgggcccctcagcacctgatgaagaggacgaagaagattacgactcctagcgccttctgccccccagaccatagccccttttagttggttttagttgctctggggggaggagagaaggtagagctgttcttaaatttattaaaaaaaaaaataaaagggaatctcagtgtctgttccaggctctgcgcaggacgtcatggttgccatcccatccacccacctgccttccccacatgaaactgggagctggggccgggtgcggtggctcacgcctgtaatcccaacactttgggaggctgaggcgggcagatcacctgaggtcaagagttcaagaccagcctggccaacatggtgaaaccccgtctctactaaaaatacaaaaattagctgggtgtggtggtgcatgcctgtaatcccagctactagggaggctgaggcaggagaatcgcttgaacctgggaggtggaggtggcagtgagctgagatcacgccactgcactccaacctgggcagcagagtgagactccatgtcaaaaaaaaaaaaaaagaaactgggagctggggccgcgtcagtggcaggtgaggtggcagcgaggggagagaggggtcatccggggaggctggaggccctgggtctgctgagtgcaccacagctgcggacagaagggagttgggagagcttgcaagtgctgggcatgcgggggacacttgccacgtggtgctgctgacccccggtgggctgctgacccccggcgggctgctgccctgctctgagcagccccttgtctctctgatggagactgttctgccccctgtagtctgctgtgaagggataagtgggacagggaacaggtacaggtcttggaaactgtagagtcctgtgtccagtgtagtgaagggcaggtggaaaggagcaaacatagagagatggtggagggtcttgaaggtggtttttgagcagggcagtgacacagtctgttcatccagataacctttcagagcagacccaggagctgtgctgcctgtaaagcagaggtactcggtgaggctggggagggcgcaggtggcccacatggggcctcctggagcccgcaaggcattcagttttaaaggtctgctggcatggtggcatatgcctatggttccagctgcttgggaggctgggacaggagttccaggcagcagtgagccatgattgcaccactgcactccagcctgggcaacaggagcaaaactccatctcaaagaaaaagagtctgacatccccaagtactgcagaggaagaggctacacggcactcatacacagctggtggaaatgtcagtaagtacaaccacttcggaaaaccgttcagcagtttcttattaacacacacacttcccctatgacccagcaattccactcctaggtagctaccaagagagatggtggcatagggccactggaagacatgtacaagcctgtagccccaaactggaaacagctcaaatgcccatcagcaagagcaggaataagtaaatggtggaatgttgtatgatagaacagcagtaaaaggaaccactgtcaatgcaactccctgggtagatcttgtagaccttacgtggagcaaaagaagccaaacaaaaaagtacatgggccaggtgcagtggctcacacttgtagtcccagcactttgggaagccaaggtgggcagatcgcttgagctcaggagttcaagaccagcttaggtaacatagtgagaccctgtctctacagaaaaatacagacattagctgggcatagtggggcccgcctataatcccagctactcaggaggctgaggtgggaggatggctttaacccaggaggtagaggctgcagtgagctgagattgctccactgcactccagcctgggcgacagagtgagaccctgcctcaaaaattaattagtaaaaatgaaaaagagtacaccctgatgtaattcatttaagccaagctcaggaacaggaaaaactaatcaacagtgatggaagtcagtacatccataaggggtggggattggctgggggtcgggtacagggagccttctggaagtgttcttcaacttgacct

SEQ ID NO: 13665 - DNA, 6817 bp, Human
  misc_feature (1)...(6817): n = A,T,C or G
cttagcctcgggatccagtgaagccagaagccaaataaactcaaaagctgtctccccacatgtagcctgtcacctttcttggaggtaaccaggtgacccaacctatcatacaaccctggtgtcctgatgccccaacaataggcagttggatgccttgtactgcatgcctctcctgggaccaaatccaccagccttggtcagtcattcaaggctcttctcggccaggtgcagtggctcactcctgtcatcacagcagtttgggaggccgaggccggcggatcacatgaggtcaggagttcaagaccaacctggccacatggtgaaaccccatctctactaaaaatacaaaaattagccaggtgtggtggtgcatgcctgtagtcccagctactctggaggctgaggcaggagaattgcttgaacctggaaggtggaggttgcagtgagccaaaatcacgccactgcactccagcctgggcaacagagcaagactccgtctcaaaaaaaaaaaaaacaaaaaaccataggccgggcatggtggctcacgcctgtaatcccagcactttgggaggccgagacggacagatcacaaggtcaggattttgagaccagcctggccaatatggtgaaaccccgtctctactgaaaaaaatatatatatatacaaaaattaaccaggcgtggtggcaggtgcctgtagccccagctacttgggaggctgaggcaggagaatagcttgaacccgggcggcgaaggttgagtgagccgagattgcaccactgcactccagcctgggcgacagagcgagactccatctcaaaaaaaagagtagtaagttccacccacctcccagtatggtgacttgccatggcatctggcacccctgacagttctcttcacactgccatgggggctctggcactcccacaccataccctagggcagggtccctccctcggcctctgtccattctcttcacactgccatgggggctctggcactcccacaccataccctagggctgggtcccttccttggcctctgtcctcagcccctctgacgttagaggagttggaacccaggctcccccttcccctctcccaggtgccccatggcagcccagactctgtgtctgcagttcaggggcagggagtcaggagggcaggcacaaagcgttctcaggaagaactggcaatcgggcgcaagggtatcatctgcccgggtgctctgggcaccctggagtcctctccccacctcccacccccacctgatccttcccagctgccaccattcctctcccaccacaccacccaggccaaaatcactccatccatgacgcctacagtagcccagcgtaggtctccctggaccacatttatcctcaagggcctgtgtccttatccccccttcacccccaactctcccctgccacagccagccctctgttcctctcacaccccaagctcattcctaccttcactggcctcttactccccagctgaaatatcacctccttagcagagctttcccagtgagataacccccccgctccccgcagagctctcccatcacccagggtgtttccttcatggaactcatgacaatgtgaggttgccatgtttctttgctaagaggtttcttgtgtaaacaccaggaaggaaaggacctgtgcctgtcctcttccctaagcacttgaatgaatgaatgaatgaatgaatgtggtatgggtgcctgagtgagcaggaccttgaataagtgtgaggtcctctctaggcttcagcttcctccgcctcctcccctcaccgcagccgccttcctccacccatccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggtaagagagccaggcagccaagtcggggggtgcggctccaagaggccatggctccctgggggctttggggttcatgcagcccttccttcagccccaaagagccagatggagcccaggccctgtgaggcctgacatcacagctggggctccccaccaacacaccccaactggtgcctccacttcaactgccaggaagggtgtggcctccccagtcccaccccaggcaccctttgagacccaggagagctgcccagatgccacagcctgtggccagataggggatacaatacagtgggatggattcttggatggaagcaaatagaatgaacctgggaaggacagatcaggaccatggcctcgggtgggggagtgagggaagataggggaggaagtcggcatgagatgcttgtggatcaggagggcacagacagggatgagggagtcctgcagagaaatcgcgtgggcacaggcccagggaaaagcagcaatgagacccacagccctgggttttcgtattttttgccccacaaagtgtctcagtattttttgaattggaatttgtatttccaactttttttttttttgaaacggtgtctgaccctgtcacccaggctggggtgcggtggtgcgatcttggctcactgcaacctccacctcccgggttctagcaattctcctgcctcagcctcctgagtagctgggactacaggcatgcaccaccatgcccggctaatttttgtgtttttagtagagacggggttttgccatgttggccaggctgttctcaaactcctgacctcaagtgatccacctgcctcagcctcccaaagtgttgggattacaggtgtgagccactgtgcccagctcatatttccaacttcttttggaaaatcaggaaacccactcacactgagccagaatccctgcaaggcaacatcctgactggagcagaatggggcctgccctttggatacagctcacactttccagtgtacccctgtccccaccactcctgtttgtctcccatctggctccggtaggcatgtgcgtttgcagctctgtattagctgatcctgttctcccagcacaccccgcactcccacccctccccgcctggcacatgccctctctcgcccatgctgcctctttgcagcccttcgtgatttgcctgcccgactcccccaccagaaggggcagggcctgggctgattcagatcccagtacaaagcctggcacacaggacatgacacacatttggggaaagagtggatgatattccaccagctgtggaatcgggagtatctgttaagggcagcgcagttctcagaattgtcccagctacaaaaggcctgaggaactgtcttctttcatcctttcattttccaaaaaagaaaagaatggcctagagagggtaagggatcccctgacgaagaggagcagagccagctagaacctgggcctggccagttcaaggccaccagagggcagccttctgcggaaggcagtattggggtaggcagggaccccagcagacatggcactcagagctctcactgtccactgactctctcttctccaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtaagtccagccacctaacagcgtgtgggggaagggggaagaggagcctggactaggactcccataaatcactggggggctgggccttgcaggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcaggggatactgttaatcataaaatgagcaacgacttcggctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcaggaggcgcgggcccagggactgtgccgcctccaccctggctctgtcttgcctcccggcccctgagcccatgtcccaccttcgatggccagcatggcccgcagctcgcggctcagcagctcgaaccttcgctccaagtcctgctcctccatgctggaaggtggcggggggtgggtggcgggggggtggcagttcaggaaaaggggcgtagggagagagtgcccagggctctggccactccctgaccccatcccacctccccagcagttcccgagggcagggctgaccgcagagctatcctctagtctccagaccacattatcgcttttcttctgttttctccaattgctgggtgtttgtgttgctcctcccacacaccccccagaaggacccccgaaggattatttggatgaacagtactcataaacaggaagcactggctacagttattctgaaaaatcccaaacgcaaaagggaggcaaagctgtctccaccctgcaggatgacaaaggcaatggccgcagagtggcttcggaccccacatgggaaccagatcagatctctctgggcttctgttttccttactgtaaaggctggagtgcagtggcacgatctcggctcactgcaatctctcaaccccaggagggttcaagcgattctcctgcctcagccttcccagaagctggaactacaggcgcccgccaccaggcctggctaatgttttgtatttttagtagagacggggtttcactgtgtt

SEQ ID NO: 13666 - DNA, 19237 bp, Human
gtgatgaaccttatgacaccctgtagaaatccagatttcgtagattagaaatccaatggctttgtttaaactgtctcttcctctgtttttacattttttcctccacacttgacaaaaacaaacccaactctttttaaaccaacttccctacctctttcctgcactcatcccttcctaaaggtttgctcctataattattatcgttggaactgcccaacaagaccctcgttttctatttatctggatctccaggctcatttctttctttgtatcctattttctatatcatgctcagaattttaaagttgcttccaggctgggcgcggtggctcatgtctgtaacgccagcatttcgggaggagggattgcttgagtccaggagtttgagaccggacgggccaacatggcgaaaccctgtatccactaaaaatacaaaaattagccaggtgtagtggcgcgtgcctattgtcccagctactcgggaggctgaggtgggaggatcacctgatcctgggaagtcaaggctgcaatcagccagatcacaccactgcactccagcctgggtgacagagtgaaattctgtcaaagaaagaaaagaaagagaaagaaaaggaagaaaggaaggaaggaagcgtatctccattttcatccaaacagctatttttctctgctactacgtacctcctcagagcccatcccccctactggtctgaggcttttttttaaacaactttctggacatagcccctcttaagactaacaacctatagccaggcgtggtggctcacgcttgtaatcccaggattttgggaggccgaggcaggtggatcacctgaggtcgggagtaccagaccagcctgaccaatatggagaaaccccatctctgctaaaaacacaaaattaggctgggcatggcggcgcatgcctgtaatcccagcaactcgggaggctgaggcaggagaactgcttgaacccaggaggcggaagttgtggtgagcggagattgcgccattgtactccagcctgggcaacaagagcgaaactctgtctcaaaaaaacaaaacaaaacaaaaagagtagcaacctaggccgggcgcagtggctcacgcctgtaatcccagcactttgggaggctgaggcgggtggatcacctgaggtcaggagttcgagaccagcctggccaacatggtgaaaccccgtctctactaaaaatacaaaaattagccgggcgtggtggtgggcgcctgtaatcccagctactcggaaggctgaggcaggagaattgcttaaacgcaggaggcggaggttgtagtgagtggagatcgagccactgcactccagcctgggcgatagagcgagactccgtctcaaaaaaacaaacaaacaaataaacaaaaagactagcaacctcctctccagcaatgccaaccccagtccaggcccccatccgcccaggatctcgatcaaaaaacattaatctgtggcctttctttgccatttccaactctgccacctccatcgaacgacaaggtccccttcttcctttccattcccgtcagcttcatttccctaatctccgtacaaatccctagcctgactccctttcctttccatcctcaccagacgcccgcatgccggacctcaaaagcgcaaacgctaaaaaccggttgagttgacgcacggagagaaggggtgtgtgggtgggtgggtgtgtgttagtgtgcgtgcttgcttgtgtgtggaagaaaccaacagggttcacgctggtgcccatttctggaaatgccaatcgcgcccgactgcgggagccaggatcaggtccccagggcgcccttgcagacagcaccctgagcgaaggagctcagaaggcagtccggcttcacccagacccccaatcccacagaagcgccgtcccccagcggcacagcaccccctccccggcgcggtggtagggcccgacgtgacgtcacccattgtttacaaatcaacccgagccggcaggattccggctcccgcggctgcaggcgcgcggctagagtgcctggcgggctccggcttccgcgtccgccccggccccggtccagacttagtcttcagctccgcgcccgctccgccgcggcccaccgcgcccgccggcagccgagcccccagcgacgcccgcacagctccgggtgcccagacagggggccatgccgtgccggagggaggaggaagaggaagccggcgaggaggcggagggggaggaagaggaggaggacagcttcctcctgctgcagcagtcagtggcgctgggcagctcgggcgaggtggaccggctggtggcccagatcggcgagacgctgcagctggacgcggcgcaggacagcccggcctcgccgtgcgggcccccgggggcgccgctgcgggccccggggcccctggctgcggcggtgccggcggacaaggccaggtccccggcggtgccgctgctgctgccgcccgcgttggcggagactgtgggcccggcgccccctggggtcctgcgctgcgccctgggggaccgcggccgcgtgcggggccgccctgcgccctacttggaggtggccgagctcgccacaggccccagcgcgctgtccccactgccccctcaggccgaccttgatgggcctccgggagctggcaagcagggcatcccgcagccgctgtcgggtccgtgccggcgaggatggctccggggcgccgccgcctcccgccgcctgcagcagcgacgcgggtcccaaccagaaacccgcacaggcgacgacgacccgcaccggcttctgcagcagctagtgctctctggaaacctcatcaaggaggccgtgcgaaggcttcattcgcgacggctgcagttacgtgcaaagcttccccaacgcccgctcctgggacctctgtcggccccggtgcatgaacccccttcgcctcgcagccctcgcgcggcctgcagtgaccctggcgcctccgggagggcgcagctcagaactggcgacggcgttcttgtgcctggcagctaacacgcccggggtggccacagcgccagcctcagactggagggcaaggggttcccttgagggctgcagttctactcaggctggtggagaactctggcttttggaagcgagagtaaaaagctaatgacgaggaaccgaaaaatcgcgagtgtttcgcgggtaactggggttgagggccaaaatatttggaatgaaggacttggccctatttaaggcagattttacagagcgcacctcaaacgtacaagtcagtaggactccttatttggcgtgacccgacctggccgcggagcctgcatttcctcgcagcctctcagtgccctccagccccgcgaccatgtggccacaatccacgcttctccggatcgcggtgcgccggaaccacggaggatgatgccagttacttgctttaccttttcagggctggctcctgatccactttgggggaggagaacatgagtagataatttcagggtgcagcccaatctgccagacttaaaaaaaccatcttgtgtctttggaggtgctgcttaataccaaacatgcggtgccatgaagggaccctttgggggttgaataggagttaacccctgcgctctctttgcaactgtctctcttctcagagtggtgggggaaggctgtacgacacgggtggggaaaggaggtgggggcggggagtattgaatggtggtggaagggtagagaggcgcggagtgaaccccacgccctgtctaaagtgtattttcagagccggcccgcctctcctcggttcaaggtcactgtttcctgggcacgcactgggttgcgggacagagtagccagtttctgccggtgctcggagaagagcgcagtgttttgcaagtgctggagtctcctgaggacacgcgcgtcgccgccaccgcgggtgtgggaaagcgcggacgtgctgggcgtctgtgcttcggtaggcgaccaccgcccctggccgcgctccgggctttcacggaaactcccgagaccgggccctgggttcctcctctcctactcggctctgcagtcctactcaagcgggtggctctgggatcctgggggcctgggttgggggctagggagacgccatgtgatggacactccagggacacacagcctagcacagcagcttataatgggctctccggggccatttgcaataacagctgcaattccctggatagacgagttgatttcctccctctgcccctcccccagccatgccagctggcctttgtaagtgcaggaaaccgagtagaaaatgtgaccctccaaatggagaagctgcaggctttgccattgtgaaccatggtgaagtgcttggaacatactgttcactcactctaaaggcgctgagactgtgctgttgttctcgtttttatagtcaatggcttgttcatcatccagatgtggctactgacatatctacacttcgcaccggagtgtctggaattgtggctatcctgattataggattttaacttaactgaaatgcctgctttgaataaatgtgttgggttttttgtttggttttattttatacttgccatcagtgaaaaagatgtacagaacacatttctctgatctccataaacatgaaaacacttgaaatctctgtcagcctggcttgtggatggtaattagagcgcctttgtgtctgagcagctcactagctagacaaggtctccgcagctgggtgtgtattggagctggcatgaaattaaatgaaagtgaggtcaggttttggaccaatcccattcgttaaaacctcagagccttttggattactagtcagtgatggagatgtgttataaagctgcctctattagcaaaggacatcagatcagccagtcactgcaaactgggaggcttatctttttttttttctttttctttttttcttctttctcaccgtggccattaagtgcacttgttccacaaggtgggccttaaggctggggcagctcttgattaggagactgctcacaatgtgagcctggtggtaggaaagctgggtggaaacttacaaaagactcctgtctttgcccctggcacatttataccattctgtccctaagcagtgacataacaggccatgtctatccttatggttctgacttacttcagtctgttccctcatggaaggagctaatttcctccctctgaggaaagagtacccagagtttaagcccacttctgaagtgggaagggaaccttggacaagttgctctacctctgtggcttcagtttcctcatccgtacaacagggataatgaaataaaaggtgggccaggcccagtagtttacacctgtaatcctagtagcactttgggaggctaaagtggaggattgctggagcccagaagttcaagaccagccagggcaacatagtgagacctcacctctccaaaaataaatagataaatggccgggcacagtggctcatgcctgcaatcccagcactttgggaggccaagaagggctgatcacgaggtcaggagttcaagaccagcctgaccaacatggtgaaaccccatctctactaaaaatacaaaaattaactgggcatggtggtgcatgcccataatcccaggtactcaggaggctgaggcaggagaatcgcttgaacctgggaggcagaggttgcagtgagctgagatcgcgccactgcactccagcctgggcgacagagcgagactctgtctcaaataagataaaataaaataaataaataaatgaggcaagaggattgcttgagcctaggagtttgaggctgtcgtaagccatgattgagctactgcactcccacctgggtggcagagcaagaccctgcctcaaaaaaataaattaataaaaggcatatggtgactggcacatgctgcagatgaacagtatctagtccctaccccttccttcccaggtggcggtgtcccaggtgtcctcattttcccacaaaacaagagcatgccatgatcccaaatctgctttctggagtgttctatgacttcgagtcctgattttctaacttcctttttggttcaatgccccattttctcaaattcacacacagacgctgatggtctctgaggagtaccttcagaacacaccaagcctgccatttcccacaacatgcccagaaagggctgtgggggcctcagtccagtgttctccagcatgggaagggtaactatggaggctctaatacaaactgaggaaaaggagcccccaatagtgtagtgggcaccacctctgggcgctgagcatgaggggaaagtggccaggtgctgatgtcccctggcatgggagtagccctgaagtccccagttcccattcttagttgatgtacgatttatccaaggtcaaggggttatgagcaatccagggctttccatcctgaaataggctatgatttgatgtcactgcaccgactgtgcatagcttcttgtaataagaatgactggttaagttcagactcaaccttagggcccatgcagaacaacccactcctaaaaaaggaaaattgggaaaaactaaagcctctctacataaagcaagttagcactctaaacacattataatccagtaaccgttcatctgtgtttttattttttatcttatttacttatttatttttgagacagagtcttgctctgtcacccaggctggagtgcaatggcgtgatctcggcccactgcaagctccacctcctgggttcaagtgattctcccgcctcagtctcctgagtagctgggactacaggcacccgccatcacgcccagctaatttttgtatatttgtagaggcggagtttccccatgttacccaggctggtctggaactcctaacctcaggtgatccgcctgcctcggcctcccaaagtgctgggattttaggcgtgagccaccgcatccggcctgtttttttttttttttttttttttaaatcctgccaagttttttctttttttttagacgaagtctcgctctgtcacccaggctggagtgcagtggcatgatctcggcttactgcaacctccacctcctggggtcacaccattctcctgcctcagcctctggaatagctgggactacaggtgcccgccaccatgcccggctaattttttgtatttttagtagagatggggtttcaccgcgttagccaggatggtctcgatctcctgacctcctgatccgcccgcctcggcctcccaaagtgctgggattacaggcatgagccaccgcacccagccaaatcctgccaagttttactattcaccccaaaatactttttttgggataagtcaggatttacataaagtgtggggttttttgtttgtttgtttgtttgtgacggggtctcagtcagtcacccaggagtgcaacggtgagatctcagctcactgcaacctccacctcctggactcaagtgattctcccatctcttgagtaattggactacaggtgcgtgccaccatgcctggataattttaaaattttttataaagacaaggttttgccatgttgcccaggctgttctcaaactcttgggctcaagcaatccacctgcctcagcctcccaaagtgctgggattacaagtgtgagccacctcgcccagccaggatttacataaagtattttaaaagtcatattggggcagacgtggtggctcatgcctgtaatcctaggactctgggaggtcgaggcaggtggatcacctgaggtcaagagttcaagaccagcgtggccaaaatggggaaccctcgtctctactaaaaatacaaaagttagctggacgtggtggtgggcatctgtaatcccagctactaggaggctgagccaggaaaatcgcttgaacccaggaggtggagcgtgcagtgagctgagatctcaccgttgcactccagcctgggcaaaaaagagcaaaacctctgtctcaaaaaaaaaaaaaaaaaaaaagtcatattagaccattttataggtggaaaaatagtccaaggaagtgagcagggaagaatgacctaccaaagttgtttatgaagccagaggcctagcagagtctagaacctaggtctcccagctcccaactcagggctctttccagtggctccatatcatcaaacatggtccaatattgttcactgcacaactctgcacataggctaccatgggaatgacatccctacaattgcccaaattggtgaccctgccattggaaccctggaaaattctgctccaagttcctaggctgagttagggaatgccatttccttacaaaatgttcagcatcctatgaagacagctggccacagaaaatggcctgggtgagatatgagaacaaagctacaaatggaatgaaacaaagtgacacatacattggcaaataagtgatttagagaaaagaatgccacacctcacagagaactccagagtctgccaccccaagatttcattctaaattaggcatacatccgacaatatttggattcaatttttacccgtttttgctctttttccagctcagatgcagaaagctggagcgaagatcagacaccactttcctatctagcaaagtctatgttgaaacctgtgatcccttccttccaatcaggaaagagttaccttggcaacgaaattactaactcactcaattagcccccacttctaccaatgctcagtaatcacagaccatcagcccccggagagctcagctttcagcagtctgatgctaccgcctcatttagagatggaagctcagagaggtttccactccgaggtgcgctccatttgaacactgtgaaagctggtgcaggcaaaggggcaaaactcttccgagtagtgtttcctcctggttttccatcataactgaagggagagcaattgacctgcccctaccagtgttacccaaaagacataataggtaagagtggggggtctgcaggcagccctccactgtcggctgtgtgatatgggacaggttcagtaagctcaatgaactcatttgcaaaatgtgggtaagggtagagcaccttgaagacttgtgtgaaaattaaattagaaccaaagagcaaatggtatgggaaccaaagagcaaataataaacaaaacagaacactgttcctgagagacgttgcattaaggccacttctttgagtcttctgcagaaaaccctgcctcttactgacttcttcaatatttcttaacaggcacaaacctgtttcttctgaaggtcagaccagtttcctgatcatgcaccccagttgcataggtgggtgttaagggaagtgtagaagaagggaataagggcggaggcggccgggtgcggtggctcacacctgtaatctcaacaatttggtaaacccaggcaggcggatcatgtgaggtcatgagttcgaaaccagcctggccaaaatggtgaaacctcgtctctactaaaaatacaaaaattagctgggcgtggtggtgcatgctacttgggaggctgaggcaggagaatcgcttgaactcaggaggcggaggttacagtgagctgagatcacgccactgcactccagcatgggcatctaaaaagagagagaaaaaaagggtggagccaagctaagcctgcaaagcagctcagggttggaactggtggaatagagggagcaggaatatcacaaaggatagggttggcagttggcagtgaacacagcctggggccacagctcttaactcccccatttcctatcagaaaacctatccttttccaaaattcaaatactcaagttctacttgctgtcctgtccagtcctggctataatctgcactgagaaaaccatacaataggccgggtgcggtggctcacacctgtaatcccaacactttgggaggctgagacgggtggatcacctgaggtcaagagttcgagactagcctggccaacatggtgaaaccctgtctctactgaaaatacaaaaattagccaggcacggtggcatgcgcctgtagtcccagctactcggagggctgaggtaggagaatcgcttgaacccatgaggcagaggctgcagtgagctgagatggtgccattgcactccagcctgggtggcagagtgagactccatctccaaaaaaaaaaaaaaaaaaaaaaagagaaaaccatgcatgcaatttcttcacaggaagtggcctttgagttcatttcattctcactctcacatttcatttactgtcattatagagttatctcagggactcatatgtgaatgaatgtgttctcttccccaatagattatgtattttgtgatggcagaggagtgacaagatgatgaggatgttttaggcagattgtcaggctgcatggcatggggagtggtctggagctgaggaaaacactgatggtcagccagatcagccgaatggtgttaaagctcccaggcacccaggcgattaagggagaggaaaacacaagagacacttccaaaagaaaaccggtaggcctcagttaactgtactgtgtagctgtaaaatcatggctctggagccagactgcctggctccttccttgaaagctccttcctgtgaccttgggcaggtaacttcacctctctaaccttacgttcagttgcaaagtcccatgataaaaaaaaaaaagtccccccctcagagggttgttgtgaggattaattgagctaatgctagtaaaaatgcttaggccactgcctgcctgcaacatagctgcatttagcaacagcaccagggtactggtatttagtaaatatttgcagagcaaacaatgggcaatttcaacagactggcagaggctaagggagtggggtgcttaggacgtagatgatgtgttgtggtgcctacaagtctgaagatgggaaaagagtgactacagctaaaaagggaaaatggccaagggaaggattcactcagccaggggagaactgtgctcatctgggtgtggagagaggatacaaaagggtgaaattgccaggcacggtggctcacgcctgtaatcccagtactttgagaggctaaggcgggtggatcacttgaggtcaagagtttgagaccaacctggccaacatggtgaaaccgtctctactaaaaatacaaaaattagctgggcgtggtggcatacgcctgtagtcccagttactcaggaggctaaggcatgagaatcacttgaacccgggaggctgaggttgcacgccactacactccagcctgggtgacagagcgatatgccgtctcaagaaaaaaaaaaaggggtgaaatcaaagggaagatgctataaaggtctaagttcctggaggagtgggacagtatggggtcctcagacagggcaggtttgaagggcagggcttagggggactgtggttgtggatgccccacatgacagctccctgtgtcactaactgtcctgccacagtgtggctgcaacctgacagattggttgctgaaaccatccttcatgcctgggatggctggacatgtttctgttgtttttgtgtgaatgaattatctgtagctgatgctataatggaatgaaaatgaaaactgataccaaggagtttaagtgctccctcttatcaactgttaactgactcatagcaagtaaaatcacaacccccaactgataggctgcccaggcagtttgtttgacttattgatttgggtgggttaaaaaaagcaagagctggttatcatcctgttacctttgccctgccttttgcctgtttctgtaactgcctaaattagattccacagcctaagatcggtgaaaaatggtttcctataggttttcctgaaaatctttcctagacactgaagtcacaaacccctttctgctgatgcagcataaatagtacttttcttcagctgggctaaggaggggaggaatccagtgcagatgttcaaaacacgctacttaagggtgctgacaaaggcaacttgagaattaacttcaggattcaaagacagtgaaagtcattgaataagatctgattccatatgccccggacctctgtggcctgactacagaggatatacatagggataatagatacagctgtgtttgtgttatgtgcacatgtggacccactactgttcaccctacagtctcccttggcttctcctgggtctacttttattttctgtctgttccttttgtgtagtcttcttcctcccagagatttgatgagttgggtatttgtaaagtgcttagaaggccgggcacacacaggctgggtgtggtggctcacgcctataatcccagcactttggaaggccgaggcgggtggatcacttgaggtcaaaagttcgagaccagcctggacaacatggcaaaacccgtctataccaaaaaaatacaaaaaaaaaattagccagatgtggtggtgcccgcctgtagctacagctccttgggaggctgaggcagaagaatcacttgaacctgggaggcagaagttgtagtgagtcgagatcacgccactgcactccagcctgggcaacagtgtgagactgtctcaaaaaaaaaaagaaaaaagaaagaaaaagtgcttagaacacagcctggcacatggcacgcactattgcacattagctagtgttattactgcccatcttccaggccccattctgcgccccaccccatcccacccccttagccttaactgccaaatctttatcttaagccctgaaccctctccaactcctagtcatttacaaggcaccaggcttctgtcctcgtaacttcccatgtgaaactcctaattctccaaacaccacacacacacacataccatttctcattatttccctattgctctggtccttctaggctagagacttgcagaatgttatcagggaaacatgggcaatggccccttcagaagacgaagctgtctcaactctgtgaccatccactacaaggggctagggatatcctagccaaaatcattcctgagctaagagtactaggaatgggctatcccaagctgcaacaccttggaaatggccattgcctcgtagacagagacacttccccaggcccaggccctccacaggctttgcaaatggctggatcagtagcaagagttggggtgagaagagcgtactgtgtgtaggctcagacaggtgacaagggtgtgtgagaagagcattgtgtgtaggctcagacagggggcaagaggaccaacttaagtgccctgagttctgattctgctctaccaccaataattcctttcaccattgtaaaaagcaaagtagggccaggcacggtggctcacacctgtaatcccagcactttgggaggccaagacaggtggatcacttgaggttagcagtttgagaccagccagggcaacacggtgaaacctcatctctgctaaaaatacaaaagttagctgggagtggtggcgggcacctgtaatcccagctacttgggaggctgaggcaggagaattgcttgaacccaggaggtggaggctgcagtgagccaagatcatgccactgcactccagcctggggacagagcaagaccacgtcttaaaaaaaaaaaaatgccaggtgccgtggctcatgcctgtaattccagcactttgggaggtcaaggtaggcggatcacaaggtcagatcgagaccatcctggccaacatggtaaaaccccgtctctactaaatatacaaaaattagctgggtgtggtggcatgctcctgtagtcccagttactcgggaggctgaggcaggagaatcacttgaacccaggagagggaggctgcagtgagctgagatcacaccactgcactctagccaggcgacagagcgagattccatctcaaaaaaaaaaaaatcttgtaaaaggtgccaaccagggtgcctgccctaacagggatcagctccatctctacctaggaagtagagaaacactcagatcttgtaggtcttttcccattgtctgtagtccttatctataagatggaaaaatagtgcctacctcgtggcacataaagccatgtggtagtaccaagaatgagcagctatcactttttgagcaatgaagtctccccttcaagtcctcatttaacccttccaactcccctattaagtactattgttttacaaatcacaagggaaaaactcagagtcttgacttgcccaccatgacacagctggtgagcagaaagggctgaggcaactgagcatcagccttcctctgcagccccagcctcgggagtgtgctgagcaggagaggttccccgggggctgggttagtagagctgggcaaggaaggggcaaggcaggggccaggtgtggtggctcacgcctttaatcccagcactttgggaggccgaggagggcagatcacttgagctcgagttcaagaccagcctgggcaacacagtgagaacccatctctactaaaaatataaaaaattagcctggcatggtggtatgagcctgtagtcccagctactcaggaggttgaggtgagaggactgtttgagcccaggaggttgaggctgcagtgagccaagatcgtgccactgcactccaacctgggttacagagtaagacaccatctcaaaataataaaattaaattaaaaagagaaaagggcaaggcaggaactaggaagggattcagcaagggctctatgcctgggaagacagggcagagagagaatgaggagaggaggagggctacttcggtcaaatctaacccctgagtgctcaaaccaagccattttacaactaccaaatacactgctgtaaaaccctgtttttctctcccaaggccatagctcaagactaggtcagtctcaaaggggaaagcaggctggcttcgcctgtgccctccccattttgcacaaaaacgtccagatgaaaacccacctccctccaccacagcacctctttgctctccagcccagaaagcatttctagaatacattgtctttccacaaagggagtggaagcccatcttgcagcttctaaaaacctggactcaattttctgatcttgtggaataaaaacttagaagcactcaagtcctgtggctctactaggattctgtgcccatcagcattggcccaaaccatttgtccaggtccccccccccccgtttagcccaagtgccctctttattaaggacatccccatatgcttttctgcccctctcccaccttccaccaaaatgccaaaccgtgctccaaaacaaaagccaaatttattcagcagacattttaattatgaaatcctataaatcaggaccaccacaatttcagacactccgttgcgaagtgtacatcaatagctacatctggaggatgaacaagccattgaatcttttaaaaattggtttagctaccttaaagtttgggggtggcaccttacaaaagcgccgtcaagtttcatacagccagcggcttcttctctgggagagtcacattttaaaaccggtttcagacacaaaagaagggctggcacgggaggaggaaataaattgtgagggtgaggagccgccgaggccgaggcccatggctccatggagggccagaagagagcagaaaaacgtccagggtctctcatgcattcctatagacaccagaaagggtggaataagaaagctcagctgggaggacaagaaagagactcaagagatcgtttatgactgtttctgagaaagctcctggcatggccatgagtggccttccgggagtcctgtaaaaaggaaagcacagaaaacaggaaagaactctccctacacgtccctctctgcctgtttgtgtcctcgggagactccaagcggtggtaaagcaccaacagggctcttcttggagcaagagaaagaaaagactccggggtgagtaagctctcccaggaaccccacagcaaaccgtgaccttgaacacagatggcaaggtcaagtcatttacaagtccacattcaaatccaaatctcccacctgcaaaattcttcacctctctccagtcccttaattggagttcacatctcccaccttcaccagccaccgaatcggtgggaaaaaggggcaatgccaagccacccaccaccaaacttttacattcttctcccctctggaatttctttgcacagcaattgtagcaccacttactaagctcctccaccagaaaataagaaaatgtatgcgtgtcgttagttttcaagtattgttataaagccatcgcgattcctacccctgagccctccttaaacaatccaagctcacgacgcccccaagggctaagtgaggtacaagtcgatgcaagtagctgccatagttctcccagtttatcccaggtccttgggcttggatggcccgggaaattctcatgccccacggaagcaccctggcgcatacatttctccacgcttaagttttctccgacggcctcgccgcggctggtaacttctctggttgagatctctccccacgcgcctccccgcagccaaagtggtcgctcccaggctggcgacgtcggcttcagctcagagttagtaggaactggacgctgttgggtctacgcagcggcctccacttcctcctccaggaggcctgcgtcagagcaaggagcctgagggctgcagggcaatgcggtcaggtccgctgcggcctcccccgggcccaggggcgcttgcggggcccgtggctgcaaccgcggcgacggctcgttggagtctccgcacggcttccttgatgaggtttcccgagagcacgagctgctggaggagccgatgcgggtcgtcgtcgccggcgcgtgccccggcttgggtccatcggcgctgctgcaagcggcgggaggtgaccgcgtccctgagccatcctcgccggcacggccccggcagcgcgctggggcctgcggcgacctccgccacgcagtagggcgcacggcgtccgcgcacgcgccgcggtcccctagggcgcacggcagggcccagagggcgccgggccaccgtctcagccgaagcgggcggcagcagcagcggcaccgccgggggccgggccttgtccgtcggcaccgcgcagcaggggccccggggcccgcagcggcacccccgggggcgcgcacggcgaggccgggctgtctgcgccgcgtccagctgcagcgtctcgccgatctgggccaccagccggtccacctcgcccgagctgcccagcgtcaccgactgctgcagcaggaggaagctgtcgtcctcctcttcctccccctccgcctcctcgccggcttcctcttcctcctccctccggcacggcatggccccccgtcctggcacccggagctgtgcgggcttcgctgggggcttggttgcccgcgggcgcggagctgcgggcgaagccggagcaggggcggacgcggaagccagagcccgccaggcactcgagccacgcgcctgcagccgctggagccggaatcctgccggctcgggttgatttgtaaacaatgggtgacgtcgcgccgggccctaccaccgcaccggggcgggggtgacgcgcgagcaggcacgggggcaaagggcggcgcgggcgtgaccgaagccgtcccgcgcctgtgttcgttgtccctccaggagggggtccggggcgtggggactgatttccgacctcccgggcccaacgagccgtgctgaaacgtggcgcctcggaggaggctgaggttggtttctcccacgcacggacacacccacacccactccgggcccgcctcctgggccgcggcctccctccccacgtgtcggccgcgcctaagcccgcccgactcccgccccgcgcacccgcagttcccggccctggtcgtgggggaggggcgggccgccgcgggtccggcttcgacgaggcggggcggggaaaggcggagggaattgggagtgaagaggcggcacgttacttatttacttatttattatttagaaaaggtctctgtcgcccaggctgaagtatagtggcgcgaacacggctgactgcagcctcgaactctggcttaagtaatcatcccactttaagcctccggagcagctgggaccacaggcgcggccaccacgcctggctaattaaaaaaattttttttgtagagacggtggtggggggggggtctcactatattgcccaggctggtctcgaactcttgggctcaaggagtcctcgctcctcggcctccgaaagtgttggggttactggcgtcagccgccgcgcccggcctaagaggggacgctttgaagcagagcagaatcgctctgaggtgaggtcccagaggctttccctcccgcagtcttcaagcccccggacatatcatgagaataggactcaccgccgctcggctaaagaagggtctttttttttttttaaggttcaaatagaaatataggggattggccaggagcggtgggtggctcatgcctgtgatcccaacactttgggaggccgaggcgggcggatcacctgaggtcaggagttccagaccagtctggccaacatggtgaaaccccatctctgctaaaaatacaaaaattagccgggcgtggtggcgggcgcctgtaatcccagctactcgggagactgaggcaggagaatggtttgaaccctggaggcggaggttgcagtgagccgagatcacgccactgcactccagcctgggcaacaaagcgagactccgtctcaaaaaaaaaaagaaaaatataagggatggaaaaaatctctcatggttcacatttaaatttttttcctttttagcctttgttctatgaaagtgtagtatacaaacacatgcatacagtgttacacacttttccactttgccttacatcataaacgtttttcgtgttattgcatgcactttgaaaacattttaatgattacataagtttccatcaagtgcctatgtttttaacatttgcctaatttcaccatcgttaagtgtgtaactaacatttttgtgcgcgacactttaagatattgatgattctttccttagggcatattcccaggagtggaattttaagtcacagtagttgggtattttaaggtttactgataaatgttcaggaagtgtctttccaagagttaggtaaatgtactctaccatcattaatgcttgagcatacatcattacaccttcactagtatttgagtattattgaatttttttttttttgcggattatatagggaaattttctcccttcagtttgcatatct

SEQ ID NO: 13667 - DNA, 89892 bp, Human
  misc_feature (1)...(89892): n = A,T,C or G
atggcgcaatctcggctcactgcaatctctgcctcccgggttcaagcgattctcctgcctcagcctcccaagtagccgggattacaggcatatgccatcacacctggctaattttgtatttttattagagacagggtttcatcatgttggtcagtctagtctcgaactcctgataccaggcgatctgactgcctcggcctcccaaagtgctgggattacaggcatgagccaccgtgccaggccgcaaattgctatttttcaattcacatttactttaccttttcttagggcaagatctggcagagtctaagatatggtggaaactaatataaaaggatttttccaatgaaataagaataggatgttgctatttaaacttcatatacatttaaaatgtgctagtttgtatgcagaacagaaactcaaactcagtatttgcccctagctgcttacattggaaggcagtggtggcagtttactcaaaatgagtaagaaaataaatcagcttacaactctagactgtacagacatgcaggctgccttttacgtttctgactcctgatttatttttctttcccaccttcccacggcgaagggcagtcaatgaatactcagatcaagtgtctgtctggaaagctggcagtcttccagaaatacaattaggtatgaaagaaaagtcccatccctcacctccatagaatattactccaactctttcacagcaggaacactagagtgggaatgagaagtgtggcccttgtgtgttacgttacttcttttgagagtatggtcatatccatccgtttgtagcattacacaaggagtcagttaaggtacaaggggtgtgagacccagtgactgcccccaaagtgcttgtcactagagcttctctccctcacctctacttggccttgacatttgggttcgttcagagggttgccccatactgcctttgggttcgttcagagggttgccccatactgccttctggtaaaatcttggcgccctaggcctaagcctgctcatcttgtgcctccttttcctcctcctcagggcccattccagtggaacagaagtgctactttgggggtggactgaaacaagttgctgggcttccattggccattgccacttgcttgtcgttgtgaggaggggccgtgcctccacaggcccatacctgtaacctgacgatactgttgtgagcgggaatggaggaagtgcatggaagcccctcagcacgatgcatagtgaacagacaagctgtgaaccttgggagttatcaccatgtgtgatgatgctggtgaagaaagcctgcactgaggaggctgacagcctgggtttgaatcccctcatttggaatataatcttggcaaagtctgaaagcctcaattgctcgtttgtaaaactggaagatagtaggacttgctgcccggggtcggggcaggatggagggggcccatgagaattaaggcagagcccagcggagtgcattgtaaggatccatgagtgtgaaccttcgtttttactactgcatatgaggatcctgccaacaaacctggcggcttcaagcatccttgcccttaaccaaataagctcttaggtcctagaggcaggaagacttccttgaagaggcgcgggaggctggtgaggggagtggaggacgctctgggaccctctgggggtggggcgggcggggtgaacttgaccccaggccgcgtgccgggcgtgccatctgccgctccgctgcaaggtctcgcccgggaccggggctggcggagcgcgcgcccgcgagtaggggccgggccggggaccccgcctaggcggcggcggccgggtccccaaggctgggcgctgcttgcggaaccgacggggcggagaggagcgtggcgggaggaggagtaggagaagggggctggtcaagggaagtgcgacgtgtctgcggagcctttttatacctccttcccgggagtccggcagcgctgctgctgctgctgctgctgctgctgccgccgccgccgccgccgtccctgcgtccttcggtctctgctcccgggacccgggctccgccgcagccagccagcatgtcggggatcaagaagcaaaagacggtaggcttccaggcgccggcttccctccccgccaccgcactgcacgcgccgacccccaacccccaattccccggcacttgggtcccaccctccccgggagggggcgtggggaggaggagtaagagtggggcacggagggaagcaggagaaagaggctctgtgtggaattcccggggcagtcctcgccccgcagcccctctccacctcgcgactctgggaatctgcgctccttggggtcgccgcgcccgcgagagacctcccgagcttctcaagtgggtccggatctagatccaggaccagggacaggaaatcccctttctttcccaagagctcttccagacccgccttttcttctgtagggtctcggagcagatcgagctgactcccgttctgccaggtctggtcgctggggttttgtctatgggaacttccttggagtgggctttaatgacggactttcatagaggaaactgcaattatcaaagcaaactggaggaaattgcatttctacactggcgggatttagccctctagcttgatttcggcattgggtggcatctcgagttcagtaatgaggggtgagggtgcccctcggtttggtggagtaagatgaggggactgtgttgaggaggcacacttttacccagaattaataatctgagctgtcctcctttaatgggaaatatgagggcgtgtcaaagagaaaagtttctttcccagcaacatgggcacctataaattttgcattcttaaaaatggcagcagttctatttgtcaattataccccaataaactgaaaaaaaaaaaaaaaaccgggagcagtaatcatagactcttagagttggatggcgccttctagacagcactggggccacgtcagatgtggtcagcaagccttgataaaatcctactcagcagtttggccgctgaacattctatcttcagccaccaccctgcaagcctcagatgattgtactggttactgaatgggttgacctctctctagtagatagacgtgcaatggacacatagtaggtgcctgataaatgtttattcttatataatgtgtattaccgaaatatctttgaggtgtatttgtggtgggccggggagaggtttaaaaaaaaaaacaaaatataaagccaagaagtggggaaggagtgtggaggggccatgcagggctagaagggtcatttgagcagcaagagaacagggtgggggctctgtggctccagggaccatactggaccagcaggagggtccagggtgtaggtggcatcaatttgggaagggacatttatcaaaatccagctgcctttctcaggagtaatttttaagtgggggactctcagcgttgtaacatatttttgaaataataaatgaaaatcacttgtattttgttcctatttaatgcgattaatttctgtaaaatcctaaatagtgtcttctaaatggcaagccgctgtgccagtagctttttatatcaatggggttttaattcccaccttcctgcttgcatcaagaattccttctcagttgtgatgggggactttgtcaagcattagaaagggacgaggtggtctctcctcttgatgcctccagtcggcaggagcccaggaagaggagggtttgagaacagggtcattacaaatcaattgcgggggctctgcacagtcagaagcagtgagaaatttgagggccggagggtttggtttttgtatttacacattctgaaccttctattttttgttaggtgggtgtatgtgtgtgtctgttttatacagcattaaattaactcctgaaacagctaactgaaatagaacttttctgaattttgatttagtctaacgcagttataacccaggcaccaacccaagttcccaaaagggctagataggtactatcggtactatttacagcaagccagctgtaaatgcatgtggaatctctcaagctttgaatgttcattcaaaatgtgttttgaaaccttgcaggccaaagcaaaatctgtccgcttgtgtgacctctgaactaatcaattatttgataagtattgctgacctcacaagctagcctaggagtgagactgagctgatcttttacggtcttataggaatcatcacattgtttactgcactgtcaacagaggacagttaattcacacagcagccactacagtaacttcaaatatttgttgagcacctactgtatgccaggtggtatactgggtgggggaggcggaaaaggagatacctcttttccaggtttttttggccacactctctggatgaatattgcctttcagttcagaccactctaggaagaggagatagttttggtttaaatgagagagtgtaggatgactttttcataagctttagaaaaaataaattaagtgttcttttataaaggaaggtagcacattccttctgttttatgcatctttaccatggaaaccaaagaaacagctaccagtcacattcatcccttcatcatttccacccctcacttacctccaaccctggctaccctcccacccccaccccctatacacacacatagacacctaggagagggaaagggacagactgcctctaggggactggaaagaagggaaggcaaaggcctgggcctttcctcttacatcatttcctggattaacatttttcaaggcccacagacagtgctgttatgttctggagacacccaatctgaaaacattgactgagatattaagttatttccgaaggatcaaataggaaaacaattggaaaggagtgaaaagatactgaaaaccacagcgctctccatagatgtaagggattatcaaccttttccttatttattttctttctttctttttttttttgagacagagtctcactctgtcacccaggctggagtgcagtagcgtggcatgatctcagctcactgcaacctccgcctcccgggttcaagccattctcttgccccagcctcccaagtagctgggattacaggcaccaccatcatgccctgctaattaccttttccttattttcagaattgtgcacagtataacattatttttctagaagtagccactttttttttttttttttttttttgagatggagtctcgctctgtcacccaggctggagtgcagagaagcgatctcgtctcactgcaacctccgcctcccaagttcgagcaattctcctgcctcagcctcccgagtagctggcactactggtgtgtaccaccacgcccagctaatttttgtatttttagtagagacggggttttgccacgttggtcaggctggtctcgaactcctgacctcaggtgattcacccaccttgaccttccaaagtgctgggattgcaggcttgagccactgcccccagccagaagtaattacttttaaaactatataaagacactaccgaaggcaagacatgaattctagatgagcaactactggagggagggacaaaaagcatttcctagaggccagacactcagacatctcatccccacagtagctctcatctcaggaaacagctttgtcttcaggggaggagaaataccaggggcagggcactactgaaattcaggtctgtccagcttcaaaactcatgctcttgaccccctccgtacttctgtttcaggatgtaactgctctggcccaaagttttctcatctgtaaaatgtgggtaataataactttccccttacaattgtcgtgaaaagtaagtaactcctaaaaattgtcttgctcagtgccagacccagagttagtgcttcatatgcagtagctatttcatttgtattaaactatactgtcatggtttggcatacataaaaagaaaaaacagcacacatcatactgttttgaagactcagtaaatgacaacagccagaatatttttgttttgttttgagacaggctggagtgcagtgctgctataatgggtcactgcagtctcgacctcctgggctcaagtgatcctcctgcctcagcctcccaagtacctagtactacaggtgcacaccatcatgcctggctaacttttaaagtttttgttgttgttgttttggtagagatgaggtctcactctgttgctctggccagtcttgaactcctgagctgaagagatcctcctgccttggcctcccgaagtattaggattgcaggcttgagccactgtgcttggccagccagaatatttaataaggaaaaacaaatgcagaaatatagaggtgacaatttgaattcttattgtgataggctggatagaagacactggttgacctctggtagaggtaccagagtatcagtgagtttttgccaacaactttggccaagaaagataatccatgcatagagtaaatattggactaacttctctccacccttcctgtgccttcaactattcctatgtgcaccttaaaattagtgtttcccaattcatgccatcgccatttattagatcatctgtttggactttggtgcggttaaaagataaatgtggttaactcagttatatgtctctttgagatagttatctttgtcttttatcacttttctgttgatgcatgtggctctgtggtttgctgaggggataattaggcttacctctaacatggaacttttagggaattagagtctgggaaaggcatcaatgatgtcaatctcagtcctaggagatttctgtttatttcaaaatctatcactaaatagtaatgggcactcattagtctttgtgtttggaagtcttaggaaaatgcagaaactaaaggtaaataaacataaatataacactagttcaactgttctattagcccctaggtgatttgttcatatgacacttggaacagcttatatgcccagcacctgacagtgatcctggcacagattaggtgttcaatattcattgaataaatgaatgagtaaatggctagagaattcattagaggatgtatttgctcttaggatccacattttttcctagattcctcactctcccctcttctctttgtgtgcttggttatttttgactgggtatttgtcattactgctgaaaaattgcttgtagagattccttcaggcctaggatgaatgactttgttttcagagaggatttgcttttgtttctgccaggtgtctggccccactcctagcctaggactcctttaattgaatttaccactttttttttttttggagacagagtctcgcactgtcacccaggctggagtgcagtggcgtgatctcagctcactgcaagttccgccttccgggttcacgccattcttctgcctcagcctcccgagtagctggaactacaggtgcctgccaccacgcccggctaactttttgtatttttagtagagacggggtttcaccgcgttaaccaggatggttttgatctcctgacctcgtgatctgcccgcctcggcctcccaaagtgctgggattacaggcgtgagccaccgtgcccggcctgaatttaccactttttaaagacttaggtgatgtgaatttggattgctattttgcacatgagagccagcttgtgaatacaacttcccagggaccaccctccccttttatactcactttctatgccaagacaattgtccttgccgtctctctgagtgggaggtaggtttattctggttcacccttatttttagagtgtagggtttaggagcccagcttaacttgaggaagacctttttttattttcacttgagtgggttctgggctttaatttctgttccacctctctcagtgaagctgtcaaaatcagttcatgtatgctcctctcagcaaatatgccccataaggataaaagtgcctctctgcttacttatctctttgagttcttgctttcttccagattttggcctagtagtttcttcctattttgtcagctatttgttgttttaatttttttttcttttttttttttttagatggagtcttgctctgtcacccaggctcaagtgctgttggcgtgatcttggctcattgcaacctccacctcccaagttcaagcgattctcacgcctcggcctccctagtagctggggttacaggtgtgcaccaccacacccggctaatttttgtatttttagttgagacgggttttcaccatgttggccagactggtcttgaactcctgacctcaagtgatctgtctgccttggcctcccagagtgctgggattacaggcatgagccaccatgctcatcctgttgttttaaatttgattattttatgttattactagcatttatagttattttcagtggaagcatcaatctgaataacctacccatcactgctggaaacagagacctctaccctttctagattcctgtgaatcattaacatctcctatcataccttaccagacctgtgtcgctgtcataaaaggagtactttttaaacatgaactctagtcagatagctagtcaaaaatctttgatttaatcctttttccctaggatgtgctacagtgtggagtggggagtgctcaccttgtcttggtggtctcttcctatgcagacatccttagagatgtgcattgtcctgtccaatccttagtgttggtccaatttcaagtgcgttcttgtctgaaaggccccttcaatttaaacaactctccttacttctttcatgctctcctgggtaccctgaggccgttttgttgctccagcacaactctgaggtcgtggggtatgaatttggtgggactagttaaggtccttgacatgtccccactactcccaggagtgtaggaactaggttcctactttgctgtgaccatgcagggacttggaggagctctgggggctgctgaaacccaccctcttttcctctgagatcagaagcacatccaatgccctctgctttcagagcccccagggctatttggcctccctcttccccaagctcagcaccaggggcaggacactactccctgtttcagactcagactggtacccaagcttgctttgcttctcttttaataaagattaaagctttcccaaaaggttaattggtttatcataagcattgaatttgttataaattttgtcttcttgttcctttttcctgtctttttgatcaccacatttttgaaaaatttacaataaattggctgggtgtggtggctcatgcctgtaatcccagcactttgagaggctgaggtgggcggatcacttgagcgcaggagtttgagaccagcctgggcaacatggcaaaaccttgtctctacaaaaatgcaaaaaattagccaagtgtggtggcgcgggcctgtagtcccagctatctaggaggctgaggtgggatcgccccagtactggaggtcaaggctgcagtcagccatgatcatgccactacactccagcctgggtgacagagtgagaccctctctcaaaaaacctcaacaaaacaaacaaacaataaattggtgcacaagatgaaaatattttttctctgtacaaaagagccactgtattaaaacttgaaatataagttgcctctgatgacacgtggtgtataaaatggattccatcagttgactgatgtgacttcctttaaaatcttatcagcatccctttctgcatttcaaatttactactgaagttgattttgctgtaattgatattgtgcaagcacgactgtaatataaacatgacaaactcaatctgtataccatcaaatattaacttttggcaataaatgcatatagcctgtgacaataaagattttttaaaacagttacataaatatattatgtcaaatgctgcatcattcatagtgataatttctctgctagtcaatatttggtttaaatgtctagttaacacctgctttatgttttattattgatttattatgaaaagtattgatttttatccaccaagcatctatatccagtctcataccacaattacttttttaaaacaattttatgttgggtgtgtgcttttaaagacatttgtagactttatggatttaaactacctggaagaaaatccgagattctatccctataaactttattcttctacaccctcctccagtcattattaatttatgaataattcatgccttcccaatttccagcaaagtaagcaactcaagcattagtgatgattttattttcatacatttgctagtgttaaaaacctgaattaactttttggccctctgctgggggtcccatgtgtattactttgtttccttaagctctctaaaatcctttcctttttcagttcctgtcaaaatcctcacgtatatatttgtttacctcactcactcaacaatatttattgaatgaccaaaccaggatctctatttgtcataattaacaatagctaccaaagccttatattctttaattatagtttttagtctattcactgtctttaagtctattctaaacacagcatttgccttttctaattgaagcactccacccgcacctttatattatcaacgttctgcccagtaagtcttgcagtggccttgagctaaaagcaataaaattcccaattgacttttcttacatttcctcattcatttttctactaagttgaacattatttactctatattaaggctgtctctactttaaaaatgtgtgtgtgtgtgtgtgtgtgtgtgtgtgtgtttaaaaataattctagtattttacttctggaaggaaaattaggaggtcacctttaagctctttatatgacagttgatatacagcgttaagagctgtgccaggatctatggccattctttggcttgactgggtggggatacttccactaagctagaactctgatcaccctaccacacgcttaccacttctctctttatcacgtgctctttgaaagtgaccctgcctattttctacagctttatttcctctttcattcaacaagaaatattttccataaacaaaacttcctcccagttggtttattacattctgacttagctttagcattttgttgtggcattctggggacagaaaatacagaccaaaaagcagtatttgaaagatgtaacttgaccgttttgaaatatttttgattggccggactgtttctctttagaaaattcaaccctttcccacctcactcagtcttccttaaaccttctcaagtggtttaattgttttattaaaaaaagggatgccattgattagatagcatgcaatgcagataaagttgtatttggtaaaggctggaccaagttcagttatacgccaaagcctcagttcagttttacctctaaatctatccatttccattgcttcctcagttcgcaaagtactatgaagtcgattacagtaaccatgtgtggtcttcccaggacctaaattgctgactcccaatagagagtgttttcctaaagtatatgagtaattatggctcttgggccattgggtcactagtacaacaatgttttgagtagttactaaaaaataaccaaatcataactaaaataatttttcatttgacctttaagttagccaacagaataagaagacatcaaataaagcctagacattaaaattccgattgtggaatgtgcgttatttatctgaagtttctttttttagagcatgtgttgttagaaaattcctactctgttgtattctgttcattgccacgatttattgagcactgacctgtaggttaactcattgactcttcaccatctcgcgaagcaagtttgtgaataaatagtccaaagggaactcatttaactgaaatgggtctttaaagagttacccaaaggagaagttagaatcttattagcttctctgtagttaataagatgtttatttcatagaggcaatgacacttcatgccatgtagccaacacagctagattaggtaactagtaatgtattactgcttcatttgtaaaatattctggcagctgtctactgctagtatctcaagataataataatgaattctattgagaagcattccccagcacttttattaaaaaagagtaagtggcataaattggcaaatacatgttaccctcactatcacacgcatttctttctttatggtaacataaggtgaataattggaaaataaattttatttgttctcagactcaacctgtatgggtaatagtttttattgcctagccttacggctatgtcagtattcagcaaacgtgaacagaataatttgtttccactagctgcaatacttgaaccaagttgtaatattaatatgatttgtagataataaaaaagaaagtagaacaccagtgcatttttcacataaaaatttgacccagttcaaggtcgacgcttaaggatgttgtcaaccgatcaatgaggagtgcctagaaatcatgggattgtaaaaggtatgttccttggtgtttggaagaaaaattagggagcgttgtctccttctaacacataggtaagggaagtccaagtttttcagcaatcctgggctagtgtttcagcgataggtactaggaaggttcatattcccattctcaggagatgattgcataaaaagatggagcacacacacacacacacacacacactcatgctgaggagagcagcattggctgggtgtatttcaggggatgaaattgaagtcttttactggagaggagctgcattatttaaataaaaagaatcatggtgactgcatagaagttgaatcacagaatttgtgtcttcacagtgggatacaaaattctgtctaaaggatgtgttgtctctgcacagttagtcacatttagggaatggaaaaatctgggtcatcaaaaatacccagtttcttccattttcttctcagtgttgaggctgtgactcaaaaagtctcttacacatcacactgtgttattaatccttgttgtcataataacatcccttgggattcaggaaggcaccttgtgtacccaacagggttccccaaatagaagaagggaacaagcatttatccagggactatccatacagtatcccatctcatcctcacaataacctatgaagtagttcttatccctgctttacagtagggaactctgagcttgtagagactaagtaacttgcctcaggatgcataaccctaagtggcagagctggaacacaagtgccatgttttcaatcattcttttttttttcttcagttaaaataacatataatggatactatgactgtgagaatgcaaaaggatcttttgattatttaaacatgcattttaattttgtctttgcagactaaaaggatgatgcaggcactttgaaagggatttccttaggggctttttgtaatgttgtgtaatctttagaagatgtagattttagcaaatgctgttaaaaggcaataaatgttagtttggatgaggctctgtggccagttttaggaacagtagtctttggaattgaacccaacatttcaccttaagaatacaaggcttcagtgttctagtgggtgaatgcatacactcaagaataagtgattttagaaataattgcagtgacttacacataactctacacccagccttgtccattatgtgagtgctgcacagtcgagcattcatgagttacaagttcccaaagccccacaggctatgggcctgttctctggatgtactagaggtttcatcagcatttccattgctcagcacagaatgttaatatttcgtggttcagggagattgttttatatacacagcctaataaccagaaccaattgagaaaaaaatataaagaaaatacagataggtagcaaagtacagcctacagtggaacaccaacagggctagtgttaggaggggcagctgagacctgggttgaacactgtaattgtgtggctttgagcatcttctgattgaagttacacatttcaggagactcaattttatgcacgtggtattgccataagggtaattgctacctccctgtattatagcggagttcctctgggcatgcataatacctttctttcatcatgctcatcaagacttattcatactttgttatcaattatcctagtagctctacatattaggtagttacaagtattacaaatcatagattaggccactaacataaagaaatgaggtaaattccctgcagtcttcttgtggggccatgtaacagtagagaccacttgagtttgccaagtttggtggccaagtcccatgttttgtctgagaacagacagaggctcagggatattgggatgatatttggtatgaagggtttcttatttggactgcaccaagttaactgtgtgctgtgaaacattatatggcttcattttcattgggagaactagtgatataaatgatgtaacgtgaactaagtgatttagctaattacacatatttttggatgcttctaaaaaactaatatgtgatccttggagtagaggaagttgtacattcaaggttttctaccctttttgtgtgtgtttattttaatgaggacaatgggaactacaccatttctttcctgctagttcatcctggattacctttttatatccattaaacatagaaattctgaagccatgtctgcctacatgtcatcctgattgcctttgtgtataattgcagatcaaatgtagaagcagtgactacttaaaaaaaaagttgttatagaccaaggcttgaggaaagagaaaggtacagtgacaatgagatatcttgggggaaatttggtcccgtagaccaggggttagcaaatcatatcctgtgggccaaaccacagtcacctgcctgttttggtaggcctataagctaggaatggtttttacatttttttaaaagactgatggggagaagtgaaaggaaaaattatattttgtgttatgaaaagtatatgaaattaaaattttagtgtctataaataaagctttcgaaacgtaccatgcttattcgtttacacattgtggcttcttttacagcaaggatgggtatttctgtgtggcctgaaaggctgagaatgtgtactgtctgatcctttaagaaaaatttgccacctcctgttatatatagtgggggccagtgttcagttggaagatgcttaggcccatggcctgtcagcgtgtaactctatgtgtctgaattcagagagctgagtactagctgtacttcatgagccccattgaattgtgtttgttgtattgtcattgttttgttaaaacattatttttttaaagttctgtggaacactagtgtgtctactgtaatgatattattcagattatttattaattagaacattccctttataaatatctctggaattttctttgtttttgtttttgtagagatgggtctccctatgttgcccaggctggtcttgtactcctggcctcaagcgatcctcccaccttgccctcctaaagtgctggggattgcaggtgtgagccactgtgccagcctgggattttcttcatattctctttataaaaattcatagagagacatttctgtctagttttactaccagaagggttatatttttcttagctgtgtgtgtgtttgtgtgtgtatgtattcatgtgtgtgtgtgtgtgtgtgtgtgtctaattcctttgcgaattttgggaccatccaggttttccccctcaagatgcctgccagaaagctcagaagtgaatttttggcttactttttttttttttttttttttttttgcaccagctttatgcttggtaccacttcgttttatgcccctgggttgttctttcctttttcttgtccacttctgattcatgagtttttgctatgctttatgaatcttctaagtcactgaatacttttaggaactctacagaacattaaaatataaaattaatagtaagacatatctgaatttttgttctagaaggtcccagagctctcctttaccattctacctcagagagcccttttccttctgcatgttatcttgggactgtccagggctctatgcctgcagggcctagagccagtccatgaagtgctcattgagtgctttgtggtctaatgttctacccttcctgcaagcttacaaatcaaccccttcaagactgataaagacagagcagaggttctttagtatctagagtccccagaagtcaggaaggttgtgaacttggatgggtaaaaaaaatttctgttttgagatgaagtcttgctctgtctcccaggctggagtgcagtggcacgatctcggctcactgcaacctccacctcctgtgtccaagcgattctcctgcctcagctctctgagtagctgggattacaggcacgtgccaccacacccggctaattttttatatttttggtagagatgggttttcaccatgttggccaggctggtcttgaactcctggcctcaggtgatcctcctgcctaggcctcccaaagtgctgggattacagatatgagccactgctcccagcagtaattttttttttataacttgtaacagaaatttggcattttcttcaattatgaagacaggcaacaaaccacagcaatattagcaatacttgtgactatgtcaccagtagaaaccacagatactttaatatcagattatatcgttgcagatattgcaaaatatctgtgctttttataactagaaaattaagatctataaaaagatctataaaagagttataaaaatacttcaaaattaagattataactgtctacctagacagatagttcttgttatttaatacattgctaaagaagcatatttattaccgtgctataatttttaaaaagcattttgttaccgtaattctttttcttttattggcaatcctttgtgttttatgcatttaaaaacacttttctgagaggggatccataggcgaccataggggtttttgactccaaaaagggtaagaaacctccatgcatgggtgtgcccacatgcatgtatgcacacacagacacagatacacaatttttacatatggtttcaaggagttacagactcctcttacaagacccatatctaggaactgcagtttaagatcttatgccctgttggctaaaattcaaaatagcaggccctaagagggacggcctttattttgtctttttaaaacactattcaaatgaatcttttctagtaatgacttacaacaccctcttagtcatagcattagcactggctgttatcatttagtattacctctttcttctataaaacaaggaatgtgtatgtagttatgaaatcattctcttggtttataccatatcaactagatatttgtcagtgaaaaattgaaaatctacctcttcaccctctttgaattgtagtttgcattaaaaagattcgcatatttgaattttcaaaacttggtatgtgtgtattttgtaagtttggaattggataaaaattacaaatattataataagttaatgacataatcccttttgtattcttctgtgtcttgagtggttttgttgctgtaagtcaagcacatttattattcatgtatggggggccaagtttcatctgagaatgtaatttcatgctaataggttgcgttgtaagtccctggttaggatttacttatacctgcatgggttttatgcttccctgtgttccattcattacgctgctattctgaatgcatctcctaatttagtgagatctgagagccaccttagagattacgtagtccagtttttctccaccctgctaagcttcacaaaatattgatgcctggacctcactcctagtgaatatgattgaatggatctgtgttggggaatggaggcagtcttcaaaaactggctacaaggtttcttggttcagccaggcttgagaacctcagcctagcctaattccttccccatgcaaatgaaagcattgtaacatgcctgagggccaccggctcagatgagttttctctacttcagaaagctattttccctttccacatttcttttttttttttttttttttttaatgtaaagccatttcccagccagtgcagtcttctgtggtcactacattcctcatggaatatttaaaattaaatattccatgaggaatgtagctggaacgtttaaaagcttactatccttgtcctgttttaccgttacctaatgggaagacagctttctggaaaaacctgaagaccattctttcttagtgagctgttcttgacggtggtgactttatctttggaaatttgcccgattcccatatcacaattaaggaagtggcttaagaaagtagcttgtaattctctagagtgtaagtctccagatctcactgttgaactttgtatgttccagtaggactaaatctaaaataatttccttgtcacatttgatagacatgagtattagggacccacattggaagaaccctccaaaaacggacctgtctttcctttgtgagttttcagtgtaattctagcatttctgggagaaatatgtaagtacctcaagggcagaaatcctgcccacttaaatgtttcataattatcacctaaaacttagaatggatcaaattaactaattagctttgtaccttttcaacacaagctaatagattgcctgacttcgtttatctgatcatgaattttgatcaactttatctcattaggtttaaaaattaatatgttgcgttatatagcacttatctttacagagattattcatcttcaatgcaataaataaaagaaaagccaagccaggtgtgatggcacatgcctgtagacacagctacttggcaggctgaggtgggaggatcacttgagcccagcggttccaggcctgcagtaagcccagattgtgccactgtactccagtctggatgacagaatgagaccctgtctcaaaaaaaaaaaaaaaaaaaaaaaaaaaggccggatgcagtggctcatgcctataatcccagcactttgggaggccgaggcaggcagatcacttgaggtcaggagttcgagaccaacttggacaacatgatgaaaccccatctctactaaaaataaaaaaattagccgggcatggcagcacactcctgtaatcccagctactccagagattggggcaggaaaattgcttgaacccgggaggcagaggctgcagtgagctgagatcacgccactacactccagcctgggcaacagagcgagactccatctcaaaaaataagataaaatgaaaagacagacatttaatgcagatatctaagctttaaaagattggatgactcaagccaatggcaattctttttttctgatttacagttgtgtttttttaaagatggcaactttgttttactttcttcttccttctatattattttgaagtgaatttgactacaaatattttgaaaaatatatgcccctatgtattgaatctaaaaagcaattacaatttgtccttttcctctaattctcttatgcaactatcagaatggaaaataaatttcaggatacttttggatcaaaaatgacagaaatcaaattgcttgacatctagtaaccagagtggacatgaaagaggagtcaattctacagcaagccctgtaaccagctccgtgcaggagaaacatggagaattaagacaatcacctccctctaagaagctttgtgtgcttttcccagatcttcattttcataggcagtatgatttcaaaatgttgtccagtaaaaactctttatcaagttataactggaaagctacccactatctctttatataatgacagcatccactatgtaagatttatattacatgcatgcgtgtggaatgtactttgaaccactctctaactatgatcataggtcagtacctgccagagaatggagatttttaaaaattgtgatcacagatttgagaatataatctttttaaaaaagatatgcttagccttgtaaataaagataagcattttaagaatttattttataaagaaaaggtttgatggagcaaagatttaagcattgagaaacccatagacctacaagaaaaaaacatgaatcttatataatcacagaatggggaagaccacttctaagtataatacacattcagatactataaatttttttgaatataaaaacttttttttcccagaaataaatctgcatctttatagccaactgattttctacaaaggcgccaagactatacactggggaaaggataccctcttcaataaatggtgctgggaaaattgacgatccatacacagaagattgaaactggacccctgtctctcaccatatacaaaaatcaaccgaagatggattaaagatgtgaatataagaccccaaactttaaaactactagaagaaaacacagggaaaacacttcaagatattggtctaggcaaatattttatggttaagaccttaaaagcatagacacctaaaacgaaaatagacaaattgaactatattaaactaaaaagcttctgcacaacaaaggaaacaatcaacagcatgaagaggcaacctgttgaatgagagaaaatattgcatactatcttctgacaagggactaatatccagactatatcagaaacccagcagcgtaaaaaaaaaattccattaaaaagtgggcaaaggacatgaatagacaattctcaaaagaagacatgtaaatggccaacagatatgtgaaaaaatgctccacatcactaattgtcaggaaaattcaaatcaaaaccatgagatattacctcacctcatgtagaagggctaatatgtaaaaagacaaaaaaaaagtaatactggtgaggatgtggaaaaaagggaattcatacactgttggtgggaatgtaaattagtaaagccactgtggaaaacaaatggagatttctcaaaaaactaaaaacagaactatgatacagtccatcagttccactacgggtatctattcaaaggaaaagcaatcagtatatcaaagagatacctacatttacatgtttattgtagcactattcataataggaaagacatggaataaacccaggtgtccatcaacaggcaaatggataaagaaaatgtggtatatgtttacaatggaatactattcagccataaaaaagaatgaaatcatgtcatttgcagcaacatggatgcaactggagatcattatattaaatgatataatccaggcacagaaggacaaacattgcgtgttttcactcatatgcagaagctagaaaacttgatatcatcaaggtagagagtagaatgatacatactagaggccgggaaaattggttagggtggggagatgaacaaagataggttaacaggtacagatacaattagataaaagttataataagttctatcgttctacagcagagcagagtgactatagttagcaacaatgtattgtatatttcaaagtagctggaagtgaggactggaattgttctcaacacataaaaataataaatgcacaaagtgatagactcttcaaataccctgacttaatcattacacattctatgcatgtaacaaactaccacatgcaccctgtaagtatgtaaaatataatatatcaataaaaagccaaatattttaaaaattacatgccaattttttttatgtgtgttaaaacaaaagtcaaaagacaagcgaaaacctaggggataatttgtaactcataggagacataggactgttttccaaaatatatagaactcctataaatcaatatttttaaaaatcagcaggtctgacacagtggctcatgtctgtaatcccggcacttcaggaggctgagacaggtagattgcttgagtccaggggttcgagaccagcctgggcaacatgacaaaaccccatctctacaaaaaatacaaaaattagccaggtatggtggtgcgtgcctgtagtcccaggtacttgggaggctgaggtgggagtatcgcttgagactcgaaggtcaaggctgcagtgagccaccatgatcgtgccactgcgctccagcctgagcaacagtgagaacctatctcaaaaaaaaaaaaaaaaagtcactctcatcacagtctccactgttgtaatggtccactgtctgcaaggacaagttattgatcaggaggatttccaaccaagagcgagaacccaaacaaattagcacaactcatcttctgcttctgtaacaaacaagttgtccagttgtcactttgggcactaaagagggacttactctcagatttgggaactagacccgttactattttctttagcactggagggagccttcctttatttggtctcactctaagttggtttcacactgaagtcaattttaagtctgtgctttgcaagtatgaattgaaaatggtggtgtggggtgctttcttggctttggcacctggataacaaagttccccaggaacaagctttcattcatcaatggaatacactggatttctgtcttacagttcagggtgggccagaaggagccatggtgggtctgtagagggatgaattagcatcctgttagaaaggtgctgggtccctcctcagtcactttgaatgctccctgtttttgcagcagtcatgacccatatttttaaacttttaaagtataaagtccatacagaaaaatatataaattttcagtgtgctactcaatgaatttgtgtgatggtatttcaggtagtattctgttttctaatctgtgtactggaacacactttcataactggcacacagattaggaaacagaatactacctgaatcccacaaatgccttccagtcactacctccttctcctcggtaaccatcctgactaatcttgccggtttttgagcttttagaaatggaattctacgttatacaatcttttgtgtttggtttcttttgctccgagatgtatttgtgagagtcattcatattgtttgtgtgcaattggaatttgttcattctcactgctatatagtgtattccactgctggaataattaaatatgtgtttctcaactgggggtgattttgccctttgagggacattgagcaatgtctggagatctttttctagttgttacaactcacagtaagggaagcgggtgttgctgctattatcctacaatgcacaggaccacaggacagccctccaacacaaagaattctcaggttcaagacatcaatagtgccaaggttgagaaaccctgctgtacatagcgttggatcgtgtgaatataccaccatttatttctctgtgtatttcttagagcctcaacttgagcattcatgagcataatgcagctcagccctggctttgaagttcttgaaaccatgcttaccaccatcagaataaaaagactatcaaacaggaggagttttaaatgtttacaataactgttagagtcaaaatacactgtcatgtatagccttggtcatagacaaaaattgtacattttggaactactacaagaatttgaagaggttttaagtgagaaagtgaaatgggctaagtcaaggttttcatcaaagaatgaaaagacttttcttagaaacagctttattgagaaataatttatatactataaaattcacccattttaactgtacagtttaaagattcctagaaaatttacagagttgtacaaccatgatcacactctaattttagaacattttcattacgctaaaaagatccctggtgcccattcgcagtcattcccattcctactccaagttccgagaagctaccagtctactttctgtctcctgatagtttccttttttggatgtttcttataaatggaatgataaaatatgtggtcttttgtgactggcttctttcacttagcataatgttttaagattcattcatgttgctgcaggtatcagtacttcatactttttatggctgaatacgattccattgtgtgggtataccacattttttatccattaacaggttgatggacatttgggttgcttacagtttggggctattatgaagaatggacatgaagaatttttgaagcgtggctagataaatggttagcacaagtaggcttttgaagaagggacatgattctgggccagatgacttattttgtttagaggaataatttgagtgattgaaaaaatagaatacgaagggaaaaggacaagaatggcacaagaagtattagacttacagggaaaggagatctctgacatttacccatacagaccctagtatttcaaaggcattgtatagccatgccggctaggctatagagcagcaaaggtctacagaggagcaaagggtaacatcccactctcttccccagtcttgcaggcacaaacgcagttggcatagccttgaggctgatttttccagatgaaccaggaagacccttggtttttggcagatttaataaccaacattcaaacaaggcactttaaaaaatctacaattcgagaggatttcctggcactatataaaaccccttccatcaatgggagttgttctcccttcttgaattggagtgttcattaagtccataaaatggaaagcacatgtaggataataacacagatattttgtgttagagaaaagttatgaagcatggcatcgaaagaggttagaaaaaaaaaattcactaaaaacaatcatgaaatggtaaagaaaattcccatcctcaacccatctgcatcaaatgaagatgctgctgacagtagatattaaaagagatgttgaacacataaggtccaggtggccacaatgctttccttttatcccttcctacatagatagatggaagggactcggcacaataaaaagaaggagcatgtagaaaaacatgggcgatttgagaccttccaaggcagagcaggccagtaaaggtgaagcagctggaagccttttttctccaccaggaaaggaggatagagagcaagggaggttttaagtgggagatgctgcgcgtgctttccccataaattctgagggcagtgcacagtattccaagttgtgtagcttctcacatgcaagctaggcccagaaccacttgagttcacaactatttctttctttttctttttcttttttttctttttttcttttcctttttcttttttcttttttttttttttgagacagagtcttggtttgtcccctaggcactggagtgcagtggcatgatctcagcttaccaccatctccctctcccgggttcaagcaattctcctgcctcagcctcctgagtagctgggactgcaggtgtgcaccacctcacccagtgaatttttgtatttttagtagagacggggtttcaccatgttcgccaggctggtcttgaactcctgacctcaggtgatccacccacctcaggtgatccgcccacctcagcctcccaaagtgttaggattacaggcgtgagccaccgtgcctggcccacagctatttcttgaaaatgagttcaacaatgtggaccttctgtgtgtgcaagggaatatgccttatattcatcctctattctatcacctgacaagaacgaaacagagttcaatggtctaaatttgcattcacgtgcagggctcctagaaatgatgatcctgcataattgttgtggaaatcatttgtcttctattggattcatgaaggcttaaacacatggtcaggggatcagactcactaatagctcttttatgtttcttccacttattgagataaaatctttttttttttttttgaaacaaggtttcactctgtcacccaggctggaatacagtggtgtgatgatggcttgctgcagcctcaacctcctaggttcaagtgatcctctggcctcagcctccagagtagttgggaccacaggtgcaaaccaccacacacacttggctaatttttaaaatttttgtggagatgggggtttcgctatgttgcccaagctggtcttgaactcctggcttcaagcgatcctcccaccttggcctcccaaaatgcttggattacagaagcgtgccaccacacctggcctcagatgaaatatcctgcatttactccatactagagaaaaatagagacgtgacatgtagcctgcatagcttttttgaattcttttacaatcactctgtaccagtacgtgttgtcaacaaaatgcagcaaaataaagagttgcatgataattttaatgcatgaccaatgaagattgaagccagcctgttgggttaatcctgttttgtttcaatcctagtctttcccctcaggagctaggtttttggctggactgactggataattgttgcaggaatctctttccatcttcatgtatgaaagcagtgatggggtatgtgattaaaccatgttagacaatatgattaggccatgccattattctttcacagttgcaaaggtaagctatatttctcaggctgtcatccccacagctaatgctttgtgtaagtcttcagggagcagctcacatgtgctgatgacaagttcagttcacagtgtgacttgtccaacacaggatgtctgccgtgtctttgaacgctatagattatttgctttgctggtttttgtgttttaaatacgtggaaccgtacaatgtgtactcttctgtgtttgtaagatgcatccttagtgttgtgcgtagctgtcctttgttcattctcattgccgtgtggtattccattgtgtaaagacatcacaatttatttacccagactaccactgatgggcagttgggtgtctcaatatttatagcaactgtgtgaggtaggtgctattattccatccattttgctgacggggagattgaagctacgagtggctttagaattgattacctcaagtcacacaggtcatttcgtggttgagccagaccttgagccaaggtagcccaggctccctaccctcacccttttatgcctcaatgtctgactgagctatttagtgaagcacttctttgatctgtctctgtctttcttttctccctctaaaggactgcctctgaaggaaaaatccaggtcaccaggctacacagggactcatctctacccctgggactaaagcttggctctcagatccagttttctgagcttagggtagggctatccccagtgaccccattcattcacctgccatgtctgaatccatgggaaatcctttgtaggctcaagctgagccccccacttcaaaagcatatttaaaagccaaattaaccccagagaggagagttgagcttgtctctgtgttggtatatttttggctttaactgttcaggctctactcttttcaagcagagtatgaggaaacctgaggactacatttttgttttgttttgcttttcctgtattagaatttttattttctgtatggagtcttctctttaatgtttgtaggaaaagaactgccaactcatattttatgttttttagaaaattgtcaggctgagtgcagtggctcatgcctgcaatcctggcacttacggaggacaaggcggcttgagcctgggagtttgagaccagcctgtgcaacatagcaagacctcatccttacaaaaaaataaaaacattagctgggcatgatgatgtatacctgcagtctcagctactcgggaagctggtggtgggaggatcgcttgagcctgggaggttgaggctacagtgagccacaattgtaccactgcactccagcttgagtgacagagtgagaccctgtctcaaaaaaaattttattttttcacaatgcatgtttctttctgttgtttccacagaaacattcaggtagaggctacagatttacatgaaaaggaaagatcagtttcctagccttgtgtcaggagcccatgtgaggccagttcttggcttctccttggctggaaataggagggtacaaatagggtcacctactctcaaattctgcggttcaaattgtggttggagatgagatgttctatttctgcatctctcctggaccatcttagagcagtgcaaagtttactggatcttccagtgcattattggcctttggtgtgatgacgagagagcaggaaggaggtctccagctccttttctgagttcagatgttccctagcccaagaagactaatcatgcacctggtttcctgctctgaaaaataagaagtgattttggcagcctttgaatctggatggaaggtggttttttttttttttcagtaacaaaggtagttgtgtatgtatgtacagagatagattaaaacaattttttttcctagaagcattttacaaaagttaagtgtgcaagctatcctgtcgaactttgtccttttttttctagacactcctttacactgtggaatctgtgagtagtgccagccaggaggagagtggcaactttccaaaaaaaaaaaaaaaaaaagaggcccttttacccattggttaatagagggggagggtgcagctatttaggaacatctgaatcctgtcattctggagtctggaatccccttctcttccccctccaaggtcttcgtatagctcacctcacacccagtacacacacccgctcctgggatactgtatcctattcagccacctcctagccagtggaccacctcataactaatgtcaaggttatgtgtaaaatctgaatgtgcttagatcttgataggaaaattatctaaactttgaaaaattgctatgtctacaatttcagaactggttgtcgactcatgagacgacacttactgttgtcccgtgatttaattgtttttaccaactaacaatttggaaccaaggcttttaaaccatcccttctgattaacgtcagagaagaggggcattcctttgaaaagaattcctaaacagaatttttataaatggagtacaaaatagcacgaggaacagtgagaaacatcttcaggattcccatggcctaggcatggaataaatgcaaggttagggcttattttctgagaaataaacccttagtaggatgctagataaaacacaggacatccagctaaatttgaacttcagacaaacaagaaatacttttttgatataagtatgtctcaaatattgcatggggcatcctatgtttttatttgttaaatctggtcattttaactaggtttgcaatatattttcagcacaatttcaacagttcatatttgctgagtactttgggcatgatggttagagtcagaggtgactttaggagctgcaggccttgtgtgtgtccctttcaccactatccccacagccccaagtacaatctttggcatatagttgagctcaataaatatattttgaaaaaattaatcaaaatgataaaataagtatggactatgactaactgatgatgcttatgacgtaggtgggaatacaggctcctatattaaaaaagttattgtggctaatactatcttattttggattttaactggttaatttgcttaatagactagcccacttggttgaaggattcaaattctaaatatacgaaaggttatttccatttcaaaaagtgatgcagaaagacaaatagcatgttctctcactcatatgtggattctaaagatgaccgcatagaaatagagagtagaatagtggttaccagaggctggtaacgatagaagggaagggaggatgaatacagttacataggaggaataagtcctggtgttccattgcacagtgaagtgcctatagtagctagaagagaggatgttgaatgttctcagcatgaagaaatgataagtgtttgaggtgatggaatgcttaccctgatttcatcattacacaaggtatacatgtatcgaaatatcaccttgtacttcatatatatgtacagttatgtctcaattaaaaatttaaaaaactcttaaaaagaaaaaagaatcaagagagaagaatacaaaaaatgatgattaagtggaaattaaaccatagttttatctggatttgatgtaattttttaaatgatttgatttagactgtgctattggacaatgccacctattttctttcatatacacttttattctaatgttctaatcaattaagtcctgtatatttaatattcatttctgtcagggttgaatttgatccaggagaaatggatgtgtactaactagtcaggtgtaactggaatcttactataaagtaaaaattattgtaggccttctaaggaatttataattcattaaaatacatataataacactaaaaagctaattaatatataatattctagttaaaaattaggcatatatgactatatgcaatagtgtggaaaacaattaggcatggaaattattgttagagtttattatttttcaaaagataatgataaaacacacctgtaaatttaatataattataaattcgtcaaatctcaggatggtaaaaccttaaatataccatttgtaactgacattatgtattctctttcttcttcagaggaaaaccctgaagaactatggaaatttcttttttattttatttatttatttatttatttatttatttattgagactaagtctcactctgtcacccaggctggagtgcagtggtgggatctctgctcacctcaagctccgccccccgggttcatgccgttctcctgcctcagcctccccagtagctgggactacaggcgcccgccaccacgcctggctaatttttttgtatttttagtagagacggggtttcactgtgttagccatggtctcgatctcctgacctcatgatcctcccgcctcggcctcccaaagtgctgggattacaggcgtgagccaccaaggccggcagaactatggaaatttctaagaaacaaaaacccaaacagtccttcttattcagacttctttgtaaaaccgaccaaaataactctctctttttcttaattgcttgaagtgatactcacattcagttccactagttgtctctaagcagtggtataaccagaataattggagtcccacctgaaagaaaagatggataaatttaactaccttaaaaaaaaaaactgtatggaaagcaactccataaacaagtcagaaacaacattattcacaaagttaaggaataaagaaccaggggtcagggccggggccagttgcggtggctcacgcctgtaatcccagcactttgggagtccaaggcgggtggattacctgaggtcgggagttggagatcagcctgaccaacatggagaaaccccgtccccactaaaaatacaaaattagccgggcatggtggcacatgcctgcaatcctagctactcgggaggctgaggcaggagaattgcttgaaactgggaggcagaggttgtggtgagccgagatcatgccactgcaccccagcctaggcaacacgagcaaaactccatctcaaaaaaaaaaaaaaacaaaaaaaacccacaaagaacttgtggcctgggggacaggcgcagtggcccaggcctgtaatcccagcactttgggaggccgaggcaggtggatcacctgaagtcaggagttcgagaccagcctaacatggtgaaaccccgtctctactaaatacaaaaaattagccaggcgtggtggcgcatgcctataatcccagctacttgggaggctgaggcaggagaatcgcttgaacctgggaggtggaggtttgcggtgagccgagatcgtgccattgcactccagcctgggcaacaagagcgaaaccttgtctcaaaaaaaaaaaaaaagaaaaaaaaaaagaactgggaaaattacataatatcttcagggctcctgcaaattataagaaaagaccaataatggaatagaacaaggggtaaagagtatgaatgagagtccaaaaaagaaaaaggaaaaaatacaaacagtcgtagacataataaaaggtgtaaggtgtacaatatagcttataatagaaatttaaactaaaatcacattgaaataccattgttcattcatcagattggtagaaatccaaaagtcttgatatactctgtggcaatgctgttgggaactgaaactcccatccatcgctggtaggagtatagattggtgtaatattctataatggacaatttagttatatctattgatatgacagatgttcatactgattgacctagtaatccacgtctagcaattaatcccacagatatattttcacatgcaaaaaattaagtataaggttattaattattgcaatgtttgtaataataaaagactggaaatcatccaagtattcatcaaaaaagagctagttaaatatatattcatacaccggaacattatgcaagggtaaaatgaatgagaaaaccctctgtactgatgtggaaagatttgccaagacagatctgaaaaaggtgtgtaatagtgtggaaaggaggattaagcaaataaatgcctattttaaaatttatgcataaaaaactgacagagcatgtaaggaacgaatagaaatgaccatctacttttagaagtgaggaggagggaggctagagagatgggggcggaggcagaagtggcagcatggcttctgcatacctgcttgtgtatatatcttttcagtttttgagccatgtggatgtgacttatgcaataattaaataattaagaagaatatagcatgagctaggtccagaagccagagagaacagggatatctgggggaatttcaggggttagattgataggtgtgcagaatgtgaaggtggagtggtaagagatgagatgaaaagacccattttaattatcattaaaaacaactatttttctttttctaacatttattgagagcttaactaagagccagaccctgtgcttttatgtacatttcctcatttaatcctcataacagttcagtaaggctgcagctgttattacaatcattttataagtgaaggaacagagaggttaagtaatttacttaagggcatacagcagttggccactggtggaatcagtatgcacaacccatcatgaccctgtgttcatgctcttaacttttgtaccattctgcttgttcaagggaacatacatccaactgagggaggtggggtgaggggcaagagtttctatctttctacacagtgaattttattaattctgtagagctcatcttacagtactaccaagtatggctgcccccaaatctgtgactcagccaagattatttttaaatatttcccattcttatgacctatccaccactttggcacctatcctcttccaagactatctcagcatctggctcgctacctttgaccataacaaacatttgaataacaaaccaagtttatgaagtatcatgggcatgacaaattagtttaagaaacattcattcagtaaattttgaacccccatagtattccaggcatacagattcaaagataaacgtgagcaaagcagcctctctggtgttcccatctggtgaagaaggccgacatgtcagcaaaaatccatatttaacctacgttctcttatattggttagtgttacctagatttgcctaagcattaaaatcacttgagacacttaaaaaaaaaaaaaggcaacaacataaaaaccctagtttcttgggccctaccgccgaccacttgaatgagaatttcctggggatggtcctgggaatgtgtatttttaacaagtgcccatgagagtcttaaattaggtaagtttgggaaatgagatatcagtagaaacaggatactgtggggtcagaggaggaagttgctcagtctgtctgtaggtgggaagattagccaaagcctcacagcaatgtttaggccacaccttaatgagtgagtaagcacccaaggagaaaggactttccaagcaaggagaattttaaaaattagccaggtatggtcggtgcacacctgtagtcacagctacttggaaggctgaggtgggaagatcacttgagttcagtgagccatgaacatgccactgcactgcagcctgtgtgacagagtaagcaagaccctgtctctaaaaaaaataaaattaaagggaattttactctactggcaaagaagagaatggcttcatggaagagagggagtccagttcaaaggctgtcaggaagacttctgggagcaattagctaactaacagtgatggaatggcgtttagctgaaatttgcaagacttgatagattaatttttttaatgaaggagacaagcaataggatggctcctagcttacaaaatggggagaagtgtgggtcatcgctagtggtgaggaatatgggaaaaggagcaaagggtgatgataggaagatgaattccatcttgatcctgctgagtttcagtggctctggggggaatcatacctactaggcatttggatatctgaagatagagatttgggagcccgcagcatatggatggtagacaaagccttggaagcaggtacaaatcactgaggggtgtagggaggaagagtagaagagtgctgaaggcagagctatggatccctgaccctaaagagagatggaggaagagaggaatatggcaaggagtctatggaagagcgatgagaagacagaaaagctctgagagagaacattatcttggaagctgaagagagagttttccagaaaaagagtggtcaatgggaagaaatggaagagagatgctgttttagagattattggctgcttgttgtttctgcttctaatgccttggtttgccaaatccagtccagattctacatgaatctccagttaaatggtcaaccatataactgacaggttgtctgattttatacagcttaaattcctaagagaatctaatgggttcatcctgtgtgttgatttcacttgggtcaacctagtgcaataagccattttatagggagggtagcccgcgaggttgagtctgtagctgtggctgagcagatcactgagtgtgcaggggaaagaggataaacactgaagatcttgccaataatcatcataacaacccccaatgttgattaggcactgttttaaacaccttacacgtggtaattcatttaatctgtttgaatataatggtgagcatggaagtcatattacagtgaattgagtcctctactactaataatgacagtaagtctctagaaaggcgttaatctgactcttccaaaaatgccctttgctttgctctcccttaaaagggcagaatccttccctgggtccacttttgatgactgggtgggagactgtgccttctgatcaagtttcctgagttcttttaatggaatcatcagaatatcacacataaaatgaggccttgagccaggctggcatggccacactgaagtcctgtgattctgtttacctgagagcatgatgagtttattggtctttcttagccttaggaatctgcctttccagtgcatggtgtttagacagagtagcagctgaatgaattttgaatttaattgttccccagcagagagtgaacaacctttgcatatgccagctttttgtgtagacttttcagaatggtgatttcaggtcatttccaaccgaaggactctttcagttcataataacacatattttaattagctatctttggattgttcatatttgtggaggaagaagcagtggaataacctacttgagaatgtgctcagagcatgtggctcgtttgacatacaaaagcactgtattaaataagtgtccagttcggtcgtttatttagatttagttgataacttggatttcagcactaactgaaatgcattggttcacattagcttaatcaattctcatagaatatggagagctcaccagaactataattacaacagcacataattatttgatgctgatttcaaaggatattttacaaatgcatttgtgaatggtagttcgttcttttaaacgtttggactgctttggctttttctgtggtggggcctagaagaagacaggtcacagcaggtctcacttgaagaaatctttaacacagaacataaaagtgactgtaactaaagtttggaacatgtcattttactgagtactgacactagaggagtttgtttaaggatattcacatcagttaacaaatcaacgaaacgtttattaaacttctgttactcattcaacaaatatgtaatgaatacctactataagtccaagtattccacatcatctcttttcatccttgcaaacattagcaggaactataatcccacaattttatgagatgtagagaggtcaggcttagcttgctcaaggttctagtggaggcagaatttgaactgcttccaaactgtccaacattaaaatctatattacttcctcttagctggatcttatcaggaaatcaaagctgtataagctatggccccttctgtgtggggttgacaatgacatctaaaacatcagacttaagtctataaatctagaaaacataaggcataagtctacaccacccaggcaaagtgccacaggatctcatagctacaggagtttaggaaagaagcatcaaggaaggcagccagcacccatggggtttgtgctgcttggagaacaggtggtatgtggatagttgagggcatggagagatgattccagtgggaagagctgaatgagaaaaggtgcaaaaccagaatgaccaagctgtgtccaggaaatcataaacagacctgctgctgagaacaaaagttctgttatctgagagtagaaaatatggctgaaaggtaaatggaaccggcttagcggagggccttaagttccaagctaaggattaggactttgttctgtggtttataggaagtgattacaagttttggatataaaagtaacatgatttaagggtgttttagaaaattaacctgattgtcaactggaaaaagaggtgatagagctggaaatcagtaaaggggctctgggccaggcagggaaatgatgtgatggctgctttacaaccttgaggaaactcagaaggagtagggttcatgggggactgtgttcaggaacaggtccaaaaagttaggccaggccaagggggatatttacgcacagcaatggagggcagggtagctagaaggaaagcatagtcacaaagagaggcaaaggccagggctggagaatcagttcatagcatcaggagggtctaaggagtgaaatgcaacgatgtcttagtccatgcaggctgctatcacaaaataccataccctggtggcttataaaaaacaaagttatttcttgcaggtctggaggctgagaagtccaagagcaaggaacttacagattcagtgtctggtgagggctgccttcttgctataagctcacatggaggaaaaacggccaggtggctctgtggggcctcttcataagagcactaattccattcatcagggctcctccctcatgatctaattacctgccaaaggcccaacccaatcctatcacattaggcattatgtttttcacaagcgaatataaagggcaaagggaacaaaaaataattagaccatagcagcctgtacataaaaaatgagcaggttagggggcaaaaggcaaggggaggacccgcaacaagttctgctacagaatgtgacacaaactgaggcacccgggtcaggaccaaggctgaacatcatttggcagccagcttactgcctactgtgggataagcctgaaggttgaagtggaagtcacaggaaccaagacatgaagggtctaagtcagaatgctgacagtggaaattgcaagaaagttcttatgtgatagagatcatgaagaaagactcaacaggatgtgcggatacataattagatcaatgatacataattagagaggaaggagagcagtaggtcctataagccctcgtcgtcattttaaaagcaagccatgttccaagggtaaatttggaaactagttatttgggctttggaaaagttttatcacaaagagcccttttccataaggagatgctttttaaaaatatcagtctcacaggtcaggagtattgctacacccaggatagccatgaaatctaaacttcccctggcctcactgtctttccacctgctatctccatccaaatctggcttcacgtgatggcttttgggtccagatgtgaagatctgtgagcatctatgggtgtggaaacccctctcctgaggtcctggggaatagctccacatgcatatacactcccaacttcagctatgaaattctctatcttgggtccattcgagggcaggatgcaatttcaggattatttggtccaaaaatatttgctcttttaccctgcaatattctctgtctaattgcttctgttccattgtcctgtttcaaaaaacatagctcttttgagtatttgcccttctgtggagtttcaaacctccttctttctcctcttttctatttcctgggctctctctatatggaaaattaaaggctatgtatgttataataggaggcttgaggacatacaaagggctgaatgaaaattaatctcacctccactttggagagacaaaagggactcagaagagaacactgctaggtctcactggctttctctcaaaacagaatctcacttgtgatatttttaaatgttgtccataaatatcatagatatgcctatacttgttgtatgcacacccagctgctctaccagtgtcttgtccattaatttttctgttttttctgctttatttcatgatatgcttatgaaaggatttctcatataactccaagcaattttaacccttaaattaaaagtaaaataataaagttagctattttaagaaatgtgatcacgaaggataaagaatccagcaatgcagaaactgaagtgattatgaaatgtttaggttttcgtgattttgtttgttgctaaatcttactaaaatgcacttttttaaacaattagactttttatttttttagaagttttggatttacagaaaagttgagaagatggtgcaaggagttcccatggaccctgacacctagtttactctattagtaactttcacattagtgtggtacaatgaatgaaccaaatatacattgtcgttaactgaagtccgtactttctttagatttccttaattttcacctaacatttttctgttcaaggatcctatcccatgttacatttagttttgtctccttaggttcctcttggcagtgacaatttctcagcctttccttggttttgatgaccttgacagttttgaggagtacaggtcagacactttgtagaatgcccttcttggagtttgtgtggtgttttctggtgattagaataggcaaaaaacgaacatggttatggcaaataggaagatcaggcaggctcagggctccagtcaccctagtgtgcgtcctggccgattggcaactcctagcaactgtctcagagcaaggggcaacgaggggtcggggcttccaccctggcacctgggttcactcgatcctgcattgtacccactgcggaagggtgaagttccaactcagccagacacagacccctgacctggagggcaccaaggagggtgccaaggagaggtggctcacctgtgctctgggagtgaggagctgtcgtcagggtgtgtccaaggttgattacatagaattgtaccagctggagactggagccagaggaagagctgcctcaagcaatttcactaagaggcggcagtccaaggaaaataaggcagattccagagcatatgaggagaaccaagatggaaagcacagaacatatgattatgattccaagtgaaagatgcagccaaagctctcctgtgtcataaacctgttccttcctgcaggatatctgaaaaagccagggctgggtggtttatcatccaatggaaactccacagtctcttctcttccagataatgccttgtttgtaaccactgcacagacctctggattgacatctaacatatgtggtagacagaggaccagaagtatacaagacctgtaacagcatgcacagtcccatgaggagaggggcttctttatttttcttggcaaacatctgaatgatgcttgcaaactgtctgaatttgccctctagggttttccaacaatttgcatgtttttcagatgttttgggaaaaaattaaatactgtaaaaagtcatgcggaatttttttaaaaagatgccgtaagtatgacctccatctgtttttttctttgtcatcgttgttgcaatgttttcatactattcaaattcttatctctttgacattagtctgtggtttatttcctactagtggcttcgaaaagtcaaatcaacttggttgtatgtatgttttccccttaaagtgttttctcgttcacagcattaacctatgcaacataaccttctgtagcaggaattgaagaaaatgataatttttggttttaaagaaattctactatagctttttttttggtctgatcacaattttaattcataaatttcagatttgggtaatttttgtgttgcccagtaactttgacaaatgatttaatttgctcttttcaggagtttctcaaatcatttctctcaattttcacaactgatattttgtcactgtctacctgatatggttatttcccttataactcaagagtagtttaacacaaagtataatcctatagtgttggaggcttccgagaggcattgtttgcatgataagtaaatgcatattgtgaaactgtgttcctgggattggatttagcatgatctattgttggctccctttattcacaatctctctttacacaaaatacttacgaacgatattttccttagtgttaaatcccttttaaaacatgttatctcatggaggtgcacatctgtagtcatagctactggggaagctgaggcaggacgattgcttgagcccaagagttcaagtccagcttgggcaacatagcaagacctcgtttctaaaaaataatcaaaaacaacaataaaacccctatgttatgaaattttaatttagtgacacttattcagttaagactttcctatctaccaataaccatagtattggaattgaaccttaaatgtccagtgggtggtgactgcatcaaagttgaatgaaacagccttcttgctgttcagctgtttagataacttatgaatattgttagggcagctttctctgagaggttgccatttgtcatatcaatttccaaaagctgttataccttcatggacatttattctccgaatgatatttaagtgccaacacaaattaccacatgatcaagtgaaatggactatactttaaagattatcagtgtagagctcactgcatttcattatatattttaaagggattcattgccttaaatatttgctctcaagatgtcaaggttaacatatatatttttttgcagtcaaagtttccctctgttacccaggccggagtgcaatggtgcattcatggctcactgcagcctcctgggctcgaggggtccttttacctcagcctctccagttgctgggattataggcatgagttgccatccctggctaatagtattttcttatttgttcacttgatttggttattgttctgttggttgtaacttgttttacaggactcacttgtgtccacacatctgtgatccctttgaaccttaagaatcaaaccattgtctgggagcggtggctcacgcctgtaatcctagcactttgggaggctgaggcgggccaatcacgaggtcaagagagtgagaccatcctggccaacatggtgaaaccccacctctactaaaaatacaaaaattagctgggcgtggtggtgtgcgcctgtaatcccagatactcgggaggctgaggcgggagaatcacttgaacccgggacgcagaggtttcagtgagtcgagatcatgccactaaaaaaaaaaaaaaaagaatcaaactattttggcctctccattttctggttgagaaattctttatattttaaatatatatttatttccaaatttaatattgaaaactagaatatagagaagagaaggaaaatagttacctaaaatgacctaaccttcaagatgattattatcactattagcatttttccatgattttcagacttttttctatatagccttatacatataaatacatatattttaacgagattaatgttaactcactctgtaagctgttttcttacctattaatcatatggatgtgccataatctagttaattgatggacatttttattgtttctgatttcactattttagataatattgctatgaacatccttggataatgattcatttttctgtattataatgttgagatcatttgagaatcagagaaactggcagagaaaattatagtgagtcattttatgttcgcaacaaaacttgcataatttcaattccatgagagaatgtggaatgaactaaaatggaaaattttcttttaaagaatgagctttttgtctgggtgtagtggttcatgcctgtaatcccagcactttgggatgttgaggcaggagaatcacttgagtctaggagttctagaccagcccaggtaatgtggcagttgctctacattacaaaagaatacaaaaattggccagccacagtggcttgtgcctgtagtcccagctactgaggaggctgtgatgggaggatcgcttgagccggagacgtggaggcggcagtgagccaggatcacaccactgcactgcagcctgggtgacagagtgagaccctgtctcaaaaaaaaaaaaaaagaaaaaagaatgaattttatatttttgaaattttaaaacacgttagaaaaacaactatcagaaccatagatgtctacactaaaagtagaaaagttaattataactacataagaattctagaaatagtttcaaactaccaaaagatatccaaagtagaagggaaataaattataatatatttgagattgctggatgtaatgatggaaaagaaataaaatcgatccatgtaagcacataataaattataataatttcatattttaaaaattggtacagtttaattgtatcgaggtagctagaagtttgaagagtatttttggcccaggtatgtatgattaatgatcaaatggaagacaccaacaacaggaatatttctgtatattcataaaatactctttaatatgatataatagatataatgtgatatataataaagtacataccaaaaggggagcaagtgaacaaaaagtatatattattatataattagtaaaaatgttatgatacaaagcatagaaaaaagaagcaccaaaatatgtttttatttatataataattttctttcttttttcttttttctttctttcttcctttcttcctttctcttttttctttctttctttcttttttccttccttccttccttccttccttcctttctttctttctttctttctttctttctttctttctttctttctttctttctttctctttctttctctctctctctctctctctctctctctttctttcagacaaggtctcactccattgccaagactggagttcagtagtatgataagggctcactgcacccttgacctcctgggctcaagcaatctcctcccacctcagttccctgcatagctgggactataggcacgtgccaccacacccagctaatttttaaatttttttctagagatagtatctcactacgttccccaggctggttcctatctcctggactcaagcgattctctcaccttgacctcttaaagtgctgggattataggcatgagtcaccgcacccagcccaaaacatagttttaaaaagtggatgagatcattgtccagattgtagttaattaatatcaaagaggcaaacacacgaatggcctaagtaacttattacacagaaaaaggcatattcttaccaaaataagtacaaatcaacctgggggaaaaaacagtaaaaatacaaacacaaaaaagtcattgaatatttagaagtgggtatatcgtggtagcctggtaacttggttttgtcacttggaaaatgaactggcagtatacaatgagacctacaaaatagtttataagttttgatactcaataatttcactttgggttgtatattcaaaagaactaatcggaaaggaataaatatataattgtgaaacatttgaagctactcatgttaagtaatgaagatgaagtgagaatgatttttaaattgtttacattatagtgtagtatgaaaagccttattatatattatctccttcaatcctcagggaggaagctgtgacaaagagctcacataactgggactggaaactaggagtcctgtctatgcagaaataagacccagacttaaacctggctacatcctgtgtcttctggctgtgggacttcagcccccttcccaatatctctgagcagtagttttcagatctgtaaatggatcacaatgctcagtctctatggctcccaggttttgagcaataaatgagataatgcacgtggaagtggagctcctaccatgggcctgatagggcaatcactggggttgcaactttctgaaaatgggtctttaaatgaatcttcaaactgcacactgaggagcgggaagatttggaacacgtttaatcagcaagggagcaatgaaagcagagaccagtggcaatgagggccaagttaaaacagggcggagtggagttgtaaagagagaagtaaagtggatttgtttgcactgcctgggaaggagtagggtacagaggggattcaagggcacgtgcttgttttttttaattgagacattatgaacatctcagaacaaaagctttgggctttggtaagctccaccagacacctggtttagggctttttcattccccaagactcctcctcccttccatgacactcctccctgggacacatgcttggatttggctctggaaatgccccgccccaccatgaaaccatctagtcttttccccaggttacttctcttgtagtcacgcaaaatcaaggctgaggctccctgtcacgaccctcggcacttcacctgagttctaggagccactttggcagtcctctttctgtgccaccaatgggagtgaggggtgagcctggcagagacacacatgccaccctgggctttgtgacaaggcctggactctaatgggtcaaacccagggcaaaggccatcctccatctaggtaacgaagtgttcatgactctgtgacagccaggacaagggcagtaagtttgcagtagaatgacactgcaaattggtgaaccttagtgtagggtacgtcccagccgggctttaatacagagcagcaataatgacaacaacattgcgtgtgtgtgtgtgtgtgtgtgtgtgtgtgtgtgtgtgtgtgtaaaactggtgcagtcctatccattgtctgattcgatcatgagtgccacatcctccccagacttgggttagagtagacccagatccccagaacccttttaaacctgggtgatttagaattcaaactaccatcacttctccagactagattaaatgccacctggactgatcagatccaacatcctaccatgagtctggtattttctttgctattttatctagataattcttatttaatcctttcagcaatcctaggaaaaaaatattcttatccccattttacagagaaagataaggaggttcagagatgttaataacttgctccaggtcacagagcaaatcagccgtgaagcaggtttcaaatccaggtctgcttgactccaaaatcgatactcatgctactccgatgcatgctacagagagtttttctgggccagtagtgggaagaaggtagagatttttgcaaaattgtcttagggacccagtatagaagtatgccactaactttggggtttctggaccacttcctgataaggggcagagttagatgggatgccgaggatgtctgtgtgttctctatgtacacacagcaagacagacattttttcctttaacatgtgttttgctttctatagagagaatcctttttctgacagtcactttctttccaaagcttagaacatcataggctctttggcagagagtacagctttcaacaagaaaaagaaaagtttttggccactctgcccccttgcagttcaagtataattcaaaatatctgcttctatttgtttgccttttgcaaaacctcaagggtgattttgaaataaataggaataaaatatttgactgaaccaaaagagcccagtacctggccatccgaaagtatttatttatttgtttaaacattgctggagtaatagaaaatttaaatgcagttatcaaagaccaaaagttcagagattaaatactatgttagagtcattccttctaattaattttgaactgttttcgaaaaacgaagaacttgctggggagacaatgatcaagatcgtaacaaagttcccctagaagattaacagagcttggagtttactgtggatctctgcctgtgtggagaagaaacagtcaaactagaggaaacaaaactgtctctatagacaaattaaattttagtggatgttcatgtgcacaggtgggcagcagcaccttagtctagtatgttgggattgggatcagagtctttttccataaatgcagcagcattgagcaatataattccatctaaaatcttattgtatattttctcatctgcttacttttttttgtttgtttgtttgtttttgagacaaagtctcgctcttttgcccaggatggagtgcagtcacacagtcttggctcactgcaacctccgcttcctgggttcaagtgattctcctgcctcagcctctcaagtagctgggattacaggcatgcgccaccctgcacagctaatttttgtatttttagtagagacagggttttaccgtatcagctaggctgatctcaaactcctgacctcaagtgatccacccacctcagcttctcaaagtgctgggattacaggcgagaaccaccacacacagcctcgtttgcttacttttcaaaacagctctgtgtttgtgtgcgtgtacatggtaaaatttacaacgaaatacacatttagaatacattcagtgagttctaataaatgtatacacgtgagtgcctcaaacccttatcaagacataaagcattgccatcaccccagaagcaacggctgttctgaattagtgcattagttttctgtattttgggacttcatacaaatagaatcatatataatgtgtagtttttttggataaggcttctttgactcagcctaatgttttccattcattatcatccatattccgtgtattaatagtccattccttttgattattgaatagtataaccattatataagtattctacactttgagttgggttattttctattttcctattgatggacacttggctgtttccagttttgagtcaaataaagttgctaagaacattctagtgcaagtctttttgtggacacattttatttctcttgaatagatatctatcaatggaattgctgagtcatggggaaggtaaatgtaaatgtcagggttttttttcccaggatgattgccccacttcatacctccaccatcaaaatatgagagcacatgtttgctgccattagatattatcagtgacctctcattttagttttaatttgcattcttctggatgactaatgacattaagcacttcatggttctttactggccttgtgtatgtcttcctttgtaaagtgactgttcaaatctttttccattttaaaatattgggttttctttcttttttccttatttttttttttgagatggagtctcgctctgtcgcccaggctggagcgtagtggcatgatctcgggtcactgcaacctccgcctcccgggttcaagcgattcttctgcctcagcctcccgagtagctgggattacaggcaagtgccaccacgcccagctaatttttgtatttttagtagtgatggggtttcaccatattggccaggctactcttgaactcctgacctcatgatctgcccgcctcggcctcccagagtgctgggattacaggtgtgagccgccgcgtctggccaggttgtctttttattactgagttgccagtgtgctttacgtttcttcacatggtatatatatatatatatatatatatgtgtgtgtgtgtgtgtgtgtgtgtgtgtgtgtatatatataccctctccctcagagagtggagccccagttacctcatctttttgtctgtctttctccccagaatgatgccagggattcttctttgtttggtactatatttccagtgcttcagattgccactggcactgagtaggagctcaataaacatttgctgaaagaatcaatgaataatcaagtaaactgatttttgggtctgatattcagacacaatgttcttgaacttaatggcattaattaacaaggaaattgaaaaaaaggacatttaaatgctatccttgaggtatcacatatgcttggcaccaaggacacagaataccttcaggggactggacatggtggcttctgcctgtaatcctagtactttggaaggctgaggtgggagtatcacttgggcccaggagttggagatcagcctgggcaacaaggtgagaccctatctgtacaaaaaaaaaaaaaaaattaaccaggtatgatggtgtgcacctgtagtcccagctacttctagggctggggtgggaggatagctggatcctgggagttcaaggctgcagtgaggcctgattgaaccactgaactgcagtcggggtgacagagtaagtccctgtctcaaacaacaacaacaacaacaaagcccaaaacagaataccttcaggggatttgttcacccaggggagatactgctagactatctcatggagtggcctaatttgtccccatttatgagccctctagtgtaagccatcactgctgtctcatctaccgcattctgggactatgcccagccacttccaagtcttggattccgaccagatttgcttaatggatgagcagaacgtctagctttagagagttttaggtaacttcacccagctgatcccactgtgcctttaaccaccttcctcttggccccttctgacactgataatgcctgttccctaaccattggcccctctgcctggctctgtctcactagcaggcccatccccactctgtgctctgcctttcttaacacccctaaagggccacgcaggaaaggatgggacaagttgattatgacatccctttctagctctaaggaattcaataattctgatattcatccctaaagaaatttatcagcagctattaattgggctttcctaatttgacactgaaaggccggtagggtcccctaagtcttgaagccattttcctggtcccgaatccagcagattccagcctatctggtttggggggtgtctacagtgaatcatctgtattcacatttatagagaactttgccatttgcatgttcatatctgtcatcttatgtaaactgccaaacagttctagttgtagccctctttagtttctattttcccgaagtttctatttcccaaagcaaaaagaggtgagttttcatttcttttttttctttttttttttttttttttttttgagacagggtctcgctctgttgcccaggctggagtacagtggtgcaatcatggctcactgcagccttggcctcctgggttcaagtgatcctcccacctcagcctctccagtagctgggactacaggcatatgccaccatgcctggctaatatgtttttatttttcgtagagatgaggtctcactatgttgcccaggctgatctcaaactcctgagcttaagcaatcctcccgccttgacctcccaaagtgctgggattacaaaccactgctcctggcagagttttcaaaaatcctctagctcttgctaaaaaaagttggtgctttcttagctctggtgggtatgcaagtgtaatatttaaaaggctcatagatttttacagttcagaaacctggattctgtctgtcattagaaattcaattacacaccgcagacatctatgagtagttcctaaccttttaatttaaccattattatggattttttcccccttggatcacatgttattttcttttaagtccaccaaaaactgtatttattggctcactttaccttttttattcatcagacttgtacctcccagtcagagtttagaatcaggatcagatagtctcttacctcactaagctgattttattacagccaaaataaagacatttgatatttaattagcttccaaacctaataactagtacatttccatttctgctgggctttttgaaagattaaaaagttcatacattaacccttgagaaagtggaaacagtttagttcttgtgaagaagtagccctgtgtgttcagggacttcactcttgccgtgtctctgatgtctgaatgggagcaacggggatattactgactttaacccttttcactgcgatctgggcctttctctggctctatagggactggggatcaaccacccccaccctagtatttcctcagctactggagtatttgggttctcagttcaagcctataggacttggggagaacatgcattcactgaaacgatgacattcctctaaggtgcaaatgttaaaaggtcatgcaaccagaactattacataaaatcaaaaattttccagtttgaattatactctcaaaggaccatgatgagtattctaaaggcagtgtttgtttctaaattaatagaattaataaatgttattctgtttgccaattatagaagatacagttgttgaagactattaatgtaatatgcaattgcattataattgtattatttaacagattgtgttgcatgaatcaatgagatatgatgctgtaatttaaaaataattattttatggaagcaaaactgcttatgaataacattaagtgaatgcagaatgaataacttaggtatgtagactcacagctaagaaaaatatatatacatgtagctaatggctcagggtaatctgcagaaatgaaaaaaactatattagaatggacaaaggtgagtctctttcaaaatattttttatataagttgttacatgtatcagtttcgcaattaaaagtttaagatggatttatattggctccagtgaagaatatgtgttttattaattaatactgtgcttggttttgtcttattttataggagaaccagcagaaatccaccaatgtagtctatcaggcccaccatgtgagcaggaataagagagggcaagtggttggaacaaggggtgggttccgaggatgtaccgtgtggctaacaggtatgtcatgttcatatatatatatatatatacaaattgcaaactgacatgtgacacaattttatggaaattagtgtaacgtattacatgcttgttttatcattagaaggaggctgggagatgtagtagaaagcctgggtgttagtcctaaccctaccatcagtgagaaatagagtcaaggtcaactacagaaataagagtctgatcaagtcaactgtgaaagtctctagttgtcacttttctcctctttggcaggaaaggacgggacaagatgattatgacatcccctttcagtgctaagggattcaataattctcatgttcatccctaaacatatttactggcagttatgaatgaggctttcctaatttgacatcaagcatttggctgtccataaggttttggatatttagagatattcgttattgttgcctaatgttttgacattctaggagactatttcacttactatataaacaacaaacaaacataagaatctgtacaagaaggaaaactagcaatttccatttggctgaggattgcccttgtttacagaaataacttgctgctgctgaagtgactgaatgactctcccttttcttgtgtttttatagccacagaatgtcaaaactgagaattagtgacagaactggaattagaacctgactcccaatagctggccctaggctgttaccttgtactctgagtccaaggtagacaaaattatttctggactcaaaaggaaaaaccaagttcatttcatagacaacagttttcaaatggaatgagcccacctgcaaaactatgtttattcaggttataaaatgataatgttttctaacctggagctcattctaaacaatctggcaggtggggacctgccttgcatcttttcttgctgtcctaaatctttgcccttttctgtcccaactggcctcattcttgtactcttcaagtttttgccttgtgcctttggtttcctggtttcattcatgcctggactgtgcatcgaaacaactttctgcagcctccagtgcaaggacagacagtgagcaaggaacctgctgtgctctaatatgcaccatccttctgtcattactcctgaaatgtttacctcaactccccccaagagacgtaatttgagcagtaggtacagctgtattctagaagatcccctcctgttatatgtttcccttcatgcgaagatcactggtgaaaacaactttcgtgttgggctatacacacaaagtccattttctctaatgtgacaccccttgaaaagaaaaagagaattggtagaagagaaacatatctaaagggtatactttctccttctttactcttaaaatgaattatttcttcattagaggaagaaaagaatatatggcaaattttaaaaaatcaaggccgggcttggtagctcttgcctataatcccagcactttgggaggccaagacaggtggatcacctgacatcaggagttcaagaccagcctggccaacacagcgaaaccctgtctctctactaagaagacaaaaattagccaggcgtggtggtgcacgcctgtaatcccagctgctcgggaagctgaggcaggagaatcacttgaacataggaggcagaagttgcagggagctgagatccgccactgcactccagcctgggtgacagaatgagactccatctcaaaaaataaaaataaaaaattaaattaaattaaaaagtcatctttttctaatttattttttattcttatgttacaaaggtaggctgttgaccaggcagaccagaagaaacaaaatactttaaatccatagactcagattttagccccaactccacctccatgagctgtgtgactttggacaagccagttaggctctctaagcctcagttttcttatttgtacaatgggaataaagatagtacctgacttatggaggtgtcgatagaactaaatcaataaaagacaaatgtgctttgcacagtgcctggcacatagttaagttgtcagtaattgtaattagtgttacctcaatgtatgaaagtacgtgtgccaacaatctggttacatatacttactgtaatttagctctttgtttcctgagagctgaagcaaaatggaaggacattctgttatttctctcattttctgacatgagagaacacaccagagattcaggagtgccacttcccctaccccacaacctgacataaatactaagaagaatttatcacctatgtctttatttaaatgaaaaggaataacagaattacagacaataccttcaaaaatgatttgatgaagttagtgttgacacgttcttcatacagccatttcttctaatggtcctctgtcaaagccaaaggcatgactttaaaatataactaaaagtatggagactattcaccttttgcagatcaccttcccccccacccaaatcctccttcctctgtctgtccttcattcctgctttttctgccctttttcctctttcctcctgttgtcttctctgtatgaacctcttggcttttttcctctgtcatgccaaggtgctgtcggacagaggcttggcaccatgaaatattcttaggttcagagatctttaagacaaagatcctaaaatcctaaaggacccatttttttttttagagtgctagcctttagggtagttcagatttaaactgttaaataattttggcaggttgtgtttctttcccttcttatgttcctcctcatatggaaattacaaagtgtgttcctgatcattgtgctttgaaaccatggtggaagccacatggtaactcttttctcatataaagactctagagaatctttacacctaagagtgtgacatatggcagctctaaatacatctgctccctagctcaggccggcttcctgtctttatgttttgagagtcattttggaaacatctagaagccaaaggacagcctgcgggctctgtaagacggttgttcagtggcatccacgagggaggtggacttaccagtctccaggggctggctgtttccctccattccagctgattgctgactttgaaggggatatgagaccactgtcaccacatcttttgattttttcaagagaatacagaatctggatttgtatacacaacttcctttttgctttggagacaaggcctcgctctgttacacaggttggagtgtagtggtgccatcacggctcactgcatgcagccttgacttcccaggctcaaggggtcttcctacctcagcctcctgagtagctgggaccacaggagtgcaccaccacacccggctaattttttttgttttttgtagatgcagggcctcactatgttccccaggctagtttcgaactcctgggctcaagtgatcctcccaccttggcctcccaaaatgctgggattacaggcatgagccaccaccatgcccagcctgtatgacaactttctaatctttaaaacactctgcagcccaaacagaacacatcgaggaccacatgtagcccccaaatctccctatttatgaagcctgcttgctttgaaaagctataatcctaacacaggacaaatagttatttcaaaatttgagagaaatgtaagtacttgccttgtagtcaactacactgatttctttctttcttttttttttttttaagatttagttatatttaaaattactagattagttcacaatttgtcatcttaaactatccaggccgatgtcagtctgttttatctgttctgaacaggtctctctggtgctggaaaaacaacgataagttttgccctggaggagtaccttgtctcccatgccatcccttgttactccctggatggggacaatgtccgtcatggccttaacagaaatctcggattctctcctggggacagagaggaaaatatccgccggattgctgaggtggctaagctgtttgctgatgctggtctggtctgcattaccagctttatttctccattcgcaaaggtaaaaaaaaaaaaaaaaaaaaaaggcactacacacgattcccacacacagtgcaagtgctctccaactgctaggggaaggaatcggagagggagggcataagaatgtctcctttcaatttcccgactatttcttcccccaataacaggctctctcatttcctctatttaatattggttatataaaggagttccttcctttccagatgccagggcaccagtagacataaacccttccatgttcacaattataaggaacatttggtgagagtcgaagggaagagaaagttaaacaagagaaactctaaacctctgtaattttagttgtcggaaaaaggatctagttaaagaaaagagcagttcatggccaaagcttcgggttctatgtgtttaatgctgacatcactgagatggagtgtcactcttcttttaaatcaggaaatttctgggagccaaacatcagatgtagcttagaacacatcctttgaatgaaatgctcccatatggccagtgctttcctgctaagagggcctattttccatgattttctgtgaaagtccttgagagagctgtgtttaccagagtaaaatttctggactttctctcaagcactctgcaaagcacaaaccccagtgttatctcaaggctattgaaaaccaaagtacacagtgttttgtgatttagaatttcaccgtgaaacctctttttacattcttaatcatattgcttttcaggatcgtgagaatgcccgcaaaatacatgaatcagcagggctgccattctttgaaatatttgtagatgcacctctaaatatttgtgaaagcagagacgtaaaaggcctctataaaagggccagagctggggagattaaaggtaagagaattggctagtagcgtctaccagttacataggctgtcagtcctcagtccttattctgtcctcagaaatcttccttgagtttcaaactgttttccaaaattgcatataacatgcacaactttttatcagatcatgatatattcagtatgcccagaggcttattaaaaggtagggttttatttttaagaattgtcatctcagccatatgcaataacgttcagagaactagaatggatatttatatgtgagtgtgtgtgtgtagaggagtgtttcagagttcttccttattcttgtcttcctttttgattgtaatcatctatagagggcttcaacttagccagcaggattttgttgacaatttggggctttccatattgaaaatacagctatatattttcttacttatggctagaagtcaaggatggctgtttgaccttttctgttaaagtgtgaattttcagtttaatacattattccaacatgtgttttgccttattgattaaaaagattattctgtcaatacagatgcgatgattgtcacccatatgctttgcaggatttacaggtattgattctgattatgagaaacctgaaactcctgagcgtgtgcttaaaaccaatttgtccacagtgagtgactgtgtccaccaggtagtggaacttctgcaagagcaggtaggtgaaccggttgtctttttttatatgtttaataaaatcatgaaagacaatctatgcctctttactgaagcattctttttacagttttcaagtttttaccaatgctgtttcatttcagaacattgtaccctatactataatcaaagatatccacgaactctttgtgccggaaaacaaacttgaccacgtccgagctgaggctgaaactctcccttcattatcaattactaaggtaagtgggtgcagactggtcaaataattaggcttaatatcagtcattataatttatttacaattactcttaacaataagaaaagtataaataaggtgcacataatgtccataaataaaacactcctttttttccaagttatttttaacctcttctccaaagaaatctctcaccaagaattgccacaaggcagctgatcaatgccatgtatggaggtgactgggaaaataacttctgtatttgcattggacaattttacatagctgtcattgtaccagtaagtacatctggtagaaaaatatagccagaccaggatttttgtggataaaagaaagaaagaataaacagtgaattttcaactcagttgcacattttgggaatagatacaacctaaaaatgttcaaataagtcatctcaatacaaaatcttttcaccactatttcataggaaacttccaaacttaaatatttctggcccttagatcatgggttagcataacaggtggggacacttaaaacatagaaggttctgccctcatcctcctgttaactgaataagaaaggacttccctggggccagatgcctggaaaacagaacttatgaaaatgttcaactactttttgtgttttgcagctggatctccagtgggtccaggttttgagcgaaggctgggccactcccctcaaaggtttcatgcgggagaaggagtacttacaggttatgcactttgacaccctgctagatggtatgtttttgttgttgtttcttactctttgttgttaaggaaaaaaaaaaatctttcccagaagttttgcaggaacaggaagttagtctttagtttgcaaatcttattgcaaaactgtttggatcatttacagtgtgctccattctattatgtttaagcttccatttttaggattttttggttgttctcaaaggttgttcctttaaaactaaggaactgaaaaatggtgtaaagccaagagaaagacaggtctgtttcatctccacttgctctttgctggtgctgatattcagaaggtagcacgcagaagtaccattgccacctgctagggacattcctagggcagccaagatgaggtcagcacatgttgctgacctccatggcaccctccaccctccaggttgctcatgtcaagcattattgcaacaactgctttctttggtgcatgctaaagtgtcaatgttcatgcccacacatgaaatatattaaaatggtttcatccactacactctaacaaaagagcattaaggcagctttctggccacgagctgaatggcttttagaaaaccaatctggtcaagctcagaaacatgtgttattgtgaagacttccggacccttctgtgatcatttccttcctagaactgcctgaacttatcaaataaacttatctatttcaagaccttcggggaatggctgctaagtggggaaggagtaggggtagagtcacgctgaatttgtaatgctgagcagggctccaagccttttaggaagaaaaatcaaataagatgctcttttttgggagaggtgttcatgtcctgtgtttgtgcctttgcctggggaatggggcatgaactcagaatcagaactcaaagactgatcagcatgggccctcttcccttattcttttgctgtgacagataacaccccacaacctgaatccttcacttctcagattaaataatattccccaaagacacttagtttacttctagcttgctttaacaacaaaaataataatgcatatccctataccacgtctctgttttcaaagcattttctcaggcattatttcatttgatcctcacaaaagccctagaaaacaggcagcaattattatcccactttacagatgaggaaactgcctcagattaagtgatttgctcataacattcataagtgaaagcccaagaccagagtccagaatcttaggaatcctggcccagtgctccttacataccagtctgctctcctgatgtcttttccaatagaatctacaaggcctgatggtctacaaggaaggctgacttttatcttggtgtcttgattttgacacatgctgaacaccgactgcctgaagtaaaggtcattggacttagcagctagccatgagcaagaggttgattttgagcatatgaacagagctgtggccaaaagacaagtgaactacattgaaagagggggcctcattacagacaacaaggtgctgttgaccttggacaagtgttcctctcataaagaaaaatactagggtggtggaagtggttgcagaggtcagtgttaatggaaatcagaggtccttagcctgagatctaggacttcagggtgggctaacaaaaaatcttagaggcaaaaatgtttgtgttttgataagggaaggaaggagcattttcctgggttgagaatttatagcttttgatagattctgttttttcctttaattattttttattttttagaaatagggtcttgctccatcacccaggctagagtgcagtggcatgatcatagctcactgaagccttgaactcctgaattcaagcaatccttccacctctgcctcctgggtagctgggactacaggcatgtaccaccatgcctggcagatttctaaatttgttttgtagagataaggtctcactatgttgcccagggataaggtctcacagtgttgcccaggctgatcttgaattcctttcctccagtcatcctcctgccttggccttgcaaagtgctattatagacaacaaattcttaaaagagtctgtgatccaaaaagatgaagaacagctaatgcagataatccatctggatgatttaggcaaaatctctagcctttcttttacactgtctcaatttcattttatgggggtttttcaacttgcaaaacctgttgattttcttttttcttttcttttttttcttttttcttttttttgagacagagtcttgctctgtcacccaggctggagtgcagtggcatgatctcagctcactgcaacctctgcctcccgggttcaagcgattctcctgagtagctaggactacaggtgcatgccaccatgcatggctaagttttgtatttttagtagagacagggtttcactatgttggccaggctggtcttgagctccttgacttcagataatctgcccgcctcagcctcccaaagtgctgagattacaggtgtgagccacggtaccctgccaacccattgattttctatttcttatttgatgctcactaccgtgaggtggatgaagcacttattattgctcccactttccatgtaatccagatgtctgtccccgcaaacccaccagcctggggatatgaatgaggttaccttcccattaatacttgaagcctactagttccaagcccctacctgctcatgcagaaagcccagttctttcaaaagcctacccaagtgtttttgggagtccccaaggggtgcgtttcctgtgttcctgagtcagggccccagccatgtgccacttgctgtgtgattctgtgggtctgtctgtactcagaagtgcagatcatgctgggtcactccagccaccaaagttttggtgccagtagggcttttgcagtttatggactcttcttcaagtgggaaaaattgtttccttcctctgtattaacctcaattgaagactgtctaggaggttgctttagttccacagtgttagagaattgagtgaggcaactcttgtaaggtgtatagatccctttatcctcatgtggctccagtgtggctctgtcaggagggttcaagatcagatgttttgctatttccatatcctttccccttccaagctgcaggacctgtgtctgaaactttctgtaagattcttcttttccctgtgggaattatctgctggttccaccatctacctctgcaaacagagtccactggacatacttatacaaccccagttatgatcaggattctgagctctgcacagcccacagaagcatcctaaatgcctgtgtaaattgataataaaaatagataatcagggatatgatgtgctgcccacccctaccactcgccgtatgttaagttactttgggtctaagtagaggcagaatatcacagtggatgagagtgtgagctgcgaagtcacactgtctaggtttgtatgtcagtgattagctatgaacctgggccaaattacttaaactctctgggctttgttccttcatctgtataatggggatgttaataactgtacctacctacctcattggatgttgaaagtttaaaagaatgcctgattcaatagtcagtatttcatacatattagctattatgaacaaaccactctgcatacagttaaaagaatttgtcaggcatggtggctcatgaccgtagtcccagctactcagagcctaaggcgggaggatcacttgagcccaggagctagagtcccacctgggcaacatagggaaactttgtctctaaaaataaatacataaataaaagaacctggagtcttgaagagactaagtgactttatccctagtcacatcaatttggaagtagcacagatacgatgttcgtcagctagccaacagatatacactgagtgccccccatgtgccagggtttttctagcgtctggagatagaatggtaatgaaggcaggtgagcttgctgagaaatacagtacagtcattttctgagacctagtccagtaagtccttcccgccccccatcagtggttgtgaaactttcttttttattttctttttcttattttattttattttttgagacagagtctcgctctgttgcccaggctggagtgcagtggcgcgatctctgctcactgcaacctctgcctcctgggttcaagcaattcttctgcctcagcctaccaagtagctgagactacaggcgcttgccacgaagcccaggaaatttttgtatttttagtagagatggggtttcaccatattggccaggctggtcttgaactcctgacctcaagtgatccacctgcctcagcctcctaaagtgctaggattagagccatgagccgctgcacgcagccgaaactttcttttttaaaccagataattctttatttcatttcaaaaatcagaggcaatctacacaacaaaatggaactgcctcactcccccagtagaagggagtaggggcttgggctccctttcacctggagagcagcctggagggtatcaggaggaagccatttgaaacgcagcaacagaggctcctgacagtgcctcacctgatggcgtttggactgaggagacagagttaaattgtaaaaagtgatttatttctatgtcagaatgttgggcaagatatcatttatatagatatcatttaattgtaaccaattcatgaaggtttgagtcactgccattgaaaatttgaaatgatctccacagccacagacatgtgcccacttttgtcttccttcaaaccattgcaaatttcttgattacctacaatctgaaagcaacattgtttttattctgaccatgtctcctaaaaatattttgttggttttaattttctcaaaggtttatattttcccctaaatttaaaaataaaatagttctgtctactcagtccaaaagccaaaaaaaaaccccaaaacaaaaaccaaatcacttgttagagtatatgataattgtgtagtatgagtcactccatattattactcaagaatctacttttatatcagtgtatcatatcactttatttctcactagaagtatagttccagggttgtcacagaccctttgatcataaatgtcacatttaaatttaaaaatgcaacctcaagcttgtgttgactgatggcatccaagtaggatcaagacaggggagccttgtgagactccatcatttaatggctattcttccgcagctctgactttccaagggagggtgtgagagtactctgcatatatcaccagcacttattgagcaccaattgtgttctgacactggagtttgacatagattattacatttaatcaggataataccactgtgaagatattttgtccacttgagaaaatatgtattagaaaggttaaataacttatttgaagcctagacttaaatccaggttgtcctggatctaatgttggtgcttgttctgctgagcatattttcatgtcctctaaccatgtgagattctaggatgttctagggcagtttgcttctatacttgctcccaaagcctagtttggaaactattctacagtggttgtgagatcacatgtttgcaagagaaaacttcttggtgaagctggaggggacattaacatatgttataattattttaaaacagatatctcttcccagtggatggaaaaataaataaataaaaaattagaaaaccagataaacatctgaacaatgcttttggattgtattgaacaacattccatacaagttctgatttcaccagctttttgctattatatactctctatttttaaaaatagcatgacaaagctagtatatttgtatgttgtatatgtgaagtgtcataataggaatttgttctttgacattgttgctgtaagattcgtttggtggagagctgaaaatgtttcttaattgtgtttatatttccctaggcatggcccttcctggtatgtactttaactttccaagtagctaaattattataattatatatgttaaattaactggaaatggttaagaacataactaaaagaaaatctacattaaccagttggaatcgctattagttcatgatccaaccagctatagtagaataacactgtatttttctttagactggagtccaaacaacaggaaatttcccaaccagatgtagctattgtgtatgatgtagcatttggctgacaaaagtaaacttgtttctaaattatcattgtacattttgttcctgagtcttttacatttatgatcctcttccaatgactgttggtcctcatttagtttcacaaagctggaaattttttttcctacagtgtttataaaagattttaagttgatgaagaataaatcgatttaaactgaatgtacctggttggattgtgtatgattgtacttcatttgtttgcaatgtatgattatgcatgaacttaatttcaagccattatggttgcttgttatggaactgggagtaaatatacatttgctgtgactgtaaacttctgcattgtacaagaatgaaaaggtagaattctgaatatgtcatctatctttggtgttgctttcatcattgttgtttttcctttaaaaagcccagttaagcaataaaaagtaatttaggttttgcacagaaacagtcccaaacaaccatgaagcagatctataaggctaacacagaaggcttgaaaattattgaaagcaaaagaaaaatcattccattgaacaataagctatctcttggacttactgtggttaaagaaccacaatattctttttcaaaataagatataccacaataaaataatcaaggcagtgcccaccagagccaaatgaagcacatgaaggaaaaggctgaaaactcaagtcagggttgaaagtcatgggtgatgtttcagcacagttcaagtattacatcttagtaatagttggatacgtttatatattagaaaggttgataaagatgatagggaaactacagtaaatctgtgtatacacatgtagtgttgtagctacaggcttataagatcagttggcattattacttggcagaactcctttctataacatcccacagattcacttccttattgagacaacctgccagagtgttatttagtcatttcagattttcactcaaggccaagatgaaggtagattagaggctaaattggtcaggaatctagtggacaagaggaggtggctgcaacagtgaaacatcccttggatttcaagtcagaatacttgatggaaggcaacgttacagacgtgttgcaggcagcgctaggttctttcagcaccctgctccacattttgctttgcattttgctttatttcggccaagtcattctttataagcagaggcaaatatcatggtcttcctttcagcaatgtggtcagtaagcaatccacagaaagcatgatttctagtgacaacgacagcatttctgaaggggttattctttgttagcctctctcccttttcctcaactagactatgcagtggatttaatcatcttccatcagcaacctccattaacatagtgctttacagtttgccccctgcagcaacccatggagatacatgtcatttattagcccatttttccagtgaggaaactgagtttagaaaagttgaatgacacacatagtaaaagggagaactgctgcctttgaatttagtgttctctgcaaaggacttagctgctctaattgcccgagaacgttgaaacaaagagttatttgaatgacacaccattactttctgtatgtacacagtatctagtttgtggtttataaagggtctcaaagtatattgcaggattttatgatagaccggatttgtttattgccggcagttgctgtctatttccggtgacattctttaggttctagtaacctttggagagtgtttaaaaggtgcaaagtgatatgcctggaaagtttagtttcataactactagggggagtcttatgccccgaaggaatagaactctaatctttaactctgtcagaggccttctaaatgttgcattgaaaagttaggtttaaatggcttcattaatcatggcacattccctcaggtccataaataactgcatttgcttcctctggagttaaatgttttctttattcaccttcctttcattctcttctgaatcttgaacttgagaactctcacaaaattgtccctaatattattttgtgttatacgcttaaccatgagccctcattttctcatctgtgagtataattgagagaatagcctatttgtgagggcatcattgtaggaggaacaccgttttgtacatttttttacattatctagaatcatagagaaatgagatgtttttagaaagccaaattttatccctttaagccccagactgaaaaccaactacacattaactatcttatttagaaacatttcaaaatagtcttactaaaaaaaaaaaagtattcactcaaaaaaaaagagaatatgttcaatataaaggaacttttaaaaatgactctgtcattattagttttaccagttattaaactgggcactaatgtaatggtgccctgaagatggggagacctgtgggattgttggctcccacactaaagaacccccataactctgtatttcagtttcagtgttagaaccttgtatagtcagggttctccagagaaacagaacaaacaggatgcatatctgtgtgtctatctatatacagatatgcatctctctatatagacatagatataaaatatatgtaacatatttaaataaatttatatatatgcatgtacatatattaatttatacatatattaattatatatatacattattttaataaattatttattattatggagccttatctctctatgtattatacattgatatctatatataacatatagatattatatctgaattatataatatttctgatatatatctgaatagataacaatatatctgtatgttacatatggatatctatgtattatatataggtatacaataaatctctgtctatacacacacacacacacacacatacacacatagaaagagagagatttattttaaggaattggttcgtgtgattgtggaatctggcaagtccgaaaactgggaggctggggaccccgagaagacctgcggttcaagtccacaggcggtctgctggcataattctctccttttctggggagaagagtcttttgtctaattaggcctttgactgattggatgaggcccactcacattctggagggtactctactttactcaaagtctactgatttaaatgttaatcccatctaaaaagtacctctacagaaacatctagaataatgtttgactaaatatctgagtactgtggcctagctaagttgacatataacatcaaccatcacagtttctatgtgtattttttcagtagttttcctgtctcttcctttgtggtccagctgtcattggacatttcttgctgctgaagatgtagcttctctgaataccacattcgatgccttctaatttgctgtgctgtatactgagaaatcagaacaccctgtttatttaaattcctcttaaagcaagagactcagcataatggtgagaggagctcacactccagagaaagtacatgtgcgttaatgacttgatgtcatttttcactcctctgtggttttggacagatgattctcaactgtggttgcgttagcaagacctgtgattcccagataagtgagattaccagtatcctaaaaaatatttaggaaagagggagcaggagggggaagaaaaggtgattttatgctgaaaccaccatgaataacatcaagaggactgctcgtttgggatcccatagattagtgggttttgttttgttttttgagacaggatcttgctctatcacccaggctggagtacagtggagtgatcagggctcattgcagcctcaaactcctgggctcaggtgaccctcttgcctcagcctcctgagtcgctgggactacaagtgcatgccaacatgtccagctaatttaaaaaaaatatgtgtgtatacacacacacacacacacacacacacacacatattttttggtagagatgaggtcttgctgtgttacccaggctggtcacaaactcttggcctgaagcaatcctcccatcttggcctcccaaaatgctgggattataggtgtaagccactgcacctggctgaaaatacattttttacaagtgcatgagatgggtacagaaaatagaatgaataagatctagtatttgatagcacaacaggatgactatagtcaataataatttaacggctgggcacggtggcttacgcctcttatcccagcattttgggaggctgaggttggcagatcatgaggtcaagagatcgagaccatcctggccaacatggtgaaaccccgtctctactaaaaatacaaaaattagctgggagtggtggcacatgcctgtaatcccagctactccggaggctgaggcaggacaatagcttgaacctgggaggcagaggttgcagtgagccaagatcgtgccagtgaactccagcctggcggcagagcaagactctgtctaaaaataaagtaaaataaaataaattaacagtgcatttaaaaataactaagaggataattggatttttgtaacacaaaggataaatgcttgaggtgatgggtacctcatttaccctgatgtgattattatgcattgtattcctgtatcaaaatatcttatgcaccccataagcatatacactatgtacccaagaaagttaaaaatttaaaattaaagaaaaaggtgaatgaggtattacccagattgtggctgattagtattaaaaaagacaaacacacagctgtcataagtaacttattatacaaaaaatgcatattctcattcccatagattcatatcaattatctgatttttttctttgttttcaattcagtgtattggtatgcagatagagcctaaacaggtaatgaaataagagacttgcttaacgttcttacaagtttcatttccaagaaagactagagagttttgttttggtttgttttgctagcttaattttatttaattgggttttggaaaattttaaactccctactgcattgaggtcaggacttagatatgaaaagggaacccacaaagaggcgtttccaaagttagatcacttatggaggccacctccatgatttaaaactcaacccacttttcacatatgctccacttgctttgggaagcccttcaaggacttgtcattatagaatctagagaaactggtgcagctaacacaactacttggatttgggtcttaatgcttcttgaaggaaatgtttggaaggggcattgtgcacatttgattcatgcttcaaggatggcacaccttatatctagttttcgtgcatcacatggctctttccacagatggcgtgatcaacatgagcatccccattgtactgcccgtctctgcagaggataagacacggctggaagggtgcagcaagtttgtcctggcacatggtggacggagggtagctatcttacgagacgctgaattctatgaacacagaaaagaggaacgctgttcccgtgtttgggggacaacatgtacaaaacacccccatatcaaagtaagtcacaaaacctttggaaggactttcttgagctatttaaactgagaagaaaaataactctttttaattcctttgcaaaggacttagaaaaactgggattaggtggaagaatgtatttctaaggtagtgtttgcaggctttgcctcaggagatgtttttagaaaggtgcaaagaaatgtctttctgtttgaggtctggtctcaatgatctcttgagtcctcagattctgcagtggctggcatcctcagctaaatgggaccagataagaaatttagtctgacaacatgagtagagaaacaaaatcatagctgtagctatgcacaaaaccataatcagagcttgcagccctgcccatcttgaaaatgcgcaaggaacataagtatcttcataaagaatggacccaaccaaatgctggaacaagaactcagagttcatgctctgtggctagtgagggggtcaatgatactctcttagtaaatgatactctcttagtaaacaaaaatcagcacagatagtggcagagtttccagaggaaagatattttttcagtggatatttttaagattgaaaaaaatgtgttcatctgataggatcaggtagggtctatcatgcctaaagggaaaatagactaactcctcagattccttcacagcttctaattactgtcggtgatggggtggggtgggattttattaagttgctggctgtggttcatttcccacaaagaaaaatacatgaaattgaatggtaaaaccatccctcatccaagataagagcagtagggtggaaatgaaaaaagtcatatactactaatttgacttctcaaatctcccagcatgtccctttcagcatgttcacaggaagagagagcactgtcagacccaggagactctaaaaagcctgggattagacaaggcatgccctccctctgggcctcagtttctttattataaaaggagaggccaggctgggcgcggtggctcacgcctgtaatcccagtactttgggaggccgaggccagcagatcacctgaggtcgggagttcgagaacagcctggccaacatggtgaaaccccgtctctactaaaaatacagatattagctggacatggtggcgggcacctgtaatcccagctactcaggaggctaaagcacgagagttgcttgaacccaggaggcagcggttgcagtgagccaagctgccagtgtactctagactgggtgacagagcgagactctgtctgaaagaaaaaaaaaagagaggccagactcaaaataactgtaagatctcatccagcctcatgaccctgtcaaaagatatggcttcttttggtcttcatttttgttacaaaatgttccaagataggaaagaccttttaagtcccctgtttgtggcctctgaagaccttctctatctgaacacaaaaggtcaatggcaagcaaagcagctttttcatttatttatttttattttttaaaaatttttatttatgattttttgagatggagtcttgctctgtcataatcatataggtttgggattttatctttactcagtgactgaaagaatagcaacctttggttatggttatgtcagctcagatatttctaccctttgggaatgatattcgcatacacatgactagcactaaaaaaacctgaagagtttcttaagtgattacaggcatacctcattttactatgcttcactttatcgtgcttcacagattttgcttttcttttcttttttttttttaacaaattgaaggtttgtgtcaaccctgcactgagaaagtctgtgagtgccattttcccagcagcgtgtgctcattttgtgtctctgtgtcacattttggtgattcttatgatattttagatttcttcattattattatgacctgttatggtgatctacggttagtgatctttgatgttactattgtaattgttttgggacaccacgaattgcacccatatgatggcagacttaattgataaatgttgtgtgtgttctgccttctccactcactggccattcccgcatctctctccctctccttgggcctccctatttcctgagatccaacaatatttgaattaggccaattaataaccctgcaatggcctctaagtgttcaggtgaaaggaagactcacacatctctcactttaaatcaaaatgattgagcttagtgaggaaggcatgtagaaagctgaaattggacccaggtgcagtggctcacacttgtaatcccagcactttgggaggccagggtgggcggatcacttgaagtcaggagtccgagaccagcctgaccaacatggaggaaccccatctctactaaaaatacaaaattagccgggcatggtggtgcatgcctgtaatcccagctacttgggagcttgaggcaggagaatcgcttgaacccaggaagtggaggttgcactgagccgaggtagcgccattgcactccagcctgcaacaagagcgatactccgtctcaaaaaaaataagaaaaagaaatttgaattaggcctcctgggccagttagccaagttgtaaatgcaaaggaaaagttcttgaaggaaattacacacagtgagctaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggtgattccctccagatgaatgtgggcaaagtaaactgaaaaccttctggaagggattcaccattctggatgccatcaagaacatttgcaattcgtgggaagaggttaaatatcaacactaatgggagtttggaagaagttgatttcatccttcatggatgactttgaggggttcaagacttcagtagaggaagtaactgcagacgtggtggaaatagcaagagaactagaattagaagtggagcctgaagaagtaactgaattgttgcaatctcatgatagaatttgaaaggatgaggagttgcttcctatgaatgagcaaataaatcgtttttttgagatagaatctactcctggtgaagattctcttgaaatggcaacaaagtattcagaatattatgtaagcttagttgataaagcagtggcggcctgtgagaggattgactccaattttgaaggaagttctaccatgcgtaaaatgctatcaaacagcatctcatgctacagagaaatctttcatgaaagaaagagtcaattgatatgaccaacttcattgttgtcttattttaataaattgccacagccaccccagactttagcaaccatcaccctgatttgtcagcagctattaacacaagactctccaccaggagaatgattacaactctctgaaggctcagaggatcattaacatttttagcaaaaaggtatttttaaattaagataggctgggcgcggtggctcaccctgtaatcccaacactttgggaggccgattgtttcagcccaggagtttgagatcagccttggcaacatggcgaaaccctctccctgctaaaaatacaaaaaattagctgggcatagtggtgcacacctgtagtaccagctactcaggaggctgaggtgggaggatcacctgagcctgggaagtcgaggctgcagtgagctgtgattgtatcagtgcactccaacctgggctataggagtgagaccctttctcaaaaaaaaaaaaagtttagataatattacattttaaagacataatgccattgcacacttcatagactacagtatagtgtaaacataacttttaaaatgcactgggaaaccaaaaaatttgtgtgactccgtttattacaatattcactttattgcagtagtctggaactgaacctgcaatgtttctcaggtatgcctgtatttttttcatcatgccttacaatgcatgctggcagatggaactcagaattttagaatttcttagaagccaaggagaatggtggcatgacttgtgtctttgacaatattttcagtgattctatacctttaggttattagggggactcgataaacattcccagggagctaatggtgagaaatgagccttggataaccagagagagaaagccactcaccctgcagacattttgtgcaaaagtgagagagattgatgaagattgttgaagattgtcgcatgtaccaaacacacaagttttattggcaaaataattctttttgctgtgtccttttttagcactctgaaacccacaaaaacactttaacacaggtttttagaaccccacagcttccaaaagtaattacttctgcgggaatcctgggccttattctatttccatgtggcactgggagtgatatttgcaaggaaaatagagtcactaggaaatggtctgcctttgttacagagcttatctccaacgtcattcttgaccttccattcaaggcatccagccctctctttggcatcactaagtatagaaccgtgtgacatgcgctcaaatgaaatcatcaggaggagcaggtgaaacttgtaaaactaatgcttgctggggctttgttgcctttcgtccatggctcccagagatttgtcaagtagtaattatttttcacaatgctcttggtgaggaaagtaagaatcattactcctgttttgcactctacattttcttgtacaaaccaagagaacagaatatgacttctcaatgaaagatgggaatgagagtttatagcctttagctccacaatgaaaaccatatggttagttatatcaacagaatcacctgaggagctttacaaatcacccatgactggatcccatcctcacagattctcatttaattggctttgagtcagatctgattattgaggggtgggtagttaaagctccccgtgattctaatgggctgtgaaggttgagaactattgagttagataattgtttggagctattttctttagggccccacctgcatatatcctgcaagtacctcaaactcaacatgtttaacctccccccaagcctgttccccctactatgtctcctatcttagtgacagcttcaccatccaaatggtggcctgtgaccaaaacctggatgccattcttgcttctctcttctccccttgtccattcagtcaccacgtcctgccaaatgtagctttcagttattgcttgaattcattcactcctcttctattccatcttgggtcaggacatttcaattctttcctctctcttgtcttactcccccataatctcccactctttagctagagtgaattattcaacttttctttggaaacccctttattaagatacaatttaccgcaaagcctcttgccaccaccagccaacacactccctcgtccagtccttccagagctggtcattcgatcatgcgctctctgacttttgcacatactcatccttcaacctggcacactgtttcttccacctctgcctccggaccttattacctcctttcagaagtcagcactgactcctatgacacatgagcataactgagtgccccttctttgtcctcccagagtaatttgtacttgcccctttcatacctgtgacaggtgaagctgaaatgtcaatatgggggccactgatgagaggcagtgggtgcagtgatgagaagaatctggtttgcaggagtctgagatttgggtcttggctttggtaagaaagctctgtgcacttgaactctgccacttcccctctgtaaaactgccttctcttctgaaaatgaggacattaaatctacattacctccaggttccttaaagccccagattctgtgactatgactgatagcacagaaatgaatgtgtgtgtatatatatatatatatatatatatatatatatatatatatatgtatgtattctcctcttgtaggcattagtttttcttctctttgattctgttctctgcaccctttcatcatgaccttatcttgctgaatccaccatttccttccttctttctggtttctttcccttctctctgctccctttttgcattctttttcaccttcccaccctcagctgctcctccctttccaattagtgcattccctcatctccagattgtttcttttgagtcttcctctccttggcctctttgagcctatttatcatagctttcttagtctttacgctagtggttgagcttatcctctcctttatgcattcttgtgtgtaattttgagcccaattccctatttgctacttcactgggctcctgaagcctgctccccattccttttggcgcatctagttctgcaaatcctctagctgtggcccccctgctgtctttggcaggaagcttggaagggggtggggacttctaggccacaaagccctgggaaattaagcagagcctctggatctcccttcctgacagctggacacagttctggcgataattggaccaccttagggatagagatgccccttgtccctccccatcccagaaatgccaaacacatagttttaacatctctcttcaaacagacaggtttttaggctggatggtggatgaattcggtttgatgcccccttcaccaatagatagagcaatatacggtggacccctagtgtccagaataaattactgcatcctcaggggtttggaggtcagttctcaaaattgtgctgtgtccaactctaagcaatgaggagaaagtagatgtataggtatggatatttgaaaatgttcttgttgaattatctgactgagcacagagtttagaaaagaggccatgaaaacacaaccgaaaaccttgcataattgccttctgtctaccgcagggtttctcagcctcagcactgttgacatattggactagataattcttcactgagagggcagttctgtgcaatgtaggatatttagtagcatccctagcctctgttcaccagatgccaatagcacttcagtcatcacaatcaaaattatcttcagatattgtcaaatgtcaccaggagtgactaaatcagcctctgtttagagccactgctctatcccaatcccccactccctgaacctctctggaatgcaggtcatggtaaaccccaatatctggccataatggggactgtgaaccaggtccaccatcactatcttcgtgtcttcctactaggtgtttcaaatcagctttctctcactcactcttgcctccctcttctctgctaacatttcaggtaaccaagttgtatttggaaagtggtgaaaggtacttggggtttgattagggggaggattgtaaaaccattacatgtttgactgaggaatgagattggctgtaagtatttgtgtcagtgactaggagagacacagctctgtaattgattatacttcaataccagatggaaaatatttaaacttatagaaaaaaaacaaaggttgccatgtttttcttttctttctttctttttttttttttttttttttgagacagagtcttactctgttgcccaggctggagtgcagtggcgagaccccggctcactgcaacctccgcctcccaggttcaagtgattctcctgcctcaacctcctgagtagctgggattacaggtgcccgccaccaggcctggctattttttatatttttagtagagacagggtttcaccatattggccaggctggtcttgaactcctgacttcatgatccacccacctcagcctctcaaagtactgggattacaggagtgagccaccatgcccgaccatgtttttctttttcattagtttcaccattcttcaaccctggcttacccctaacatttgtggggcccagagcaagaatacaaatggagagccatacatcatatttaaaagttacatgtgtaactaacaaactgctaaataaaatgtgtttgatccttctactttgacaactatgccttaatcacaaactggaaagccaggttcaaatatagacttctgggttctgcatcagaatatggtagtgtgtggagagttggcccttggcctttcaccaactctcccttctccttctatgcttggcctcttcctatgctatgtgggtcctctggattgatttgtgggcaccccaggctgcatggctgagctctctccacaacctctgcagaccctccctgcttggcccgccctcagaagtagggctgctctgagtgtgtggtccaccctggaaagacaggttgggagatgaagctctcccaggcctagcagcaagctcagagttgattgggcaggaaattctagagttctgggtaccctgattatgatcaaaagagtaggtgatgactctgggtgggtcttcccaccaagggtctccttgcctttatgagatagacacaaccaaagggggccagagttgggccatctaatgtgtgggacactatgaagatggttcttctgcaggtctccaggtgctcttcacacccaccctttcctgaagtcacattttcagctgagactgggaatagaaaagtgattgcttctaacctcagtgaaataaatcctcagtgagttaaaaaacggtggttcctctaaaaaaaaaaattaaggtaaaaaacagaacataaaaattatcatcttaaccttcttgtaagtgtgcaactcagtaatgttaagcatattcacattgttgtgaaccaaatctccagaactttgtcatcttgcaaaatggaaactctacacccattaaacaactcccgcggtcaggcatggtggctcacgcttgtaatcccaacactttggaaggccgaagttggaggattgcttgagcccaggagttgagacctatctggttatcatagtgagaacctgtctctacaaaaaaaaaattttaaaattagccaggtgtggtggcatgcttgtagtcccagctacttgggaggttgaggtgggagaactgcataagccccggaggtagaggctgcagtgagctactgcatgccagcctggtgacagagtgagacctgcctcaaacaaaaacaaaaacaactcccctcttcttctttcctccagctcctggtaactaccatccttcctccagcccgtggtaactaccattgcactctctgtttctatgaattcgactagaattcatagaaatttagatacctcatataagtggaatcatgtaatatttgcttttttgtgactggcttatttcacttagcctaatgtcctcaaggttcagccatgttatagcatgtgacaggatttccttccttttaaaggatgaatgatcttcccttgtatgtgtataccacattttatttacccattcatccatctatgcacatttgggttgcttccacctcttggctatttgaatagtgctgctgtgaacatgaggatacaaatatttcttcaagactctttcatttcctttgaatatacacccataagtaggattgctggatcatatggtagttccatttttaattcactgaggaacctccatactgttttccatagtggttgcaccttttacaatcccactaacagtgtacaagggttccaatttttatttttctacatcctcaccaacaccaacacttgttttttttcttttctgtgtgtgtgtgtgtgtgtctctgtcacccaggctgaagtgcagtgacgcaatcatggctcactgcagcctcaaccttcccaggctcaggtgatcctcccacctcagcctgctgagtagctgggactacaggcatgcaccaccatgccagattaatttttatattttatgaagagatggggttttaccatgttgcccaggctggtctcaaactctgggcttaagcaatccacccaacttggctcatgctgggattacaggcgtgagccactgtgcccagccattttctgttttttaatagtggccatcctaatggatgggagatgatatctcattgtagttttgatttgcatttctcataattaatgatgctgagcatcttacatgcttttggccatttgtagatcatctcaagttatgtctattcaagtcctttgcctatttcttaattgggttaatttttttgtcattgagttgtaggagtttttatatattctggatattaaccccttatcagaaaatatgattttcaaatattttctctttctataggttgctttttcactgttgtgttctttgatgcacatatgtttgaagtagttgcaattttttttgcttttgttgcccatgttttagatgtcatgtctaataaatcatttccaactccaatatcataaagctttttcccttatattttttgtaagagtttaatagttttatgtcttacttttaggtgtttcatccattttgagttaaattttgtatgtggtgtaagataagggtccaacttcattcctttgcatgtggatatccagttttcccaacattatttgttgaagagactgtcctttcccccattgagtggtcctggtacccttgtcaaagattatttttaaaaatagggttttagctaatagtctatgtttagccttagatgtgaatttggctacattttgctgcgctttggagatttccttttgttttaaaatcagatataattgaagaaggctgcttcttttgagaatttccatagaaattgtgcccaacaataattaactggaagaaaacaagttgtccgatttttcccccagggtctctaatttaggtcttcattggaaatagtctaagatacatcagactgtattaggaatgtactagcagcagttctcaagtatggcttacaaaactgagggtccccaagacctttctagagaatccccaagttcaaaactgtgttcataatactaagacattctttgcctttttctctgtgttgacatttgaattgctggtacaaaagcagtagtggttaaaactgctgtaactttagactcgagacaatgacaactatgtccatagtcactgcactattcatcatcatgcacttgcagtaaaagcaatgctagcttcacctaagagtgttcttgatgaagctgtaaaagcgattattaaatcttggcccttgagtccccgtctttttagtattccattacaaaagaggaagtacacattaaagtacttctgctacatataccaatgtacaatggttgtcttaaggaaaagtacttgcacagtggtttgtgctacaagcaatactagccactattttttttcatggatcaccatgtctacttgaaagcatgagtgataaactatggttattcagatatgactattcggcagatatttttcaaaatggacaaagggaacctgataattcaaggaaaacagctgaaagtattcattgccaatgataaatctaaggtttcaagcaaaatatttttggaaaatttttattcaccaccataagcttggcagattcccagtacttagaaaactttttgatgagactagtagtgatattaacacatgtgtgatgagactagtagtgatattaacacatgtgtgtgtttaaaaatcctgtaatgaaatatgtcaacacttggaagacttacaaactcagtgaactagtagtttctaattggccaatatacaatattgcaaaatcattcatgggtaaatgattcatccaaagcacagtgaactaatagtttctaattggccaatatgtaatattgcaaaatcattcatgggtaaatgattcatccaaagcacaatggatttttaatgtaacagagtatgagaagtgcattaatatggcttcccattccacagtccaacttaaacctttaagaaactgacacttgttgagttttggtgtagtatcagataagaatatccataattgtgcaaaaaggctatccaaatcctcttctcttttccagctacctacctatagttggacttcctttttatacttcagccaaaacaatgtattactacagattaaatgtagacatagatatgagaatccagctgtcttctattaagtcagatattaaaaagattgcaaatatgtaaaacaataccatacttccctacatttggggaggaaaatgcttatttttcactaaaaatgttatatatgttaacaggcaataggtttattaatgttagctttagatggattgataaacatttttaaaggttctcagtttaaatttctaatatgaaaagtaatgatagctataacccacaaaaatgaaagctcatggtggggggtactcaataattttttaagagcataacgggttctagagaccaaaaagtttgagaaatactgtgccagaaatactaaagaactgaaggcagttctttaactgtaacccgagattggtctaaaaggagaaaacttttcagataaaatagaaatcacaattaatcattagcaatcataacaatgttctttctagatggtgatggaaagtggggactggctggttggtggagaccttcaggtgctggagaaaataagatggaatgatgggctggaccaataccgtctgacacctctggagctcaaacagaaatgtaaagaaatgaatgctggtatgtaaactgttcttagtgcattttatttatttatttattgagatggtgtcttgttctgtcacccaggctggagtgcaatggcacgatctcagctcactgcaacctctgcctcccaggttcaagtaattctcctgcctcagcctcctgagtagcttggattacaggtgcccaccaccacgcccagctaatttttgtatttttagtagagacagggtttcaacatgttggtcaggctggtctcaaactcctgacctcaggtgatccccctaccttggcctcccaaagtgctgggattacagatgtgagccactgcacccggcccctagtgcatttattaatattcccttaccaccctctgattaaagaattaaggataccaggagtcagcattttcttttttaagagacaggtctcaccctgtcacccaggctggagtgcagtggcatgaccatagctcactgcagcctcaacctcctgggctcaagtaattctccaaccttaacctcacaagtagctgggactacaaggcacatgccaccatactctgctaatttttatatttttttgtagaaatgggtctcactatgttttccaggctggtcttgaactcctgggctcaagcaatctccccgcctcagcctcccaaagtgctgggattacaggcatgagccaccatcatgcctggcttcagcatttttatagttaaaaataacctgaaaacatcttctattggtatgtctataatatggaaacagttttataaagttgtactatatattagaaccatatattagaacactattcaacagtttaaaatattcactgatagagatagctgaagtgtatttatgaagtgaaaaagcaaattgcagaacaatatgtagagcataatcatgttctggaaaacaaaataaaatatcatcataattctaaaatccctaacctactttctgtgcatagtggcagaaaagtctctggcagcacatgccccaaactgcagattacagtggctacctcttggggatggagtttggactaagagatttttactctttattgtatacattttgaaaaagagggagaaaaagtaataataggattggtgatttttatattctattttgggcttttctgtatttctcaagtttttcattataatattgaaagtattcattttcagtactatagacataaaaattatttcattatcagaaaaaaaaattaaggctttcaggagtccaccactaagtggagtagttttggagatttctttaaagcgaaagcaaaatttttttatatctttagattgttgccccttgcacaggccccagaaaacatttgttacaattattcacctccctctaggcttcctggtacaagaggactaattaacactggccctgcctgagccttggtgtacaggaaaggtcctggcaacaaatcttttcattcctgagttaggctgtccctaagcagcttcctgcctctgcatctcatccctgtctcagctatctggtgttggttagtgctggattaacacctctaaagacccaggtgtattctccagctgattatcagaagccagtggataggctgggtgcagtggcttacgcctgtaatcccaacactttgggaggctgaggcaggcggatcacttgaggtcaggagttcgagaccagcctggccaacatggtgaaaccctgagtctactaaaaatacaaaaattagccgggtgtggtggcacacgcctgtaatcccagctactcaggaggctgaggcaggagaatcgcttgaatcctggaggcggaggttgcagtgacctgagatcgctgactgcactccagcctgggcaacagagtgagactctttcaaaaaaaaaaaaaaaaagccagtggataatgaatgcacagaacaataaacatagctgtgtcctttctgttcttgtggagaaatgacaccatgtgtttctgtgaccttccttcttctgctttcctctcccagatgcggtgtttgcattccagttgcgcaatcctgtccacaatggccatgccctgttgatgcaggacactcgccgcaggctcctagagaggggctacaagcacccggtcctcctactacaccctctgggcggctggaccaaggatgacgatgtgcctctagactggcggatgaagcagcacgcggctgtgctcgaggaaggggtcctggatcccaagtcaaccattgttgccatctttccgtctcccatgttatatgctggccccacagaggtgagcaattcccagagctgggctttgagactcaggaattcagactcagactttacatagaagagtaaatgagtctctgggatcctttctgtttcctcatgagcagattctggaatgttctggtgtctcttctttatctagcttaattatgtttccacttagtatttgaaaagtgctagaaggccaggcgcagtggctgtcacctgtaatcccagcactttgggaggccgaggtgggcagatcacaaggtcaggagttcgaggccacctgaccaacatgatgaaaccctgtctctactaaaaatacaaaaattagctgggcatggtggcatgcccctgtaatcccagctactcgggaagctgaggcaggagaatcgcttgaacctgggaggtggaggttgcagtgagccgagatcatgccactgcactccagcctgggcaacagagcgagacttggtctcaaaaaaaaaaagaaagatgctagaaacatcaaatcaaacctattatacattgcctttgagaatatggaagttggcaagtgaatgaggtggctaatgaaacttaactgggtgatagggcaagttgtatgtaacctaatattcaatttcagaagttccagttactctccatgccctgtgagcttcattaggaaaggatatctttaaaagataaatgtcacccttttatcataacacagtgagcttatcaaacagagattttctttgtcccactgcaccaccagtgtagtggatttgaacgagctggctgcaagtatgatgaatagaaagggtctcaaccctttggaatgccccaaactgagtttaatgaattaattctcttcaatcagataaaagttccaggcccctagctctcctttccatcctttgtattgctatctgagctttaaagagggtaagtgttatgttgaactgaaatcagcatttgcatgtgaaaggtaattagctcattaatggcagtcagataatgagatactggagttggtaatttcctttaaactgcaatttattgtgaatagggaggcactggaaagtaaaatccacatagttctgtagaatagtaagatttgagtgttcttgtccggctagcctgtttggagaagagatgaggaaatacaaccttgagttatgagggaggaatcttatctttagagctcctatcctacctaatataacaaagcatgaagagtgcacggagtcttagaacctcagtgattttcttgcaattcttagttgactcacattgctgaattacttttaaagtagaataaaggtgtctccataaaccatgacctacagatttgacccacaatgaccagcatgtcccttatggacattttctaggtccagtggcactgcaggtcccggatgattgcgggtgccaatttctacattgtggggagggaccctgcaggaatgccccatcctgaaaccaagaaggatctgtatgaacccactcatgggggcaaggtcttgagcatggcccctggcctcacctctgtggaaatcattccattccgagtggctgcctacaacaaagccaaaaaagccatggacttctatgatccagcaaggtaggttttcagaggaaaattcttttatcaacatctgtataaaagaaatgatgaggcagaatttgggccctttgaaaaactctccagtgcattgccacatgctcccaagtggactgagtcccttgagagtcaagacgtggtcttataaattttatgtcccctaaaattgtactacagtcttctgcatatagtagatggtccataaatatttctctttcaacatgcattcttgagcatgcacagagtgcctggcacactaagtgaaaggaagcaacatagaaagagattgcaatgaatatttatggtgcacttgctcctcatgctgagggttcacagaagtaggcagagaaacagaagacagactctgggctcaagacacttcccaggaacagtataggcgcatggcaaatactaaatggatagctgccattatttcccttctcttctgcaagttcctgaagatttagaggactgcccacttttgaagatgcagcattttacagaaagaacatgggtctcaaaaaccataacctactccaggaatccttaaggcagatatcatttacctacactgagttctttgttgccaccctgtaacaggcacaatgagtttgacttcatctcaggaactcgaatgaggaagctcgcccgggaaggagagaatcccccagatggcttcatggcccccaaagcatggaaggtcctgacagattattacaggtccctggagaagaactaagcctttggctccagagtttctttctgaagtgctctttgattaccttttctatttttatgattagatgctttgtattaaattgcttctcaatgatgcattttaatcttttataatgaagtaaaagttgtgtctataattaaaaaaatatatatatatatacacacacacatatacatacaaagtcaaactgaagaccaaatcttagcaggtaaaagcaatattcttatacatttcataataaaattagctctatgtattttctactgcacctgagcaggcaggtcccagatttcttaaggctttgtttgaccatgtgtctagttacttgctgaaaagtgaatatattttccagcatgtcttgacaacctgtactcttccaatgtcatttatcagttgtaaaatatatcagattgtgtcctcttctgtacaattgaccaaaaaaaaaaaatttttttttctcactctaaaagaggtgtggctcacatcaagattcttcctgatattttacctcatgctgtacaaagccttaatgttgtaatcatatcttacgtgttgaagacctgactggagaaacaaaatgtgcaataacgtgaattttatcttagagatctgtgcagcctatttctgtcacaaaagttatattgtctaataagagaagtcttaatggcctctgtgaataatgtaactccagttacacggtgacttttaatagcatacagtgatttgatgaaaggacgtcaaacaatgtggcgatgtcgtggaaagttatctttcccgctctttgctgtggtcattgtgtcttgcagaaaggatggccctgatgcagcagcagcgccagctgtaataaaaaataattcacactatcagactagcaaggcactagaactggaaaagaccacagaaaacaaagaatccaaccctttcatcttacaggtgaacaaactgtgatgatgcacatgtatgtgttttgtaagctgtgagcaccgtaacaaaatgtaaatttgccattattaggaagtgctggtggcagtgaagaagcacccaggccacttgactcccagtctggtgccctgtctacaccagacaacacaggagctgggtcagattcccctcagctgcttaacaaagttcctcgaacagaaagtgcttacaaagctgccttctcggatactgaaaggtcgagttttctgaactgcactgattttattgcagttgaaaaaaaaaaaaagctattccaaagatttcaagctgttctgagacatcttctgatggctttacttcctgagaggcaatgtttttactttatgcataattcattgttgccaaggaataaagtgaagaaacagcaccttttaatatataggtctctctggaagagacctaaattagaaagagaaaactgtgacaattttcatattctcattcttaaaaaacactaatcttaactaacaaaagttcttttgagaataagttacacacaatggccacagcagtttgtctttaatagtatagtgcctatactcatgtaatcggttactcactactgcctttaaaaaaaaaaaacagcatatttattgaaaacatgagacaggattatagtgccttaaccgatatattttgtgacttaaaaaatacatttaaaactgctcttctgctctagtaccatgcttagtgcaaatgattatttctatgtacaactgatgcttgttcttattttaataaatttatcagagtgaaggctgagttttttctgcctgtaccattgggtgtgggttgaccacacaacttaagggctttgtgactttgtataattggagtgagacagcagcaactctcttgaacatcataactgagattatttacccttattcatgtcttttttattttttatttttttaaagacgaagtcttgctctgtcacccaggctggagcgctgtggcacgatctcggctcactgcaacctccacctcctggattcaagtgattcgcctgcctcagcctcctgagtggctgggattacaggcatgcaccagcacgcaaggctaatttttgtatttttagtagagatggggtttcaccatgttggcca

SEQ ID NO: 13668 - DNA, 51770 bp, Human
  misc_feature (1)...(51770): n = A,T,C or G
aaaaaactaaggcccagagaacttgggtcactcaattaataagcggcagagctaattagagtctgggtccaaagcttaagcactcttcgtcttctttatatttggctttttcctagccaaaaacatggaggcattgcttacttttactttatcattgttatcttggcataacatcaaaataattaggagctgatatacctaagtgtataaaacaggataaaattaattgatgaggaattagataaggaaaataaaatcaaactaggggcaaatttcatgtataaaaatgtgtactgtgccatacattttgtaagcggagtctctaaagattgcttcataaggaagaagtgaataatgactttgggaacacttggtaacccctaggactcaaaagattgggtgtgagaagttattagtaagcatatgtattaggcaaaatacagtgagatgaacctggaacaaatgctcgctgaatgcacttagaaatattatcaggcgactcagcctatagagcatacgggttagaatgtctattttaagaaggagcggatatttactaaatgctaatttgagcaaagttctacaaaaatatcactgaccatgaatattcaggcattgacatgctacaaaatagcatatcgaaaagaacatctgttgccctaaagatggtttcctgcacagaacgtctccaaattttcagcattcataggctggccccgtttcttcttggttaacatttagaggcacgcctaaacttagaggaacacctctctaaaccaaggagacacttaaagagaaaaggagtaaagatggtgatgggcttataaagagcaatgtaatagtgtctttgaagcaaaagctaacttaatgaaaacgtggtcccaatttccttaaatctggatcaccgtacgacttctgtaatacttattatttccccagctggcaaataaactggagttcaagtgggaaaaaacaaggtattgttcagacttatgatttttggggtcaaagattctgagcaataacctattaaaaaacccagcttttgatttgagtatgtaagtaagtacatgggaggaacgtatggatctggagtggtggtaaatacagagcatgtttgcttcgcaaagcagattagctcatacttaataatagagtaaatctgttgggccatgactcaatgcacccaaattctctagattgctatgtctctactcgctaagccttcgggaacaacaagcacagaacttttagggtgctgtctcactgatgtcggcgttagctctggtagtccaggtcaagattataccaaagattcaggacttaaattcctgcagaatgtaagcccctttccaagttctctgctttactgtatcctgtttattttcaaactcaaatggaaaaaaacgaaacaaaaaccttgggcttcaagaggcatcctgccgcaaggcccagcgatgtgaattttcaacaaccgtctcaggcagatttcatgctgatggttcaggcactaaactttgaaaaacacagtatcacagagtagggatggtgatgtaagagtcatctgtaaaagctgtgctgttttggcagcctgggaggctaaggtttagtctaggcgactaaggtttagtccgggctgtattcacacccaaaacaactaaaaaagcggaggagtctttgagtcaatccctgaagctccggctaagaggaaactcgcccacgctccagggcagcgacgccggctccacctcagccacggctgtctcaagcttctcggggttttccgccggctccacccgagccacaagtctacaggactcctcggagctttccgccgggacgcaagacccaccgccagaggttggtacctcctagagaacagcgaagcgcatcccgagggccgccggccggaagcgccctccagacccgccccctgccctccggagccggaagctgggcatctgcagctggctcggcgcactccactgaccgtcccgacgatgctacgcgcgcccggctgcctcctccggacctccgtagcgcctgccgcggccctggctgcggcgctgctctcgtcgcttgcgcgctgctctcttctagagccgagggacccggtggcctcgtcgctcagcccctatttcggcaccaagactcgctacgaggatgtcaaccccgtgctattgtcgggccccgaggctccgtggcgggaccctgagctgctggaggggacctgcaccccggtgcagctggtcgccctcattcgccacggcacccgctaccccacggtcaaacagatccgcaagctgaggcagctgcacgggttgctgcaggcccgcgggtccagggatggcggggctagtagtaccggcagccgcgacctgggtgcagcgctggccgactggcctttgtggtacgcggactggatggacgggcagctagtagagaagggacggcaggatatgcgacagctggcgctgcgtctggcctcgctcttcccggcccttttcagccgtgagaactacggccgcctgcggctcatcaccagttccaagcaccgctgcatggatagcagcgccgccttcctgcaggggctgtggcagcactaccaccctggcttgccgccgccggacgtcgcaggtgaccccccgggcggcccgtgtgctgtcccggtcctcccacccgccctggatgctctcccgcctcccccagaccctgggcttttccgatgccccccagttctctttcctcttttcccaagccatcatccctcgggctacgtcctccctgtcgagggatattacagacttggctatctctttttccccttacacgtatgttcatttattaattcatcaggtgtaaattcagcaccttgtactcgctgcctgctttagtagagttggggatccaacaggaaaggggacagacgaggtctcccgcaatttttgcgctcccgttcccaaactgaattgccccttcgagcgccaacccatcccttcccccttccctggcgtctagtttcacaattgggcgcacgttttaaaaaacagaatctagaattttcttcctcgggctttgcttccgatactagtttttccttctttctttttttttttttttaaactcatcatctttttcagatgacagttttagacctacaccctgttttaggaacctgatctcaagcctttgtgtcctccttttttcttctgttttgttcatgtttttactgtagcgttcccatcgttgtagctgtggtccgtggtcacaagcagtaacaactcatttattccattaattacactttttcgaaatttgagaaatcatctagtaaggccccgttatttcacaggtgaagaacccgagcccaagagtatgccttcttaattgtctttctctaaggtctagtatccaagtcttctgttttcctagaatggttctttttctcttagaaaatgttgtaatagttacaaataataatgatagcatacacctcatgcctattgtatgccaggtatgcctcacatttattttacaaaatccttacaaccacaatctggagttgatagtattttccccttatctcaaagatgaggaaattgatacacgaacacattaaataatttgcccattttcatacagctagctgtggacccaggaaatctgattcagagcttgctttcttagccattatgctatactgcctccatttgtccaataacatacctaataagaataaaaacatgtaacatttttgtaccacagagatgagcaagcattaatagtttcttgatcacttttaaggccagaattgaagtgaggattattgtttagcttcaaagcccaagtgaaaaattagaagtaggctggtttgtaatttcttctgtagctgttgaacagtgaaaccatctgtaagggatttctccactgattctgtgtcatgttattgtgggtaattcagttagctgacttgtgtctaattacttgttgaactgtgtttttttttaaatatatactttttccattagcatgagtgaaaattcctcataaatctgttaaattaacagaatggtgaaagcagaacatattttaatataacacaatatctatagcgacttcctggaacaagtgaatttttgttctcagatggcattgcgaagactggcatttgactctcagtacagagccagggatgaaaatactacagttcagaataagcccactcctgaccgttttcagtgtcagatagcaaaccctttgcctagccactttattattctctatagacaatagttttgcctattatgtacatctggtcttttgagggagtctgctgaattagatttgtagttttgtagaaacagaacaatgcctttgtttttgtttaaagactagcaataattagatagtaacaaggataaaatacccagatgcacttgggaaattatattttagtgtacacagaaaaaaggtgacaaagttcgcttattttcctagtcaagatattttcttaagaattgcaatccagttgacaaagtgggcagaattatccatttcaagagaaacaaacatacatactgattttttttgcatacacatccaaagcccagataaaactatattcaattttctcatattttatgtacaaaaatgatatacttggtgttcttttcgtggtaaattgttggagaaatgattgaaaaatgtgtgttttgaatatgactgaaaaaaacgtaaagggcacaccagtagttgaagcatgattatgaatgcttctccaatacatatttgttgcccaattgggggcataatgtaatttattaaattttatatagaaagttatctggggcttcagttaaaagataaaccaattcacaggcccagcacagtgaagcacaggagacccaaaacatcagtgcgttttgtgctgctgtcagtagtttttgtccaaagcagaatctttgtaaagtaatacagagttgggaaggttaattgagaaaataaaatactctgtttagactttggcttagagtgaaaaaatagattccatatgttgaattctctctcaccttgtaagtagaaactttgctgatttttagtttgctttctaaagttttccgtgcctgacagaaacagtacttattaatgtatgatgcaatttcattgcgtagcatctctacaacacatttaatcttcaatctctatttctttagccttttctagctattctcatgcgttacagccattataaatggggaataattttaccccaagagtttcctgaccaatatgtgcttatttcagctgtgcggattagtaagatgttagtgttcctttttcacacttaacattttcaataatttgaaactgtcatttatgtcagtgatttacaaatacatataaatttttttctctttcagatatggagtttggacctccaacagttaatgataaactaatgagattttttgatcactgtgagaagtttttaactgaagtagaaaaaaatgctacagctctttatcacgtggaagccttcaaaactggaccagaaatgcagaacattttaaaaaaagttgcagctactttgcaagtgccagtaaatgatttaaatgcaggtaatatgtctgttgtcttttatttgaacttaacagtttaaataattttgaactgtgaaaatgaaaacataaggaaacagtcttttttaaagacccataattgatctacattaagaaaataatatgttctgggtcaaaaaaattgtataccttgtgcttactatttaccatttttagattcatattcttctttgagtgttatttaaattactgtacaagattctagttatattctggagtttttttgagggcagagtaatataaagcctcaactgtaggcattatttttaaaacaaattatcttttctgaatttccccctgataaagtgatacaaatggaaaaatcatataaattctttagcttttgaagcagttcaaaagtacctgttaatgtgtaagaggggtaagttttagaaagtgaaaagcaaagtactatgatgttttttgagttatatgtagcaatgctgagaagatgagcagtcatgtctatcataagttattgcagtggatgggctgactatgcaacttaccatccaaactggtgggacactttcgaaagtgaaagggaacactattaataattttgccaggaaagcaggtgggaaaccatggcacatggtcacctagcaatgggagattaagaaaataagatttttttctgttttctaggaatttatgttccatagggtagatgttgacaaagatacatgcaaagattgtagattacattatactctgaattaatttccaaaagactggaagtagatgttggggaaaaaatagattagaatttatcagtcacagggcctggatgctttataaggatcaaaaagaagatgcctagactagcatttgaaattgaattttttctctctctccaaactggcagtacattggcatcgcctgtggagctttaaaaattatttactttattgggaaataattcaaacacgaagataacaaaaaaggctaatgtggtgaacatccctatacccacaacttggttttactaaattttaactttgtgcttcagttacttgccttaaataaattgaggtctactggtccctttcctggatcccattcttcttcctttctcaccagtggtaattgttgtcatgaattgagcatttatattatcccatgccagttttatacataaatgggatattgttttgcagattttaaaacttttaagagtggtatcaaagtttataccagtccaaaattctatttttatgcaactttttgtttttgatgtaatgtttgcaattctagtcctacattttaaatgtatgtatttcattctacatctataccaatatctagccattattctgttagtaggcagttaggttgttgaaaaagattttttaaaactatgtttagtctctgaatgggcaagaattatgtattttactgatgaagtaactgacagcaacttctttttggaagcagtattaagtatagtggttaaaataatggattctggaattggactatttgcatttgaatcttgactctactatcctattgaataactatgatttttgacaagtttattaatgtctttatgccacagtttccttttctgtaaaatgaacatgggaattattcttgtcttataggattattgcaaagattatataagattaattcatacaaagcatttagtacctggcgcagtaattgcgcaataaatacttttgctatttaaatacccttttgtttacatagggggtgatgctatatgtattttcagtaacttactatttttacttaacaatatatttgtctctagacaaatatagaactgtctcattcttttaaatcctgtgttatttcatgggacatatgaatgactcgatttgtaagtcaatgctagttaaattgtttaacccatcatcgaattttactgctgtaagaggctgttgctaatgcagtccaaattctttttatagaaaccattttcctactgaagtttttcttagtttttaactctttcaggtaatgctacagtgaacattcttgtagtctgttttttacacttgagagtttatttgtaagataaaataggtgaggccgagtgccgtggcataacctataatcccagcactttgggaggccaaggtgggtggatcactggagcccaggagttcaagaccagccttggcaacatggtgaaaccctgcctctatcaaagacacaaaagttagccagtcttataacttggtctccaaataaataaatagatttctaaaaatgttttttaaagataaataggtgaaattgctgggttaacacacatgaatattttacatcttgacatatatttttaaattgttctctgaaggtgtagtaaaaatttatatccacagtatatgagaatgttcattttcccatatcttccaacagtagatattattagtcattttaattttcgccaatttgattaatgaaaaatagtatctagctttaatttgcagttctttgattacttctgaaagtgaacatattttcatgtttagtagccatttgcatttcttctaaaaattaccccttcataattttgttcattttctattgggttatttttgttttcttatgaatcacaaataccttttatgtattatggatatattaattatatcttttaattctgcctgacaaaggattcgccctttgcttgttgtatgttgctaatattttaatttcttgcttatctcttaggtttgttgatggtgcctttgattgcacagaagtttacatcttttacatagccatatctgtctcttcattatggcttctgagtgttgtattttgtctaggaatcctcccaccgcaagattattatgttttcctattgtcttccttttttgttgttttatttttttctcaggggagtggagggaaagggtctatttcgttttttaaatatttaaatttcttatccacctgaaatatttttgaggttctgaaagattgaccacgaaatcagaagggtcataacagataagtcagagctataacttaaataagatagtgtatctaacctctttactttgtaagtggggaaattgacactaaagagagcttacccaggataattagtggtaaagtcaggtctcagcctgtcttcatctgatgctttttctccctgtactctgaagagttttttggtgaattttttttttctggtaaactctcttccggtttaagaatataccatgtggactgacttcatagtttcagaattagagcttcgagtgtaaataagccaggtcctttcatcaaatgtacctggtacttacaagccactatattgtatcaggtattgagattataaaaccttttctttacgtaagcaaagttttgaatggcttttctgtatattcccaatgaaatacattttttttgtattatatactgcctcaggaattctttaaactcagaactagtgcaaaatgcatgtaacgccagttgatttttggtcccattttcctttaggaaaacaggaaaggcagtaaaattaaagaaaaatcaaagcaatggaggcaaccactgcagttgacttttttttctctctagcattaaatatcacccacttctcattgactagagagcagcagtgtttttatttactaacaaaggctactttttatagcccaagcattcattcccttatcacttctcttcaatacccatatgtatctcaaagtaatgtaatcagcaaattagcagtgtaaaaatgctagataacttattctgaaatccacttccgaaatcatttgagcagctaagtttgaaaaactcatgttggtaccaacatttctctctttagtgtgtgatttttccctttttgtgcttctcctccttggctgtctctcctttctccttccccctcacttaccttgcacttccttccctctccatctctgtagtcttctctctccttttatatcttttctgtacttactgctgcttcttagttataaaatgaattgtataatttaaactgtttaataaatgtactttgttatttgtaattttcaagtcgggtactaaaacctttataaccttagcccccctccttgaaccctctaaaattaacaaaatcatattaagttttatatagcaagtccttgggttatactttttgttgatattgctaggcaaatatgctcttaacaagtaattgcctgaggcaggaggattgcttgagcccaggaatccgagtttgcagtgagctgtgatcaccactgcactctagcctggacaacagagcaagaccctgtccaaaaaaaaaaggcagaaaaaagttaccaattacagaaaatttcttagttttattgggctgaaatttatacttcctcatggtttcttcctgatagttcagttctgcacccttaaattacacagagaaagtctcttaattctttgatagccaggaagaaactaaattatttcttccccaaactgaagatgtccattttattgagctgtaccacacatggcattctacagatatttagcctttgaaaaattgcagaaaataatgacccacaaaattttacctttttttccccccagatttaattcaagtagcctttttcacctgttcatttgacctggcaattaaaggtgttaaatctccttggtgtgatgtttttgacatagatgatgcaaaggtaagtattatttttgcagtttctttgcttttttaaaaaaattttttttggcttgcttgtttgcatttggttacttgaagcagcttttcagaaaatgagtagttagggaacataaactgttttgtgactaactcctaattttccttaaataaagagagattaaaggttcaaattggtcccacctacttgtaaatagtttaggttcaaaaaactctggaaacattttttccatgatgatttgatttctaaatcatcccatttacagacctacttttaacccatcatcaaattttactgcttggaagggattatagagctgatataatcccagattctttttatgggaagccaaagctcagagagaataaatgggtttccaaagtcctagcaactattttataacagttttcatgggaaattgtgttctgtgttttacagtgaacacttgtatgtccttcacctatatttaccagttaaccttttttgccacatttcctttatcactctctctactatattagtttcctattggtgctctaacaagttaccacaaacttactggcttaaaacaatataagtttattatcttatggttctggaggtcagaagttcaaattgaatcttacagggctgaaatcaaggtatcaatagagccgtatacaatagagccgtattctttcagggggctttaggagaacatctgtaccctgctttttctgatctccagaggctgcttgcatttcctatcactcagacttctgacgggtacatctccagctctaactgtccttcctgcctgcctctcgtaaggatacttgttgattacactgggcccacctagatagtccaggatttatctctccatctcgagattcataagttaatcacactggcagattcccttttatcaggtaaggtaacatattcataggatgtcagggattagaatgtggacatatgggagctgttttttctgtctaccgtgtgtatataatctttttttccccgccccaccatcaggatgcttcacccttaaatacttgggcatgcatctaggacaagaacattcttttgtataaccacaatacagaatactatagttcatatttatgtatatcatatatatcacaatattttctaatgtacagtcaactttcaaattttcacgtcttaagtcttttatagctgttttttgtttgctttgttttataagattcaggatctaataagggatcattcattgcatttggttgcatttcttttagtctcgtttaacctgaaagagtgctccagcctttcttttgtccttcgtacattggcgttttggaagagtctaggccaggttttttgcagaatgtttttggatgtgtctgatattttttactcaggattagattcagattaaacatttttgacaagagcactacgtaagtgatatatccttctcagtgcatcatatcagaaggactgatgtctgcttgtcatgtcattgattattattactatttttttgagacagtgtctctctctgttgcccaggctggagtgcagtggcgcaatctcagctaactgaaacctctgcctcccggattcaagtgattttcctgcctcagcctctccagtagctgggattacaggcgtgtgctaccatgcccaggtaatttttttatttttagtagagatggggtttcaccatgttagccaggctgatcttgaactcctgaccttaggtgatctgcccgcctgggccccccaaagtgctggtattacaggcatcagccaccactcctggccagtgatgtttgatcattagattacaatggtgcctgcctgatttctttattgtagaggtactttttttccttgtaaataaagaacttcttggccgggcgtggtggttcatgcctgtaatcccagcactttgggcggccaaggcgggtggatcacctgaggttaggagttcgagaccagcctggccaatgtggtgaaaccccgtccatactaaaaattaaaaaattagccaagcgtggtggtgcacacctgtgatcccagctactcgggaggctgaagcaggagaatcgcttgaacccaggaggtggaggttgcagtgagccaagattgtgccactgcattccagcctgggcaacaaagcaagactctgtctcagaaaaaaaaggaaaaaaggaaaaaaaagaacttctaatttaaatgactgtgacttgaaaatttaaatacatgtttattaaattaattgaataatagtttctttttacatgtgaaaagaaattaaattcttcttttaaaaattaaggttgtcttttgattgaggtattttctattatttacttcagcaatttgttagaaaataatttatccctgcttaggactttcactgtgaaataggtttatatgctgaagtatttacaggtgaaataaaatgatacctgggatttgcttcaaaataatacagtggtggtggtaggagcaaagctgaaatgggattggttgaatgttgattattgttgaagttggatgagtacacagaggttcgttatactactgttttatattttttatgtgtttaaagttctttgttaagaattttttttttttttttttttttttgagacagagtcttcctctgtcgcccaggctggagtgcagtggcccaatctcagctcactgcaacctctgcctcttgcgttcaagcagtcctcctgcctcagcctccccagtagctgggattacaggcatgtgccatcatgcctggctaatgtttgtatttttagtagagacggggtttcaccatgttggccaggtgaaaatacatgtattgtgtatttttgctttcaattttttctttattacagtagtttattgtttactaatttattttttccctaagaaacagtttagctttatctgtttttgaactttataatgatggaattactcagcgtgtgttttttttcttttggtatctagctcttgttcaacattaagtttttaagatttatttgggagctaaatggtgagaacacatggacagatagaggggaacaacatacactggggcctttcagagggcagaggatgggaagagagagaggatcaggaaaaataactaatgggcactaggattaataactgggtaatgaagtaatccatacaacaaactcccacgacacaagttaaaaaaaaagcttcccatttatagattgctacttagaaggcagggatttgaactgggaggaatttaaaatgatcttgacctgttgtgttgtgaaaaggtttacaaatttcaggaaaatatacctcttctcaaatggattgggaattatgaggtcacagacatttctcaggattccgtaaaacatgtacctgtagcagagtattagaggagattgaagcaaaggggcaagcggtaacttcttgggggcgattaagtcattgtattatcatggtgggggcaggttatacagttgtttatatttgtcgaaagtcatcagcctgtatatttaaatcatgtgtatgtaaattacaatttaataaagttttaaaaatgaaaaaagatttatgaggttgcatatagctacaatttttaattttcattactgtataatattccattatatgaatattttacagtttattcattatcttttcagtagacattgtttttagtttggggctattatgaaccttgttgctatgaacattattgtatatgtttattggggtacaggtatacctgtttctgaaggtgtatgtctggtagaattatcgattctcatgcttcagcctcctgagtagctgggaccacaggcatccgccaccacacctggctaatttttgtatttttagtagagacggggttttgccatgttggccaggctggtcttgaactcttgacctcaagggagccacttgcctcagcctcccaaactgttgggattacaggtgtgagccactgcacctggccttttttttttttttttgagacagagtcttgctctgtcacccaggctggagtacagaggcgtgatctcggctcactgcaagctccacctcccgggttcaagccattctgctgcctcagcctcccgagcagctgggattacaggcacccgccaccacacccggctaattttttgtgtttttagtagagacggggtttcaccctgttagccaggatggtctcgatctcctgacctcgcaatccgcctgtctcagcctcccaaagtgctgggattacaggcgtgagccaccgcacccggcccttttttttttttaaatataaagttttagtggtaagcatgtgagaattttttaaatctccagttgcctcctttttatttctaatagtagattttattatttgaatagattgaacagactattatctaattcctttttaaatttcttagtgtttacgtctctttgttaacttcttgatttcattgcctttgtgtaaggacagactctctcaagccgtgtttttcctttactctcacaccaccatcacaatcatcaacacagaagacttctgtgaccaaatgtgtgggagcctttcccctgcacgccaagcaggagacaccagctgggtgtcctccagttcagatttgacattgtctacctggaggtagtattagatcccacaggttgagggctcagtccccaagtgccccatcggtactcttctgttcagctggcttcaagttggcgttcccatgacctcttctttgggttcagttaatttgctgtagcagctcacagaactcaaggaaacacttttgctggtttattataaaggatgttacaaaggatacagatgaagagatgagtagggcgagatatgggggaaggggcgtggagcttccatgtcctccctgggcatgccaccctccaggaagctccacatgttcagctatctgtaagctctctaaacccagtcctcttgggtttttatggaagtattccttccccccaggatatgaggcaggaccctttcagggcaggatcttaagacccccagaaaggcaggaagattagagttctgcctccgcacaggtgaaagggaggcaggagagagattctgtttcctgaggcctgccctggaggcctaacacacccagcattataccaaaagactacaacaagggatatgggagttacaaaccaggaagtgtggacgaaagccaatatatacatatcataataccacaggtcagcccctggttttcgaagagggataccttacatcaaaagaatatatacaatcattaataatccagtccatcatctgtatgaatgtcttccagggcaaggccactcaggtttgccagcttcctttcaatcctgtcaggttccaaaaccaggagtggtcttggcaaatttatggcttcaccctttcatgcatctgtcatacttgagctaagagacagcgtcaccttttgctctgagccccgttcaaggcgttcatgtaatatgtcatttccttcaatttataacccgtttattcatcctttttccctcagctgttctccttttcttcattaataaatatctacactgctacctttggaagggacacaagttgccattgtgctgtgctagtctagattgtaggcagcaatgctagtgtagcaagtagctcctcctcacccctttaatgtattttttgttttgtttttatatatggcactgacccacccctgctcttaaaacttactatgacatgcacttagtttctctaggagctctttcgggaagaaaggtttgtgactattgtagtcatcttgaacctcttttgggttacatattttagtcccctagttgtggttttagctacaggttttagttctagatagagatttcagttctccacttctacatgagcaaatgatcaaatgatatgtaagtggaaaatttaaccctcagataaaggctacttaattaccagctcccggttccagacctttcagcagaggttaataactgtaatcagtgataggtaggtttcaaaccgttttctatacttttataatctgtatcattcttagaaatataaaaggtatagtgtgtgtgtgtgtgtgtgtgttggtaataaatggtattatagggtatgtattatttttaatgggttcttattcaacattgtgtcttggagatttttccatgtcagtacatggaaatctataatatagaactttttgataactgcaaagtattctgaagtatgtgtataccatagtttatttaaccatctacctactattggaatttagttgtttctggggattttttggcttctataagcagtgctactataagtcattcttgtacattctccctggtgttcctctgtgaatatcactttataagaaatggaattaaatgggtcatagggtatgtgtgttttcatggattttgccaatttgccctctagaatgtctataccaatatacattccttccaacagtacccatttccccatatccttggtacacttttattattattttttcaccaaacagatacatgaaccaaagtaactcattttctatttgacttctaccttctcaaaattcttatacatttctcatccacctatggtatctttctgtgctttaatgaatattcttcttctttattctttcttctaaatgtatccttgacatttagaagaaagaataaagaagaatattaatataatatcatcttaatataatgttagaagaaaggagaggtgagcacatgtccttactccactctcttgagctgtcctgaccttggatgattggctgtgagcacttactggcttgctcttgcacaccagcatctacattcccccaatccaaatttgtgatgcagcataaatctctctgtggtatgaaccttagggaccaactcttaaatgctggaaaggacaaatactatattttgtgcagaatggtaattaaacattgtaaccatttcttagagaatcattattaaatcagggaatcttgttatatttttgaaaatatattagaaattatttttgaatttttttaggtattagaatatttaaatgatctgaaacaatattggaaaagaggatatgggtatactattaacagtcgatccagctgcaccttgtttcaggatatctttcagcacttggacaaagcagttgaacagaaacaaaggtaagaactttctaaaaaatgtgaagtacattttgagttactactaaacttctggaaatttttttataatgagtaattttaaaaaatagtttttgcttgtgttttaaaaaaattttaatataatgtgatacaaaagaattcgataacatatatgtaaattataaaacatacgaaccttccactctacccaagaactagaatattcataataaattgcatttgtttacttatgtgttcctcaactattccattttcctgcctcctcttgcccttccctttcctccagaaactattctttggaattttgtattggtcattccttcgcctctttaaaacagtttatattatgaatgtattggtgcccaaagaatatatttagtttttcttggaatcatactgcttattgtcttttgggacttgctttgtttcccccctcaactttatgtttttaatattcaacatattattgcatatagctgtagttcattttcactgtagtacaatattcaataatgtgaatataccatctactcttgtcagtgggcatttagatagttcctatcttttgctgttataattagtgtaattatgaactctatgtggctcctgctatgaatgtgcaaaatgtttttgttttgaaagagaaaaagcttttgttaacatttataatcttcaattaaaaataatttttcatgacttgaacctttgatagaacctcaattccaggcttgtttcaaacttctgggctcaaggaatcctctcccgttggtctcccaaagtgttgggattacaggcatgagccactgcacccagctgagcacagagaactttgtaggtggtagaagttttcccaaactggattgtggtgattacacagacagctgtatacatttgttaagatatctaactctttaattaaaactgatgaatttcatggtagttatgcttcagtaaaacttaatctgagtatttaacaaaagtgtaaaaaaaaacggaatgaaataattttttggtaaaagtggaaaaattttttttaaagaagactccatttttctgaattagtaaagtttttttttacaaggcaacaccaaaatgcttatgacataattactgaaaatgttttaaaattattagatcacttccctgcattgatgcgcaatatattggaaaataattgaatttttttaattaaggattttacagtgtcatagggtcattattttttaaaacagtttgagaaataattcatatgtaggcatgtctcaaagatagtgcaagttcaattccagaccactgcaaaaaagtgaatatcacaatgaagggagtcacacaatttttttggtttcccggtgcatataaaagttatgtttatactataataagtgtgcaatagcattttgtcttaaaaaacaatacatacataccttaatttaaaaatgctttattactaggaaatgcccatgatcatctgagccttcagagagttgtaatctttttgcaggtgaagggttttgcctcaggtgttgaggctgctgactgatgagagtggtggttgctgaaggctggggtggctgtggcaatttattgtaaaagaaaatatcaatgaggtttgctgcatcagttgactctttctttcatgaaagatgtctctgtaacacatgatgccgtttaataacattttacccacagtagaacatattttaaaattggagtcaatcctctcaaagcctgtcactgctttgtcactgtcacaatcctttgttgtcatttcaacaatattcatagtatcttcaccaggcgtagatttcatctcaagaaaccactttgttcatccataagaagcaactcctcaggtgttcaagtttgatcatgatattgcagtaattcagtcacatctttgggcaccacttgtaattttcttgctatttccaccacatctgcagctacttcctatcatccatgagggttggaatcagcctcttccaaactcctggtaatgttgatattttgacctcctcccatgaattacaaatattcttaatggcatctagagtggtgaaacctttctgggaggtttccagtttacattcctcagatccattaaaggcatcactgtctatgacagctatagccttatgacatttatttcttaaataaataatatttctctgtcatatgaaatttctgttttttttttttgagacagagtctcgttctgtcacccaggctggagtgcagtggcgtgatctcggctcattgcaagctccgcctcctgggttcacgccattctcctgcctcagcctcccgagtagctgggactacaggcacctgccaccacacccagctaattttttttttttttgtatttttagtagagatggggtttcaccttgttagccaggatggtctcgatctcctgaccttggatccgcctgcctcggcctcccaagaaatttatttcttaaataatttatttcttaaatatttcttaaatttatttcttaattaatttcttaaaatttataatgaaatcaaaattactacttgatctatgggatgcagaatagattttgttttagcagacatgaaaacaacattaatttccttgtacatctccatcagagctcttggatgaccaagtgtattgtcaatgagcagtaatattttgaaaggaatctttctttctgagcaggaggtctcaatagtaggcttcaaagagccagtaagccatgctgtgtaaaaatagatgtgctgtcatccaggctttgttgttctatttatagagcacaggcagaatagatttagcataattcttacgggccctagaatttttggaatgaccagtgagtattggcttcaacttacagtcaggagctgcgttatctgctaacaagagagtcatcctatcctttgaagccagacattgatgttctagatggtatcttcttccaaaagaaggctgttttgtctacattgaaaatctgcttagtatagtgaccttcagttatcttagctagatcttctggatcacttgcagtttctacatcaggacttgctgcttcaacttacatttttgtgttatggagatagcttttttccttaaaccccatgagctaacctctgccagcttctaacttttcttttgcagcttccttacctcttagcttttctagaattgaggagagttagagccttgctgtggattaggctttggctaaggggaatgttgcagctgtttggatcttctaccagagcactgaaactttcttcctatcagcaataacattcttccactttcttatcatccatgtgttcactggagtagcacttttaatttcctccaagaacttttccttttcattcataacttggctaactgacccaagagacctagtttttggcctgtttcagcttaggacatgccttcctcactaagcttaatcatatctagcttttgagttaaagtgaaagatgtgtgagtcttgctttcatttgaacacttagaggccattgtaggattattaattgacgtaatttcagtattatatctcagggaatagggagactggaggagaggaaagaggatggagaatggctggtcggtggagcagtcagaacatatacaacatttatcagttaaatttaccatcttatatgggtggggttcatggcaccccaaaacaattacaaaagtaacataaaagatcactgatcacagatcaccataacagatataataatcatagtaataattaaaaaaactttgaaatattgtgtattactaaaatgtgatacattactaaaatgtgatacattactaaaatgtgatacacaaaatgagcacgtgctgttggaaaaattacacagatggccttgcttaactcaggattgccacaaaccttccatttgtggcaaaatgcagtatctacaaagcacaataaatcaaagcacaagatgaggtaatacctgtatcatatacagtttacctacttaaagtgcacaattcagtgttttagtatattcacagagttgcacaaccatcactactgcaactttagaacattttcatcgcctcaaaaagaaactctatatgctgtgccttagcagtcactctccattcaccctcactctgccatcccctggcaaccactaatatattttctgtctgcatgcattggcatattctggacatttcatataaatggaatgatataatatgtggttctttgtgacaggcttttatgatttagcatcatatttttaaggttcttccatgttgtacatgtagcagtagcatgtatcattctttttcatggctgaataatattcctttgtattactatatcatgtttttgttcatcttattttctttttttcaccttttttaaagttatacttcaagttctagggtacatgtgcacaatgtgcaggtttgttacatatgtatacatgtgccatgctggtgtgctgcacccattaactcgtcatttacgttaggtatatctcctaatgctatcctttccccctccccctaccccacgacaggcccacgccatgacaggtgtgtgatgtcccccatgctgtgtcaagtgctctcattgttcagttcccacctatgagtgaaaacatgcagtgcttggttttctgtccttgcgatagtttgctcagaatgatggtttccagcttcatccatgtgcctacaaaggacatgaactcatccttttttatggctgcatagtattccatggtgtataagtgccacattttcttaatccagtctatcattgatggacatgtgggttggttccaagtctttgctattgtgaatagtgccgcaataaacatacatgtgcatgtatctttatagcagcatgatttataatcctttgggtatatacccagtaatgggatggctgggtgaaatggtatttctagttctagatccttgaggaatcaccacactgtcttccacaatggttgaactagtttacagtccaaccaacagtgtaaaagtgttctcacatcctctccagcacctgttgtttcctgactttttaatgattgccattctgactggtgtgagatggtatctcattgtggttttgatttgcatttctctgatggccagtgatgatgagcattttttcatgtgtctgttggctgcataaatgtcttgttttgagaagtgtctgttcatatccacccactttttgatggggttgtttgattttttcttgtaaatttgtttaagttctttgtagattctggatattagccctttgtcagatgggtagattgtaaaaattttctcccattctgtaggttgcctgttcactctgatggtaggttcttttgccgtgcagaagctctttagtttaattagatcccatttgtcaattttggcttttgttgccattgcttttggtgttttaatcatgaagtccttgcccatgcctatgtcctgaatagtactgcctaggttttcttctagggtttttatggttttaagtctaacttttaagtctttaacccatcttgaattaatttttgtataaggtgtgaggaagggatccagtttcagctttctacatatggctagccagttttcccagcaccatttattaaatagggaatcctttccccatttcctgtttttgtcagatttgtcaaagatcagatggttgtagatgtgtggtattatttctgagggctctgttctgttccattggtctatatctttgttttggtaccagtaccatgctgttttggttactgtagacttgtagtgtagtttgaagtcaggtagcatgatgcctccagctttgttcttttggcttaggattgtcttggcaatgtgggctcttttttggttccatgcgaactttaaagtagttttttccaattctgtgaaaaaagtcattggtagcttaatgaggatggcattgaatctatacattaccttgggcagtatgaccattttcactatattgattcttcctatccatgagcatggaatgttcttccatttgtttgtgttctgttttatttccttgagcagtggtttgtagttctccttgaagaggtccttcacatccctacaattgtgaatgggagttcactcatgatttggctctatgttgagtaggagtggtgagagaaggcatccctgtcttgtgccagttttcaaagggaatgcttccagtttttgcccattcagtatgatattggttgtgggtttgtcataaatagcttttattattttgagatatgtcccatcaatacctagtttattgagagtttttagcatgaagggctgttgaattttgtcaaagcccttttctgcatctattgagataatcatgtggttttttcctttggttctgtttatatgatggattactgatttattgatttgcatatattgaaccagccttgcatcccagggatgaagccaacctgatcatggtggataagctcatcagggatattggtctaaaattctttttttttgttgtgtctctgccaggctttcaggatgatgctggcctcataaaatgagttagggaggattccctctttttcttttaactggaatagtttcagaaggaatggtaccagctcgtctttgtacctcttgtagaatttggctgtgaatccgtctggtcctggactttttttggttggtaggctattaattattgcctcaatttcagagcctgctattggtctattcagggattcaccttcttcctggtttagtcttgggagggtgtatgtgtccaggaatttgtccatttcttctagattttctagtttgtttgcgtagagatgtttatactattctctgatgatagttatatttctgtgggattggtggtgatatcccctttatcattttttattgtgtctatttgattcttctttcttttcttctttattagtcttgctagcagtctatcagttttgttgatcttttcaaaaacccacctcctagattcactgattttttttgaagggttttttgtgtctctatctccttcagttctgctctgatcttagctatatcttgccttctgctagcttttgaatgtgtttgctcttgtttctctagttcttttaattgtgatgttagggtgtcaattttagatctttcctgctttctcttgtgggcatttagtgctataaatttccctgtacaccctgctttaaatgtgtcccagagattctggtatgttgtgtctttgttctcattggtttcaaagaacatctttatttctgccttcatttcgttatgtacccagtagtcattcaggagcagtttgttcagtttccatgtagttgagcggttttgagtgagtttcttaatcctgagttctagtttgattgcactgtggtctgagagacagtttgttataatttctattcttttacatttgctgaggagtgctttacttccaactatgtggtcaattttggaataagtgtgatgtggtgctgagaagaatgtatattctgttgatttggggtggagagttctgtagatgtctattaggtctgcttggtgcagagctgagttcaattcctggatatccttgttaactttctgtttcgttgatctgtctgatgttgacagtggggtgttaaagtctcccgttattattgtgtgggagtctaagtctctttgtaggtctctaaggacttgctttatgaatctgggtgctcgtgtattgggtgcatatatatttgggatagttagctcttcttgttgaattgatccctctaccgttatgtaatggccttctttgtctcttttgatctttgctggtgtaaagtctgttttatcagagactaggattgcaacccctgcttttttttgttttccatttgcttggtagatcttccaccatccctttattttgagcctatgtgtgtctctgcacatgagttgtgtctcctgaatacagcacactgatgggtcttgactctttatccaatttgccagtctgtgtcttttaattggagcatttagcccatttacatttaaggttaatattgttatgtgtgaatttgatcgtgtcattatgatgttagctggttttttgctaattagttgatgcagtttcttcctagcctcgatggtctttacaatttggcttgtttttgcagtggctggtaccggttgttcctttccatgtttagtgcttccttcaggagctcttgtaaggcaggcctggtggtgacaaaatctttcagcatttgcttgtctgtaaaggattttatttctccttcacttatgaagcttagtttggctggatatgaaattctgggttgaaaattctttaagaaggtagaatattggcccccactctcttctggcttgtagagtttctgccaagagatccactgttagtctgatgggcttccctttgtgggtaacccgacctttctctctggctgcccttaacattttttccttcatttcaactttagtgaatctgacaattatgtgtcttggagttgctcttctcaaggagtatctttgtggcgttctctgtatttcctgaatttgagtgttggcctgccttgctaggttggggaagttctcctggataacatcctgaatagtgttttccaacttggttccattctccccatcactttcaggtacaccagtcagacgtagatttggtcttttcacatagtcccatatttcttggaggctttgttcatttctttttgttcttttttctctaaacttctcttctcgcttcatttcattcatttgatcttcaatcactgataccctttcttgcacttgattgaatcggctactgaagcttgtgcatgcatcacttagttctcgtgccatggttttcagctccatcaggtcatttaaggtcttctctaggctgtttattctagttaaccattcgtctaatcttttttcaaggtttttagcttcttcgtgatgggttcgaacatcctcctttagctcacagaagtttgttattaccaatcgtctgaagccttcttctctcaactcgtcaaagtcattctccgtccagctttgttccattgctggtgaggatctgtgtttctttggaggagaagaggtgctctgatttttagaatcttcagcttttctgttctggtttctccccatctttgtggtttcatctacctttggtctttgatgatggtgatgtacagatggggttttggtgtggatgtcctttctgtttgttagttttccttctaacagtcaggaccctcagcttcaggtctgctggagtttgctggaggtccactccagaccctgtttgcctgggtatcaccagcggaggctgcagaacagcaaatattgcagaatggcaaatgttgctgcctgatccttcctctggaagcttcgtctcagaggggatgggttgtcagtcggcccctactgggaggtgcccccccagttaggctacttgggggtcaaggaccctcttgaggaggcagtctgtccgttctcagatctcagactccgtgctgggagaaccagtactctcttcaaagctgtcagacagggacgtttaagtctgcagaagtttctgctgcattttgttcagctacgccctgcccccagaggtggagtctacagaggcaggcaggcctccttgagttgcagtgggctccacacagttcaagcttcctggcggctttgtttacctacccaagcctcagcaatggtggacgcccttcccctagcctcactgctgccttgcaattcgatttcaggctgctgtgctagcagtgagcgaggctctgtgggcatgggaccctccgagccaggcgcaggatataatctcctggtgtgccgtttgctaagaccattggaaaagtgcagtattaggatgggagtgtcctgattttccaggtactgtctgtcatggcttcctttggctaagaaagggaattccctgaccccgtgcgcttcccgggtgaggcgatgccccgtcctgcttcgtctcatgctccgtgggctacacccactgtctgacaagccctagtgggatgaacccgctacctcagttggaaatgcagaaatcacctgtcttctgcatggctcacactgggagctgtagactggagctgttcttggaacctcctcctcatcatcttgcttattttcttataatttgcttatctcacctacaaataaattacagagggaaaaatgcaactaattgagcactccatttttggtagctagtagctgatggtattttaataaactgagaagctaatgaggtgaattttcatgcatggcttgtagtagcaggtgcagttctgtggtgtagaggcaatatgacatagtaggcagatgcttggatttggtttgactcctggtcctgctttatggatgctgcagattccttactttggaaaagaggaatgaagaatgcctagccctaatgtgaaaattcaaaatactccaaactccaaaactttttgagtgcggatgtgatgcagcaagtcaaaaattccacacctgacctcctgtgatgggttgtagttgaaacttttaaaattatttaaaatatcgtataaaactaccttcatgctatgtatgtaaggtgtatatggaacataaatgaatttcatgtctagacttgggtcccatccccaagattatatatatgaaaatatttcaaaatctgaaaaaatttgaaatccaaaagatttatggtcacgaacattttggataaggaatactcaacctatacctcacctgactcatggaattgtgataatcaagtgagataatacttattaaagcacttagtataatatgatatacagacatggtattggtattatatgtgatagttctctggcccaaacatgtccttaatgtctttttcagatattcacacacccttcccctctaccacccctgccccccttggcaattgtccaaataatgaaaacaagagctttgtgagacttattcttttcaaactttatggcgtcatttattaaactaacttccttttcattgcaagatggaaaacatttttacttcttttggatgattatgccttgtggcttgaaaggaaaattcattcaacaaagcagctactatgtttatatgtcaggcagtgatgactgaggcaaagtcattgcactgtggctcttacagtctagagaaaataaaaacattttataaaagccatgtataatgatataactgtttatgtaagattgtgaaacaatgtaagaagttgaaagagagagtttgaccctttaagacaggaaatcgttttggccaccgcctcttgttctaactgaagaaggaatcaacaaacactgctcagcagtgagcgatgatgaagaaactggcagatggtttcctgggactgggtatctctgtactaaaagactgatgaggattttaaaagatgcttattttgctgaattaagattaaaccttaaaataggaaaggagaataaagtacggtttgagacttctgtcaggtttctctcctaaaaacagattgactagtgctgtgagaagcacttctaaagaaaatcaatatatgctcagcaaggagcaagtaagttgttttttgtttgtttgtttttaactaatggacttttaaaagtaattttaggttcacagcaaaattgagtagaaagtacagagagttcctacttactgcttttctccacacattgacagtcaggcaccagtgtggtagaataataagcttttaatagaatgtttatctttgtgtttttcctgatctcttctatcaaaacattagccttttttttttttgtacatgacttaaaatcctttttttaaatttggaattagagtttataagtgagtattttgacatccatattttctgacaaaatgactttcactttcccaagttcccaggctatttttgctttctccatcccacccctaccccttgttagaatgttagtatgtatacagattggttttttttaatattaacattaaatcagggacattcttcagtgccactgaatttttttttcaacataattttgatagcatggttttacttcatggaaaaaatggaagattgcaaattgttaaattttcagttaaatataaccggcccttgaaattcagctccttgcattttattaggaacttgatttttattttcctttttgcaccatcactatagtaatgggattaaagttaaaaccagcaaatttaagcagatatttctatttaagcagatatttctatttaagcagctgtgattagaaaagcagattgaattcactgaagaaatgaagtatctccagattttattttactgtctccttccccatatatctgttaatataatctttttagattcgaggatttcaacaagttacttcatgttttctcaaagatttattttgggtctataattacttgcctcgagatcttccattttaagttaattactataaaatattttttactgttactaaatacctcaactctcagtgttaaccttttttttctacctttttgttgggtttcaaatcattgatattttcagatttcatagtctataaggtatggctttttaaagctgtgtagtcccatattttaacgtaagatggcagcattgagataaatgtgtagtgacaccaagtgattttagttatttggtcaattagcccattgtaacaggggaaacttgctgctttaaagttcttagaaatgtacgccaattctaggtgtttttgccaactttttgaagtcacagttccatggagtttagccaggggtatcaggaatcttttcagtgctaggaatctctgtagtgttgaaagatactggctaaatattttttttttttttttttttttttttggagacagagtctcgctctatcccccaggctggagtgcagtgacatcgtctcggctcactgcaacctctacctcccaggttcaagtgattctcatgcctcagcctcccaagtagctgggattacaggcacctgccaccatgcccagctaatttttatatttttagtagagagacagggtttcgccatgttggccaggctggtcttgaactcctaacctcaggtggtctgcctgccttggcctcccacagtgctgggattacaggattacaggggtgagccacagtgcccggccacatactggctaaatattaataagtaaaagtttatataactagcctggctgtactctgaattcatattcaaatgtccagctgccttttgaatagacactttttgactatcactagattgtaggtctactaagtagttattcattatttctgcacaattattttacctttgtacatttttttttaaaactattcttgttgaattgtatccagttttgtaagaatcactcttaaatctgttgtcatatctattcttgtcatagttggagagtatacctactctgtgctgaccccaacagtagaaccggaaggcaaatcttgtttcagttactattttaaaaaaagaaacctcacacacacaaaaccccacaactttttaataactgttaaataagtagaataggctgttttgtgaagtagtaagtgtcctattttagaaatatgctagttgaatctggataactgtgtcagagattctatggaagaaatgcttctaccacctaagaggttaggaaattatttcatggctccataactaaaggctcagttcatttcaattcagcaagcagtttttgagcacatacaatgtgtggtcacaatgctaggcattgggaatacataaacatggataagaagttatacccgctacatccaaggggctctcagtctagtaaggaagatgtcttaagaaagtaatttagtcaaaagcgaaaggatgcttgggaaagtaagtcatctctgcagttcatggtagttggaaatggcttctgtgtggatgtaagatgtaaggtgagccttaatcattgacactgtagtgtaatggaatttgcattggcataggattattaaaactcaaatccttgttcagcgtttcctaaccaaaattttgtcatctttaaaattcaggtaatactcatgtttcaaggtgttgagaaggttgagtggagttctgtgttcatgtatgtctgtgtaccacacaaatacatgtaaagacacatttatcttttactactatgctttacacaattaagtattttattaattgttattaataccatcatgacaatcattccaggcaaaatttggctagagaagaataaggaagacatcaaggaagaagagtattgagcaaaggcctatgtgggaatgaaaatgtaaaatgcccaagttaatttgatggtttgagttagacagtgttgggaaataagctgttagggtgttatctatgccagagaaaaacagtatactttacctgtcatctagatgctgatttaaaaattttcctggcctggcgtggtggctcagacctgtaatcccagcactttgggaggccaaggcaggaggatcgcttgagcccaggagtttgagaccagcgtgggcaacaggggtaatccctacctctacaaaagaaaaaaaaaattagccaggcgtggtggcatgtgcctgtagtcccagctactcacgaggctgaggtgggaggatcacctgagccagggagctcgagtctagggtgagccgtgatcatgccactgtactccagcttgggcaacagagcaagaccctgtctctaaataaataaataaataaattaagattgttcctatttctgctttagttatttgtgttaattttaaataagttccatgtattctgaggtttacacttaaacatctctctccttaattagaacatagacaagtaaagtctattgttatttttcaagaatatttggacaaatctattgaaataaatatacagcgttttccaggttatctttgataacccactatgttcaggttatttggctggcaacagagggtatatacaaagatgaatgcattgaaattgtctccaaactcaaagtttagagaacacttataatagcactaaaacagataaaaacaaaattactgagagagaattaatttgaactctttggggtttggtaaaggctttatgaggagtctttgaagtaggctaccaaagacttttctttcactaatctcagcatatcagctcttagtaattgttttgatgtgttttttaataactcgattgaggtataattcatgtaaactgtacatatttaaagtgtacaatttggtcagtttttacatatatatatacgcccatgaaaccatcaccataatcaagataaaatatccatcacatccaagtttctttgtgaccctttctaattcactttctacccccattttcaggtaacactgatacactttctgtcactatacattaagttgtattttctaggattttatataatggaatcatagtgaatttttttttgttgggcttctttcactcaacatagtgattgtaagattcatctgtgttgctgatgaatctaatagttcattcctttttaagaccaagtagtattctgttacatagatccaccaccatttgttcaccttttgatgaacatttggttattcacagttttaaggctattgcaaataatgcttctgaatatttgtgatctttgtatgttatgatttgatttcttgggaacctacctaattagatggaatggttgagtcttaagtaggtgtatttttcacttttttttttttgagacagagtcttactctgttggccaggctagagtgcagcggcacgatcttggctcacttcagcctctgtctcgtgggctcaagcagttctcctggctcagcctcccaagaagctgggattacaggcatgtgccaccacgcccagataatttttgtatttttagtagagatggggtttcatcatgttggccagactggtctcgaactcctgacctcagataatccacccacctcagcctcccaaagtgctgggattacaggcatgagccaccgtgcccggccgtctttttcactttttaagaaactgccaaacttttcccaccaatgtatgagagtttcagttgttccacatcctgccaacgcttcatatggcaggtctttttaattttaaccattctaatgggtgtgtagtagtactttgttgtggttttagtttgcattttcataatgattagtgatactgagcatcttttcatgtgcttatttacatctatatatctagtttggtgaagtctttattttgtgtgctttttaattgggttatctttattactgtttgtgtgtgtgtgtgtgtgtgtgtgtgtgtgtgtgtgtgttgtctaggtacaagtcctttgtcagatttatgctctataggaatatattctcttagtctatggtttgcctttcttaaaaaatatatatatattaatggactgattttgccccattattgaggcatttcaccctgagtatttatatgtaccctgtgtattttgaggttttcccactctggcttatgtgaaaactattctgtttttttgtgttagctttgggaattttttttctttttttagacggggtctcactctgttacccaggccagagaacagtggtgcgatcatagctcactacagcctcaacctcccaggctcaggcaatcctcccacctcagcttcccaagtagctgcgactacatgcatataccaccatgcctggctaatccttaaaaaatttttaatacatggaacttatttttatttatttatttatttttatttttttctcactgtgttgcccaggctggtctcctggtgggctcaagcagtccttcccctctgcttctggagtcactgggattatagataggagtaatctgtaattagctctgctaattttttttttttttttacctattccttttcaatgttttttctccgggatttggatagttttctcatacgcatgtgctgttcagtgccagctgaaaatttgagggagcccctgctggtctgcagcactctcttctcaggtactcctgctgtgaattcagccagtgtggcctccctaaattctcactcccatctcagctgctcagggcgacttcccgagctgtttgggcatcccctccctgtgccatagtctggaaactcggcagtaagctggggcagttgttggagtcacctcctttgccttccttttcttataactattgttgagtgtctgaaactttgtatgttttgttcagctttctggtactttaaggtaggacagtaaatctggtccctattactccgtcttgactggaagtggaaactgtttcagtgtatttttgcttgaggaagaaaaatgtcatacttgagtcattttagttcttgatttatgttaagctgttggattggtgcttctccaaatactcactggaactgatgtttcaattagatgtggaagacttaacaacaaatttttttctggtaattttcttcccaaagcatctggcagttcatgttgcttatttgtatacttacataaatatgggaattatatgagttgtgtaaagctgtatttgatattcctggatcatgtttaaaaacatactttgcataacatcaattgagtgtgaaacgtgaattaagagcttagaaagatctagctgagtacatttggggggaaaacatgcaattattagttgttttttctggttgagctttttgaataacttgaagtagttgctttgtatcctttatctactttgaacacacacatagttatcaaccctcattaaaagacaggattttagacttaaactttgtttttggttgaagacataataaaatctcctcaccaatttctgtaagtaaaaggaggggtgtaatttggagaactgcagtaatcctcttaaccattttcacgctgttattcctaaaataagaagggttgaccagatctcaaacctaaaacattatgattctgtatatttctatccagacatttatatagattactcatttgctttcatatatttgtattaatagtttacattttcaagcaaaatatgtatcttttcaagtggttttgtcactttttggaaaatgcaacattccaagtttaatgcatttttatcaaggagagagcagagttaaaggtgtaattccttttctttgggatacttctgccaagagtctcaaagaaagaatagtcattacaatgtaatgggggatgtaagttaatttgagaactatgactagttggatcagaatgcagagcatctgaatttttcttaatttggtgttaaatattcattctacttagacattttaaatatagtattaggacaaaattatcagacatttgtggaatatatatgactttggggatataaaccaatatgggacagaattatagacacattattcctcaggatgtcacattgtaatatatagcacggggattcttggggtatagagtctgaaatcccaaaactatatttaagtttttatggaccacatgcctttctttagtacgaagttccattttcttagattctcagatggtttcatgtcctttgtgaaagttaagaaccacagatgcagtgaggattgagtgattgctttggcagccctcctttaaaaaacatttacctcttcctgtattttttgcttgtttgtttgttttgagacaaggtcttactctgacaccctggagtgcagtggcgtaatcatggcttattgcatcctcgacttcctgggctcaagtgatcctcatacctcagcctcccaagtagctgggactacaggcatgcgccacagcgcctggctaattttgtggggagttttcgtagacacaaggtctctccatgtttcccaggctagtctcaaactcctgggctcaagcagttctcccatctgagcctcccaaagtgctgggattacaggcgtgagccaccatgcccagcttattcttctgttaaaggaaaaacttggtcctttctgtcatggtatcctgaacctcaccactctgtttattgaatggtagtgacaaagccacatgagaccatagataaaatatagcaatctttatgctcttagcaatcttatgacaaaatacatgcaagaggttttatataagaagagcataattatgagtataaactgagaaggaattcgtttcacatttgttgtgttttttgccctcctatacctacatgcctatgtttctctctctttctcctctctgtcagtctctctcctctctctgtctctgtctctgtctctctctctgtcacacacacacacacacacacacacacacactttcttactccctcattcagacatatacacatgctcatacccatttattgttgccagtattttgggcttgttcatagaccagctttggtttgttggagaaggttggaagtgaaaccagaaaagttgtcataccatctttgtgattttggtgtattcaaagagaaactggagatttggttccttcaaatagtgattgggcatatactaactggagttcctaggagatggtttaagaaccagattggactcttttaagattaactctaaattgtgacacagggcaaagagcagcatgttcatagacttggaaccaaatcacttcttcatagaaattagtgatttactttatacagtcctggcatatacctttaatggcttctggtaaaaattggatcataaataaatacttttgtgaatttgtttttcggtgtttaaaagttataaaaacaaacaaaccctactgtatgtgcacacacacaaactccacagctgtctcagcttccaccagttgaaggtatccaagtctccatttttggtgtctgtatacttgcaatagaaacataatttgtttttccatttgacactatgctacttaactttgtcaaagaaaatagaaatgtgagtaatccttataaatgggcaaacacagctatttaagaaggattatatattagctctttggaagctcttttggtcatagataattacctggaggcagttgtttttttatatacccgagtttgatattttgccagttgagtttcaaacaatgaagtagaaatttgtttatatattgcttagtcattcttgttcataagaagagcattctgaaattcttaactatgaatgggaccttgatttgaaccatatagtttaaaatgcctgaaaaattattggctaagtcctcttgaattttatacctcatgattatgagttagatgttttacttattccttctttgggagttgtttggaaaaaactcaaaccctgtttttcctctgccttcacaccaacacaacaatagtcaacacaacttctgcgttagtccattcttgcattgctataaagaaatacctgaggctggggaagagacacttaattggctcacagttctgcaggttgtaaaagcatggctccagcatctgcttctgatgagggcctcaggaagcttacagtcatggtggaagagaaagggagccagtgtaccacatggtgagagcaggagcgaaagcgagagaaggaagaggtcccaggcttctttacacaaccaaatctcatatgaactaactgagcaagaactgacttgtcaccaaggggatgatgctaaaccatttgagagggatcctcccccatgtcccagtctcttcccaccaggccctacctccaatgttgggaatcacgtttcaacatgagattgggaggggacaaacatccaaaccatatcattccaaccctggccccctaaatctcatatccccacatttcaaaatacagtcatgccttcacaatagttccccaagtcttaactcattccagcattaactcaaaagtcccaagtctgaagtctacaaagtctcatctggagatgagtttcttccacctgtgatcctgtgagatcagaaatgagttatttactcccaagatacagtggtagtacagacatttggtatacctcctattccaaaagggagaaatcagccaaaagaaaggggcagtaggctctgtgcaaatctgaaaccagcagggcagttgttaaatctttttttctttttctttttctctctctctctctttttttttttaaacagagtctcactctcttggcccaggctgcatgatcacagctcactgcagccttgacctctctggcacaagccatcctcccacctcaccctcccaggtagctaggacctcaggagtgcaccaccatgcctggctaatttttgtatttttagtagagaccggattccgccatgttggccaggttggtcttaacctcctgagctcaagtgatctgcccacctcagcctcccaaagtgctaggattacaggtgtgacccactctgccaagccagtctttaaatcttaaagcttcaaaacagtttccttcttgccatgtgaaacctgcttcccccttgccttccgtcatgattgtaagcctcctgaggccctccccagaagcagatgctagagccacgcttcctgtacagcctgcagaaccgtaagccaaaatacacttgttttctttataaattacccagtctcaggtatttctttatagcattgcagaaacggactaacacaaaattggtaccaaggcatggggcactgctataaagatacctgaagatgtggaagtagctttggaactgggtaaaaggcaaaggctggaagagtttggagggcaaagaagacaggaagatgaagaaaaatttggaacttctgagagactggttaaatggttgtgaacaaaatgctgatagcgatatgaacagtgaagtctaggctgatgaggttccagatggaagtgaggatgttattgggaactagagcaaatgttacccctgtcacatcctagcaaagaacctggctgtactgtgtgccctagggataccctcatcagtttttcctcattcaagatgtggcctggctgcttctaacagcctatgatctaatatgggagcaaagaaatgacttaaagttagaacttatatacaaaagggaagcagagtgtaaaagtttggaaaattttcagtcaagccatgtggtagagaaagaaaaagtattttcaggagaagaatcctagcaggctgtggagcaaccacctgaaaaagaggttatcatggccagggcacagtagctcatgcctgttaattccagaactttgggaggtcaaggaaggaggatcacttgggcccaggagttcaagaccactctgggcaagaaagtgagacctcatctctacaaaaaataaaataattagctgggtgtggtggtgcatgcctgtagtcccagctactcaggggcagaggcgggaggactgtttgagtctgaggggtcaaggttgcagtgagctatgatcactaaaatgagtttggtcatttctaagacactggattataagacatattaaaagaagatgttttaagttagtattatgtccaggtaaggtttcttaaaaataaattttttaaaaagaaaacaaagttagttttatgagagaagggggaggccccagactcttaaacaaccagatttcatgtgaactgagaagtcactcatcaccaaggggatggcactaagccattcaagagggatccatccccatgattcagtacctcccactaggtcccgccttcaacattggggatcacttttcagcatgagatttggaggagacaaacatccaaactatatcaacttctgtgacccagtgttgggggatgggggttccccaccaataagcagcagacaccagctaggtatcctctaattttgacactatctgcctggatgtagcatcagatcttacaagttgaggactcaatccccaagattgccccctgcccttttcagacaccagtcataagtctgggcctctggaacacctgactgactggcttcaagttggggttttcacagccccctctttgggttcacttaatttccaggagtggctcacagagctcaggaaaacatgtttaccagtttagtataaaatattacagaggatacaaatgacacataaaatgaggtatgggggaaaggatgtggagcttccatgccctcccagggccacaccgccctccaggaacctccacattttcagctgtccataagctctccaaaccctgtcctcttgggttcttatggaggcctcattacttagacatgattaattaaactattggccattggtgatcaacttgaccttcagcccctcttgctcttccctgaggttgagggatgggcttgaaaatgctaaccctgtaatcatgcctttgcctttttgctgaccagctccatcctgaagctatcaatcaacatgagcatgcaaaaagacagcactttggagatttcaaggattttaggagttttgtaccaggaaacaggaacaaagaccaaatatatattatatttcacaatatcattggaaccttaagaaagaagcctctctcctttcttacggagcctagaggaataaagataataataaagattactttatttatgaatagtaatactttacaaagtaatctttattatctttattctagtttgcccttgaaccattaaaggttactaagttgaattcaggctgagaaaaacaaaatagcaaagaaaaacatttatgtttgagattttagtgatttatattctgagatgttatgtaatggaaatacttttgagataaagcaaaaaatacttaacattcttttagttgttgcaacttatttaagagtgtgtgtaattcttacccttgaaacctcaacctagacatttagtgaattctgtttttgaaatgggaaaatcaagaataaagtcagattttaaaaattgtataaaacatgtagttgctaaaatgtaattttaagtcctccttagggtttcagttttatgaaccctatgtcctccttaaggtttcaggaaacctccttagggtttcatgttgatagcatattatatgaattattatggcagttttttctattttataagttgtttttctctgagataaaatttctctaagtgggatttttaatattcaagctttcttgactttttttttaaaaaagacataaaccaaaccaagtatattcttacctgtatctagtaaagatttgtgtacatacatttaggagtgatttatacatatgtcttgaagtgataatttgttttaggtgattatatgttttatacatgtttgtgttatacttcaccagtagtgatattgtcaagcaaaaaaaaatatgcagcatcataaaattaactttgttttctttttaaaaaatttattcttaagaaaccttacctggacataatactaacttaaaatatcttcttttaatatgtcttataatccagtgtcttagaaatgaccaaactcattttagttatatctaggaaatcaaaggtaaagatggagagattggcaaggagaggaggttcatgaattgagagtagaatgtgtaagaagcatgaaatagatcacatcgagtctggatacaacctcagaatccttctcaatgcagtgttccaaatagctattaattactgattggagatttggcccagatactggttttatgactaaaagttgtcatttattgacatattctctttcttctaagcaagagtaaaaatttagatgcatacacccttgtctttgttcatctgcttagaggcttacatcattagtgatcatgtcgtggggcaaaattgggattcagccccagaggccacatggttcttggcttcacggaggcaagaattcaagagtgagccaaaagactagagcgaaagcaagtttattaaaaagtaaaggaataaaagggaggctgccacataggcagagtagccttgagggctgctggttggctattttttatggttattaataaataatagcataaattaatcgtatgctaaacaaggagtggattattcatgagttttctgggaaagggtagggaattgtcaggaccaagagttccttccctttttagaccttatagggtaacttccaggagttgccgtggcatctgtaaactgtcacggcacagatgggagtgtcttttagcatgctagtgtattctagttagcacataatgagcagtgaggatcattgaggatgagcagaggtcactgtctttgccctcttgattctggctggttgtggctggcttctttaccacatcctgttttatcagcagggtccttgtgacctgtgtcttgagaaacacgttctgccgaattatctcaatcagctttttatagaactgtgcttttcactgaatatttttttcttattgcacgttcatttcagatgaaaaacctgagaaatgtggtcttcgcctttgcgttggaaaagaattgatgccttatttaagaaacaatcagctaggtgtggtggttcacacctatgatcccagcactttgggaggccgaggtgagagcatcacttggggccaggagttcaagaccagcttgggcaacaagctaagaccccgtttctacaaaaaaaaactttaaaatgagttgggcatggtggtgcactcctgtggtcctagttacttgggaggcctacgtgggaagagtgcttgagcccaggaggtcgaggctgcagtgagccatgatcacaccactgtattccagcctgggtgacagagcgagctcctgtatctttaaacaaaaacaaggaaaaaaatatcatttaaaaaaaattttgtgggattttacatgtgcttttgccaaattgcatgttgctgaagagtgttactaagcactgacaacagagtcttcctcagtcattatgttgaaatactatgtttcttcccacaaataagaactgatttgattttaaattattattattttttttccaagacagattcttgctctgtcacccgggctagagtgcagtgacgtgatcttggctcactgtgaccactgccccctgggtcaagtgattcttctgccttgggcttctgagtagcttggactacagtcatgtgccaccacacccagctagtttttttgtatatttgatagagatgggattttactaggttggcccacctgttctcaaactcttggcctcaagagatctgcccatggcctccctaagtgctgggattacttgattttaaatgattttaatcagcaatggtttgaaagtaaatttaagtgactaagaagtgactaagttcctaaattatttactctactcctcataaacaagtattttcttataaaaggcattaaggtttttccaagtaaaattttttggtataaattgtttccatacaatttaatttatggtatacctgtggttttgcttttgcatttggatctttagcacttttggatatctgatgaattttaacatatgctattcaatgaaatgagtttgttacttgataccgtgtttacctttagaataaagtgttaggtactaatattttaggagaactgacttgaactcatctcctggattctaaactcagcacaccactaatttgtgtgctgggtcacttcactgctagaactgctgtggcttttgctgccactgtggctgtttgctatcacagattgattgatggctctgtggcaaacactaccatagagccatcgatcaatatgtgatagcaaatatgtgagtatttttctgtagctcaaatccaacagctttgcaagggaagtagcttatcttcatttggcaggaatgaagcctgagagagattgagtcatttgccctaaaatttgctcataaccaagttatgccctgtagttttcaagcttcttagtttttccctctctaaaagggtatgacagaacctgtatcatagagtaagcaattactttgctaaggctacacagagcagcatttctgttttaagacttagtaggagtgtattcatgacccagctcaaacaccacctcctcagcaaagcgcattcaattcttccttagtcacaaggatttgttctctgggtttctctaacagacacatgcgaatctgaaagagccagaaatgtttcatttgtgtttttgttcttttatcccactattcttctcccctcccctccccctccaagaagaaactagcatggtgcctggcacttggcatgaaatgacagagcctgtcacatctaacaaattaaccaaatgggtcttttgaaaagtctcttctttattacgttttggaaaactgagtgcagcttatttgcccaggggcttttgtatgaatatgagcatcatcagctagcggctttttcttgagtagcaagctatgttaagtcacaaagggtaaaagtaaaaaaataattattatgaatgaaattgtgctcttttttaatactttccattatcacaaacttaaaatatttatacttggttattgtaaaaatatataaattataaaaataaaattataagtgtattattccctataggcacatttcaatttctaagcaaaatcttgtttttgcttttaatggctctactttttttaaactattacccttgtcttattattgttttactagtgcatttaactagacctttaagatattgggggtttttggtgtgtttcaaatttgtataatagacattgctctatgtaagaagataatcaatacttacggactttataaaaagttagcacttttccttcctattgaaaattgtctggaattctaaaatacaattttaaaacaaattggattcatcaaatggtagaagacagtaatttatttttgatgggatggtttactgtgagaatctaatatataaacttccttgatttcccataaaacttccagtaagcatttttaagtataattttcctcaaatttcttctgaagaattcactgattttaacatatcactgacagtaaggcagtaaaaaaaggggggaaggtgtttactgccttttgtataaacccaaggaaccttgaaatttacaacttaaatttgagtcacagtctagatttcatttcttctgtagcttgaatgcaattaatagaactttgaactcataatttgtgcatagctcttttggtctctttccttcccccaatttatagttttcatgtgtgtgtttttatttgtcttgtatcttttctcctatttgctatttatttgattaacttttgaatctaagtatgtaagactgtccataccactgtctgtcctgtgctctccaacacagtagccaccagcaacatgtgattgtttggtgcttaaaaagcagctggtctgagcgaagctgtccatactgtaaattatgcactggatctcagacacttggtagaaaaaagaatgtaaagtttactaatggcgtataaattacttgctgaaatgacaatagtttggatatattgtcatatcttgtccccagtttattagagttcttctgtgggggaaagaggagagagttactgacagtaaattcttctggttagacagtggaggtgttgctgctgttgctgctatcctccctgacctgttttgtgtgctaatagattccatggagagcaataactgaaagttgaatttaggattgcttctggctttgaggtttctgcctaatggctaaaggatttaaaatgtaaaccagtatatttatattacttgtttttcttttaacttgtatccttattaaatttcattatttagatggtgacagtagtgttagtttagacttgaatatactcagatgtataaaggggccaggcaagtaacaaaggaatgaattcatcctatgttagacaatgtggaatgatacatgtgctgtgtaacaagtatatgccctctctacagggtgggtaaccttattcctgtttagctgattatggtcttacgggtatatatggacttgtgttgccagatctttcagatttctaagaagagcaaaaatctggatttttaagaatcttaaacctctcaatttttaaatactgataagtaatgtaaaatttaaaaatacttatgctggtcaaactaaatatggctgtgttctgaatgctaccgcttggtaacttcagacctaagagattgcttcttggaaataaatacaggttttaggtattttagatgacctaattaaagtataccagttatgaagagaggcttggtaagcgcctgttgatgaatggcttttaagttttacaccttttagagaatattaatctgaaagtagtgaataattgtcttttagtttgttttgaaatactgttaacagtttcagtgtactttttgagtatatatttctagcatactcttatatatggaagttattctgctccttattttttcttacacgcttttctgtagttattttgatatgaattgttttcctgaacatttagaaaaaggtttgtgtcagattgcttgtctcatctcacagagcccccccgttctggtgtgtgtactgttcagaagtatgatgggttgttttctgagatttcctggctctgttcccctccccccactttcatctagacttactttttcctttatctcttctgtccctctcctgcttggctgaaattccactcccagcagtttctctagtgtgagccctgtgtttggagagttcacaggagctccaggattctctagccccgggcctcactgtaggcctgccttgcactcaccaagtcctggagaggactaaatacttcccaatttcagctgctatatccagttcacacacagcgcttccagtgaatacctgtgggctgtttgggattctcttgttctcagattgctcagatgctctgtggcttctctctgctttcttcaacagatactgataatatctagtgcttgaggttggatgctacttggagtggttcatagagaatacttttccacctagttatgttgtaaatgtttcccatgggtttttggatttgctatctgcttgctgtgtttgtgtgtgttgggggcagagggaatcaggaaggtctagaactgctgcttctatcctcccagaaaatccagatgcactaaattgataacctgatgagtggtggcaaaaagtcagacagtcatgtttgaataggtttacaaattatatttaagaaaaatattattttttctataaaggtagggaaaaggctaagcagtcattcactgcttcttaataaaaattctttaccagaaaaaaaaaatcatagaaaacttcaagaaaaagaattgattcagctcagtgttgaaagtggtttgtattcctggcactttatactcccactcccaaccagagacacattgtttcagccacaataggttacatcactaaccttttttgggttttgtaaaccattaaggattacatgaattaccatgtaatcctgttcagacttggtaagacatttactgaatattgcttgttcttattccctagatataaataaaataataacactttattcaaaagagctccatggagtaatatttactaagggccaggttgctcagttttatgcacagaaaggcaatacagtgttgaaatacacatctgtttcaagttcccatatctataagacacttctctctctttaaacttaaaggaaaatatgtatgcacacttatatggatttacaacagtacagtgatctgaatttcggaacttaactttcagtataaaaagtttagttctctgccacacggaatttcagccgtatgcttgtgtaatgtatataaagatttaaaaaaatagatgggattatttaaactaaaaaaagatgtggaagttactcctaagtgtaaatactatgttctatgacattaatatatataccttattttctcttaatttctatttgaaggtctcagccaatttcttctccagtcatcctccagtttggtcatgcagagactcttcttccactgctttctctcatgggctacttcaaagacaaggaacccctaacagcgtacaattacaaaaaacaaatgcatcggaagttccgaagtggtctcattgtaccttatgcctcgaacctgatatttgtgctttaccactgtgaaaatgctaagactcctaaagaacaattccgagtgcagatgttattaaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcagatttgactcacctggcaatttttttttattttttatttttgttatacttttaagttctagggtacatgtgcacaacatgcagttttgttacatatgtatacatgcaccatgttggtatgttgcacccattaacttgtcatttacattaggtatatctcctaatgctattcctcctccctccccctaccccacgacaggccccaatgtgtgatgttccccttcctgtgtccaagtgttctcattgttcagttcccacctatgagtgaaaacatgcggtgtttggttttttgttcttgcgatagtttgctgagaatgatggtttccagcttcatccatgtccctacaaaggacatgaactcatcgttttttatggctgcatagtattccatggtgtatatgtgccacattttcttaatccagtctatcattgatggacatttgggttggttccaagtctttgctattgtcacctggcaatttaaagcaattttctttgaatagaaatttcctcaaataatggatttgttaatgcattttattttaattcatatacaccttaaaggtaatatgtttcaaaggaaaatcttagatttttcttaaaaatatgtggttactcttattaaacgacatgcagcaaaatcccctactggagtctcctcttactagttttacggtactttgctttcgaggagacagaccataggaaaaccaatacatgttaagggtatccatgtgcctacgtacagattatgtacagattgtcatatgtgacttggattaggatattttcaagccaaacttcagttgataaaattggaaaaatcagtttgagacttaaaaaaaaaggcaataagatctttttttatcacccatagtcgaaatattttctagttaatgcttagtcatttgttttttagccaatgaagttatcatatgctaatttagagaaaagataaaaagatttttaatgctttctctattagtaagaaaacctcatgttgcttttggtttgcaaaatatgacccagggacacctttaaaatgatatcatattaactgttgggttatgtgaccttgccaatacctttttgaatagatcttctaaggttaaaaaaaagtagcactaatgagtaagtaaaagaaacaagctgacaaacattgggagctgtaaatatagtatgtgtgctctgaaaaaatgaaaaaggaccatttcaacatgggattttcagaaactgaattattcccgaatggatatgatacataaaatattctcctcagaacacaaattctagaaagaagatataaatgttagaaagaaaggatcctgggttgaagtgaccttgggaaacatggggttatcctatggaatgtctctggcttttaatgttctattgtgcgttatgaataaaggaggcattatagtagattacatttttttctatcttgcttgacctgagtacattctcatttatagtcatcatacattgtaactccacagcaggaaaagagatgtcgtattcttccaatgaaatttagatttatagtttgagttccatactggaaaacttgagaggaggttaactttaaaaactttaactattttgtcattactgaaataatgtattttaagatgaaaggattcttaattttattctttaaactagcctcaattcaacatcttccatgtactacattctgtgactcaccaccctctagcctgaaaggaannnnnnnnnnnnnnnnnnnnctatgacaattgtaaatgagaatatactttgaaaaattttggattaaactaacactgccatttgggttcctttcaggctatagggtggtgagtcatggaattaaataccagtggaggaaaaattgtactcaattgtatattgaaattatgagatgcagagatccctgatctttagatcagagatcttcaaatgaatgatgttttataaaatagatgattagctggtaaatgctgctg

SEQ ID NO: 13669 - DNA, 22170 bp, Human
gaaggaatcggtacgagacggctcacctaggcagcccgcagcccgtggtagtgccggagccttgctcctcttcactcattccctcctccgtccccgcgggcgccaccgtgactgcagcctccacgcgccccaatacacagccgacgagctagggccggggccaagcccggagtcgcggccggtagggcccgccgcggggcacgctgggatatggagtcccccgcccaccctacttcgtgagcctccatctggaggggagctatccgccccacaaccctctgcgtgcgtggctcgcccgggcaggctgcaccgccttctgggaggagcgggccctccgccgtcgcttctcgagaaggccgtatttttttgtttgtaataccgtcccgcctccttccttccgcgccccctctctcccggtccgtgaagctgtggacatgcgtactagcggaggggaagccgctgggtagggaggcggtaaggactcacttgggcacggagccttttggatcgcgagaaaactacagaacccaagagcccgcgcgccatctgtgtcgcagctggagaggcagggtcaagcacgcacgagaagcttcatggcgtcattggttactcccattgcgattacttcccctaggtgcactgagattggttacttcgactaaaggggcggagacaaggaaaagtcagccccccccgaccccgcctccttgatgaaggaaggttgtgattggtccggagaggctgccgtcggatcctggctctttgcggtctgggagggtgggccttacctagacgccggaggggaccgatctctgtttccgcagggctctggagctggtgcaggtttaagtccgtctcagacagtcccctcaacccacagcctaagccccttgcccttgggcctccgtgacacagaacttgcttccttttcctaggtcgtccttcacctcccttcaggtgttgcttcttttgtgaaacctttttagaaccgctctagtgaacctctctttaactggcgaggaaacctctggggcctgataatcaggctgtaatgtgggacgacaggattagaaggactaggcaccttggtggtcttgttccctcttccatgagtcttgggtctctcagctgaagagagcaaaagtgaattttggccgcctaagattaatcaactgatctgggtgttgagcagacgcgcattgtttagtcctagagccccattgcctcctcccccaaagttgcacaaccactgggctgagggaaatcttgtgaccttggagagagaaagggagagaccacattaaaaaaaaaaaaggttctaatgagtgttctgagaaggggtcaagaaagatgtcttactctgagccggggttggaggtccagaggaatcttgaaatgataatgaggggtcatccaggaacactggaggaggatggggcctagagccgagtgaattccaagtgggtgaaattggagtgagtggtgacaatcaagggaaggagagctggcaagatcggtatgatagggggagcaatgccagagcgctagggatcccaactgaggggctgctctctccgatgtagaaaggagtctataagacgggtcatagggggttcctgtggaatcagcctgaggcctgaggtgggacctccataggacaccgccagcagggaggcgcggggcccaggcgggccaggtacgagcctggagcgcgccggatggcagcagcgggctcctttaagaggccggcggctccatcgcagcatcccccgctcagggcgtgtccgtcccggggggccaggggcgggggccctggaaggagcgggagttcaagccgagcagggacggggctaggggtcggggggtgggggcagaaagctgaagctgacacccgtgcatccggacaccgcacgagcatcgcctgtgacagcgccccgggtccggtggagggcagcggggggaggagggaaggaggaggagaaggaggaggaggcgggagcagcatccggagcggagctgcagcagcgccgccttttgtgctgcggccgcggagcccccgaggtgagagcctggccgagttgtgggggggtggggggcagggatgggtctgggtcctgggatccgggcgtggagggagggtcgggatgcagatgtggcctggtgcggggtgatggcgtggggatgctgaggctgtggggatggaggaactggggacctggacccgacgcctgtggggctgggaaggaagggaatggagcggagggatgccgcggcccagcttggagacgaagggcctccagagctggaaaggaccgtattggggtggggtggaggatgattgggggacagacttaaaggacagagggcaagagaacatctcctcccactcatcctcaggaagagagagagggaaggaggagggagagttttggccccctctagggaaggaaaggaagggcaaggactgatatacccaccatctccacacacacacacacacacacacacacacacacacacacacacacacacacacacacacacagcaggctggacctgaagattagtcagagagcacctgttcctgcatgcccaggcgttggtccccctccccttcaagctgtgatcctcctaatcccctccagctgtggcattcacctccagctgtggcattcacctccatccagctgttgcatcctcccctcccccattcacgtgtgggtttctccctcctctttctctccatctcctctggctcccctaacccatctcccccagtcaggccctccaaaaacctcctccctttcccacaaacactcctcaaactcattggcttaaaaataaacaagagttgagacttgctggtaaccaaggccttgactgagaggagggaagagtcaaggctctgtagacagtgggaggaaacagtgaggtgtcccttagaattaagggaggagtcctaccttgtagatgctcatctgctgcctttttcagaggagcgtaggtgagtggcctccaatcagaagggagtgcacatgaggtctcctcaccccacccagagtcgtctcaagccacagtcagtgcatccctctaaacacatttcccttgcagttctcaaggtggactccattgctctaggagctctgagtttcagccagagggtcctaccaagctaaggctaacagaaaggatttaggaaggataggactcaagtgccccctgagccttcctgtccagacactgaagtttctctgagctttagggccccactccctcctatctcacacttacaggtgaaaaaaagtgtgtcccctcaagcgtatcattcatccactcactcccattgtcaactggggtaatgttaggaaaaccccagctctcaacatggagacaccagctaaatatccatcccagttatggacagaggaggcaagaagttagacatggctcaggatttcctaggcttccttatagctgaagagggcagaacccttctaaaaaccaattgcttttcccctcgtggtgacactgtggtaggatcaggcttttctaggaagaggactcttggttctaccactcacagcccggactctcgtaatgcacagtcctccctctcccctgcctggatctggagagaaagaaggaatcaaccctgtaagaagtccttgctagggtggactggagatcacccctacattcaggtcctcagccctacaccagtcaagccctgggacccccagctgccatgcttcttccagtgaggtggaaatgtctgcccctcacgccagccactcatgcattcactcacactgttgactgaggtgatgctgggaagaaggaggatactgttgagatgatgccagcaggggacataggggcttcatgagggcctggccacagagactggtctgtctggttcattggctcccagaaggactggggtcatatgtgtgcgtggagaaggtgaggagactgtgacagtgaccagattccagaggaggctaaagatcattcaggatagagcccttgccctttggtttcttcattctttggtcttttttttccctcttgtttctccacctccctttccacccataccctccctactggcacttgctttgagagagagaacaagggaaagaagggaagggaatcacattcataaaaaacttacaagtgtgtgttaggcactttccatatggctaatgcttatagagagcttcctgtgtgccaggtcctgggccaagaactttattttgattttcttaatcatgcccgtaacaagaccaagtgagatagtgttatcatcatctctgatggaggagaaaactgaaacttaagtaatttgtttaaagtaaaaaagttagtatgtggcaagaggtaggatttgaacccaggtctgtgtaacccagaacctgtgttcttacccaccacattatgtactgcattgccactgtgggacataggtaccactgtccccgtttagcaatgaagaaactgaggtttgttgaaaagtctcaggccaggtcacccaactggccaggagcagagacaagacctcaggaagccactctgattttgaggcctgtgttctctcctctaccacctaccctctccctattgcacaactgtcctaataagctaagtgaaggaatgcatgagcagtccatcaatcttattttctcttttacaatttaaattttatgtcttactttaaaagcaattcaaagttgttactgaaatactaggaatatacgtaaacccaaaggagaaaattaaaacactcacaattccacctacctagaaactgttgttatactttggtatttattcttccagatttttaaaaatgcccatcccgttgaggaactatatttgttaacatccgctgaacttcttcctggtctatctgaggtcctaggtaggagggactcctgaggcccatcctaccctgctcttgccctccccttccccgaggcctccatgggtaaggctgaggggtgatccagggccacgtgatcaaagggaggatcttagcagtacagctgcttaagagagcagattccagagacaactggccagggagtgaggatggggtgcagaaaatcaggccatcccccttagtccagaggagacagaatggcaggatttacagaggagggactggtgatctggtagaggaatgactggggactccagcacaatcactagcactgtgacctggttctactggaacctgaaatcacagtttatcctgggaaagcagaaggtcagagaccaagtcttcagcctctccaggatccacaaagacctggtgtccagccaaccaggaagacaaagcaaggaggaaacatgctgctccctgcaccccctctatcaccctacttaaccttcactacccccagcagggtgggttgggcaccacagagagattacattccttaaactaagtggtggcaaaactgggattctagctctgatctctccaaatctgaagctgattcttttttcctaaatagtactgtccctcccttccctgaaccccttcactgcccaccccactggaagtgtggcagctaggggtctcagggcttgatttaccaatcaaagacccgaatttaggggtgatctccagttttcccccaagttctcaggggaactcatttctccctcatgagggcactaagaaaagcaatagttcttttcctcttgggatcctggggccaggactgcggatcctgaaaaatggaaaataaaaacaagctgcagggcacagtggttcacacctgtaatgccagcattttgggagacctagactggtggatcatttgagcccaggagtttggaaccagcctgggcaacagaatgagacatggtctctacaattttttttttttttttttttttttttgagatggagtctcgctctgttgcccaggctagagtgcagtggcggcggactacaggtgcgcccaccactacgcctggcaaattttttgtatttttggtagaaacggggtttcaccatgttagccaggatggtctccattgctgggattacaggcgtgagcaactgcgcctggccttttttttttttttttttttttttttttggagacagagtattgctctgtcgcctaggctggagtgcagtggctccatctcggctcactgcaggctccgccccctggggttcacgccattctcctgcctcagcctcccgagtagctgggactacaggcgtccgccaccacgcccagctaattttttgtatttttagtagaggcggggtttccccatggtagccaggatggtctccatctcctgacctcatgatccgcccgcctgggcctcccaaagtgctgggactacagacgtgagccactgtgctcggcctttttttaatttagtctggtgtggtggtgagtgcctgtagtcccagctactcaggaggctgaagggggaggatcacttgagcccaggaggttgaggctgcaggcagtgagccgtgatcatcccactgcactccagcctgggcaacaaagcgagaccctgtttcaaaaacaatacgagctgcagccaaggggacaggaggcatggccacgattgatcagagacctttatcctctcagggtttcaaagcttgcagaggtggaattaggactccaaagtcttgggtctcctttccctttgaagactccccttcctacccccactcacgagagaaagggaatcattctccttttcctgagtaaaaaaatgaggtctcagacagtggagagcactcagtgtgagagcccaagatttaggcagatgacctggcctctgaactgagcccctaagaccaccaaacagcttagcattgacattctgctgttatacaagaaggagctagagagaattcagagagtttacctgccacaggcttccaaaatctcaggccagagaacctagaaggtgggatagatggggggtgacttcctaccccactctaccctgtagcctccttatggagtcactttggggccaccagcaaagcactgaattagggcctgttgggtgtccaaagagcctcctcccctggcacatgtatggcttagagatcattctgtcccctcacccaatgtgaggcagaagcaccatcaacacttggtagatatggttgacagtgagtgacagagagacccaccctcctgtcacattgctgcccttcccccatgctctgcataattgataacggagagacagctaccctcccccagggtgactgaacgtctgggccaggggctcctagccatcctagacgcccctccaaagctctggcgccaaggcccagccagggggcagtgggacacagctggcaggtcagaaataaaggaaacaaaaaggggtatgtgtgtgtgtgttgggagagaggaatctccactttactatagctcccaggggcagcagctttccctcactccaggtcaatgtggaagagccgtcaactagcctgagatctttcccttggtcccatctcctacttcttcagctatccccactaccgtaaaagacaaacaggtgaaatggcttctctccttctctccccagctgctggccctggataccagaagggcctctggggaagcctggtgaactggagggaggctcggctggctgcaagtgtctctgagcatgtcaccctttctatgcctaaaccacctagtcgtcaaacaaccagatgacggctgaaaaattcctttaaaaagccaggtgctgtgcctactcaaagctcggcttctagacagaaaaggagatgggtgttctccgtgtttctcactcccctttcatctccattttctcagggtcctctgcttttccaaacagcttttcaagccatccttctcggggttgactccgcttgacgctgctccggtgtctgtatatgtctcagctccttcctccttcctagctgtacctttcgccttttctgtgccctgtctccctttctctcatttcctgctttccttccctgtggtactgcacccccaatgccaaccccacaagtcccctcctgccaacaccagacgcctcagccgaagatctctctgcatgcgggggcaggggaaggaagggaacacagatggggcagaccgctgggtgggggtccgcacctaagatcctcgcagccatcccggcaaccagccacctgggccggcccaggtcaggggcggggcccaggcacagccccgcccccacgtcgcgctcacgtgatccggggctaatcttgtcctggtgacttcacgcgccgcctcaggcccagtcgtcatggttacgccgcagcgcccagcgcttcccccagccggccgtgtcccttccctttccccacccggaccacccccttccgccgccgcggcccccgccccagccacgcgccacgtgacggccgggaaggaggtcgggaagggggagggggcgctgtggccgtaaccccttcctccccactttcagcggtcctgacttgggcttcgtccttccattgctggtgaccaagctgtccagggcacggccccggctcctccccgagggctccaatcccgccatccctccctcctggcctgccaggcgagagcgtcccagagtcttgggccttgtttctgggtggtccagaagcgaagcccggggttgcggcggagtgggaggtggtgggggcggggagggaggttggggggcaggcaaaatcccttgggtcctccagacgaaattctcccatatgttggcactttgcttggtctgtgtttgtctgtaatttgcattgcaacctacaccttacctcttgaagccacaaataacgcgtgggatatgttggggatttggaagctgaactttagtgtgatttgtgctttctgggcctcagttctctcaagaatataatgggaccagtagtacctccttcacctggctcttctgaggattcagggagctagttttgtgtgtgtgtttgcgcgcgcgcgcgcgcgcagagagagtgtgcggggcttaaggcgatcctccggggtgagtagagcagtggttccaccttaccgagcaccttctgcgtgccaggtgctgttgcaagccatggttcccttgtgatgcgaagtcatctctctaaaggctgtccaggctctcaaaggagccagacgcccgactacattgtccgtccagtataatgggaaccatgatagaggacgcatagtggggctgtgtcagcccagaaggcgcattaacctagagcggatcaggaaagaaggacgtccaggataaagtgacacctggatagagatgagaagcgccttccaggctgggggtgaagcttgagcttctttttcttcttcttcttttttttttttttttgaaacagagtcttgctctgtcacccaggctagagtgcagtggcacaatctcggctcactgcaacctccacctcctgggctcaagcgattctcccacttcagcctcccgagtagctgggactacaggcgaccgccgccccacctggctaattttttgtattttagtagagacggggttgcaccgtgttgcccaggctggtctcgaactcctgagctcaagcaatcctcctgtctcagcctccgaaagtgctagattacaggcgtgagccactacgcccagccgtaagccttccttaagttagccattatcattgggtgtcctggttcaaaaacccgacgtggccaagtttgttggtgggggtggttgttttttcttttgtgacaaggtctcgctctgtcgctcaggctgcagttcagtggtgcaatcactgctcactgcagcttcaccctcccaggctcaaggtatcctcccacctcagactcctgagtagctggaactaaaggtgcacatcaccacactcagctaattttttttttttttttgagatggagtctcactctgttgcccaggctggagtgcagtggtgcgatctcggctcactgctcaacctccacctcccatgttcatgccattcttctgcctcagcctcccgagtagctgggactacaggcgcctgccaccacacacggctaattttttgtattttttagtagacagggtttcaccgtgttagccagcatggtctcgatctcctgacctcgtgatccgcccgcctcggcctcccagagtgctgggattacaggcatgagccactgtgcctggccggctaatttttatatttttgtagagatggcttttcaccatgttgcccagactggtcttgaacttccaggcttcagtgatccacctgccttggcccctcaaatttctgggattaaaggtgtgagccaccatgcctggcccaatctgttttttgttgttgttgagacacagtcttgttctgtcacccaggctggagtacagtggcgtgatctcggctcactgcaacctcctcctcccagattcaagcaattctcgtgcctcagcctcctgagtagctgggactacaggtgcccaccaccacggccggctaattttggagatttttagtagagacggggtttcaccatgttggccagtctggtctcaaactcctgacctcaggtggtccgcctgcctcagcctcccaaagtgttggtattacaggcatgagccaccacacctggcccccaatctgttttagaaagatccttctgaaggagctgggtggagaattggggttagggagggcacttggagaccagctgtcctgggccaggtgaggacagctaatgagggttgaactaaggcagtaacagtgggactggaaaatagcatgcactgggttagagctttacaaatctagggtgcttgttaaatatgctgattccaggcctaccaccctcaccccccaggaaaaagtcttcaagggaaaggcctggtaattattacaagaactatcagagtttcccaagcctccttgtgtgcctgtgtaatcatctactgaacccttctagatgtagagattcctgccactcctcccccactgcaattcagaatgtatggcaatcatttccagactaacccaggggctcatggaaggaccctgctagctatgaggaacaattagagggatgcttgttcttgggaatcttcaaatctcaggatctggtaactgacaagtgtggagtgagttgggagaccagcatggcgcctggggccaagttctggacaagtctggtgtaggattaagggtttgctgtgccttagtgacagccagtttattcctttgtatagctgaggctcaactacagctcgcctgaggtcacatagccattatgtggcagaagcaagtcaggattcagggtttttgtttgtttgtttgttttttgagacggggtttggctacgtcgcccaggctgggattcagtggcttactgcaacctccgccacctgggctcaagcaatcatctcacctcagcctccagaggagctgggaccacagtcacaggatcaccatgcccagctttgttgttttttgtttgtttgtttgtttctatttttggtagagacagggttttgccatgttgcccaggctggtctcaaacttttttttttttttttttttttgagacagagtttcactctgtcgcccaaggctggagtgcagtggtgtgatcttggcttactgcaacctcacctctggggttcaagtgattctcctgcctcagcctcccgagtagctgggattacaggcatccaccaccacgcccagctaattttttctttttaagtagagacagggtttcgccatgttggccaggctggtctcaaactcctgacctcaagcgatccacccacctcagcctcccaaagtgctaggattacaggcgtgagccactgcgcccagccaaggtctcaaactcttgagctcaagtgatccacctgcctcagcctcccaaagtgttgagattacaggcatgagccaacacaccgtgccagattcaggttttttaatggttgctttttatttatttatatatttttttagacagagtttcgctcttgttgcccaggctggagtgcagtggcatgatcttggctcaccaaaacctcagcctcccgggtttaagcaattcttctgcctcagcctcccaagtagctgggattacaggcatgtgccaccacgcctagctaattttgtatttttagtagagacggggtttctccatgttgaccagactggtctcgaattcctgacctcaggtgatccgcccgcctcggcctctgaaagtgctgagattacaggtgtgagccactgcacccggcctaatggttgctttttaaatagcacccagctatgaactgggacacatctccattgcctggaaagtttggggagcagaggatggggcaatggagaagaggaaagagaagacaagaccttgtttgacccctgggagagccgctggactgaagggagggccaagggggatgaagcagtggccttctgtgacagtgtctgcatccccattggctgcttctgcctttttccccacctgtgctggggggacagaactctgtggttacaaccttcacttaccttggagaggcccaggggtgtgttttagaatgaggctctcacctgagttgagtgttcctgagagggcctcagtagtaccgtgtgtaagtacctgggtgggaggcccgggtgcatcgcctgtgtgtaggcagctcaagaatgctgtccaagggtgtctgaaaggtttaccagcatcctgtgtgtgcttcaatgtgaaggaggtctaggtgttactattgtgtgcctgaggttgaccccgaggtaaaggtgtaaatgtgagacccttctgatacctgtgtgtgcctgtgagtctcgggtgaaaaaaatgtgctgcagcaatgaattagtcatcttacagggagaagggaactcatctgttaccattactcttgaatttgagacatattttaccagtgtgtacccacgtggggctgttacctgagaatgatactcaggtacgatacctgtctacctattacttgccttactaacatgcctgagaggaagcccaagtgtatcagatttcctaagatggctcaaggtgcaatttggagggccatgggaaacggagccacaagtgttacctccagcggggctactgtgaacccagcaccccagtctgtgcctctgggataagtgtcctgagcaggcagtcctggggctttaacagcccagcccctccttccttcattcccacagggcccagtgttcaccatcataccaggggccagaggcgatggcttgcctccatgagacccgaacaccctctccttcctttgggggctttgtgtctaccctaagtgaggcatccatgcgcaagctggacccagacacttctgactgcactcccgagaaggacctgacgcctacccagtgtgtacttcgagatgtggtaccccttggtgggcagggtgggggagggcccagcccctccccaggtggagagccgccccctgagccttttgccaacagtgtcctgcagctacatgagcaggatgcagggggcccagggggagcagctgggtcacctgagagtcgggcatccagagttcgagctgacgaggtgcgactgcagtgccagagtggcagtggcttccttgagggcctctttggctgcctgcgccctgtctggaccatgattggcaaagcctactccactgagcacaagcagcagcaggaaggtaggccacgtccttgtgggagcctcctctctgtttccctgagcccgagatctgttggtcagctccgctaaagtcacgcaatggtcccttccctccccatggcccagccctagtcccttagccatccatcagcctctaacttcccagcttcttttaaggccacccattcattccttccctgtcccctcgaaccttcttcttggcctatttttggctttctgcctcaccctccttaagtcaattcagccaacccaatgctatcctgtccctggccttgagtgtggctctttctgaggcttgtggcactgtgcctcctgcccacagacctttgggaggtcccctttgaggaaatcctggacctgcagtgggtgggctcaggggcccagggtgctgtcttcctggggcgcttccacggggaggaggtggctgtgaagaaggtgcgagacctcaaagaaaccgacatcaagcacttgcgaaagctgaagcaccccaacatcatcactttcaagtgaggtccagggcaggggctgggtgttggggatactatgctaaggcctggtaccctcctgggcagtgggacctaccccatccttccccagaggagatccataggtggaatgggtgggaatgggggttccaggtatgaatcaggtgaatgctgagccagctgaggccttcataccattgtttggctcccaggggtgtgtgcacccaggctccctgctactgcatcctcatggagttctgcgcccagggccagctgtatgaggtactgcgggctggccgccctgtcaccccctccttactggttgactggtccatgggcatcgctggtggcatgaactacctgcacctgcacaagattatccacagggatctcaagtcacccaagtgagtaagcaagcagggagcaacagatgtgcatgcaggtgacccactcaagtcagtgtggccttctcccggcttccaaaccatgccctaggtccatgtggccatctcagaaacctcttccaagtgacagtcccatctcagaagggctgtagtgagcccctcacctttgagtgtcccaaatgattttaaactgaaaggcaggccggatgcagtggctcacgcctgtaatcccaacactttgggaggccgaggcgggtggatcacaaggtcaagagatcgagaccatcctggccaacatggtgaaacctcgtctctaataaaaatacaaaaaaattagtcaggcgtggtggcgagtgcccgtagtctcagctactcaggaggctgaggcaggagaatcacttgaacccaggaggtggaggttgcagtgagccgagattgagccactgcactccagcctgagtgacagagtgagactccgtctcaaacaaacaaacaaaaaaacctgaaaggcagagttgctgcagagttagatgaggtgtgtggaggggtgtggaccccagctgactacactctttaccagcatgctaatcacctacgacgatgtggtgaagatctcagattttggcacttccaaggagctgagtgacaagagcaccaagatgtcctttgcagggacagtagcctggatggcccctgaggtgatccgcaatgaacctgtgtctgagaaggtcgacatctggtgagaactaggctgaaaactgagaagagtgggtggccagccctggggggattgtgggcaacttctagggcttgagcacaagtgatgtcccctcatccctaggtcctttggcgtggtgctatgggaactgctgactggtgagatcccctacaaagacgtagattcctcagccattatctggggtgtgggaagcaacagtctccatctgcccgtgccctccagttgcccagatggtttcaagatcctgcttcgccagtgctggtaaggatggtctgggctgggatactgggcctggagaagttgagaagcacggtagtactgggctggactgaccaataaatggcaggggtacatttaattcaaagagactgactttcatctgaatcaggctcatgctaccttctgagctgagtcaccaggggtaattggtatctactctgaacctgtttcctcatctataaaatacacttaacgatatctgcattcctgatttgtcatgaagtgccagtgagtgcatacaagtacaaggaaggagcagcataaccaccaagcatggttggttgagcctcaagtaaacaaccttagaacacagaaggaaaggaccccagaccctcatttggaacctagacccagggaagtttgacgattgctaatctgtcactgagcatttcccaaaatgtggttccttcaatgaagttattcagaaaaggcttttattttgggagacaagttggaaaatatggggttcaataggtttccttactgcaggattttgacacactaatgaatagtgtgtaatattctctagagacagttgaccataagttcttttgtcacagagtacattctaggattggattctccaggacacactttgggaaaggatgctccagttcctatctgatcctccctcaaattctcccctctccttcctaactccattcctttcaggaatagcaaaccacgaaatcgcccatcattccgacagatcctgctgcatctggacattgcctcagctgatgtactctccacaccccaggagacttactttaagtcccaggtgtgctgtgggtaggaaaataaatacctaactccccttctttgcagagatgatgctatttgagggggaggctgggaaatgggttgagtgggactgaagagattggctcttagagggctgagtcaatccactcctttttgctccagcacacacattggcagtggtgtgggcaacctgcagagcctttcactgggtgaagggatggctctcactcttcatctgctctcaacccataggcagagtggcgggaagaagtaaaactgcactttgaaaagattaagtcagaagggacctgtctgcaccgcctagaagaggaactggtgatgaggaggagggaggagctcaggtgagttcccgtgcttggggaggtgattttactaacagcaaggactatgcacccagtcagctcctacccagccccagggcgggtggaaggactacgaaaggactgtggacaggaattctgagactgagatctattatggccctaggtgaacccagttcaccttggggaacctttctgcccgttgcagacacgccctggacatcagggagcactatgaaaggaagctggagagagccaacaacctgtatatggaacttaatgccctcatgttgcagctggaactcaaggagagggagctgctcaggtaaccctacctgtccttatgcaccaagccctggagctgtgcctgccttagaggtcctactgagactggggtgccccttcctggtcatttgcccagctgagaaggtgcctggatctttaggcgagagcaagctttagagcggaggtgcccaggcctgctgaagccacacccttcccggggcctcctgcatggaaacacaatggagaagcttatcaagaagaggaatgtgccacagaagctgtcaccccatagcaaaaggtgggacatgagtactgtggttccaatatggcaagagggatactgaagtggcaacaggtatattagcagggagatgtgtactttagtgtccaaggttagggagtgctttgagtacatagatttggcagtcttaaccttttacttttcctcttcttccaggccagatatcctcaagacggagtctttgctccctaaactagatgcagccctgagtggggtggggcttcctgggtgtcctaagggccccccctcaccaggacggagtcgccgtggcaagacccgtcaccgcaaggccagcgccaaggggagctgtggggacctgcctgggcttcgtacagctgtgccaccccatgaacctggaggaccaggaagcccagggggcctaggagggggaccctcagcctgggaggcctgccctcccgccctccgtgggcttcatcatgacctcctgctccgcaaaatgtcttcatcgtccccagacctgctgtcagcagcactagggtcccggggccggggggccacaggcggagctggggatcctggctcaccacctccggcccggggtgacaccccaccaagtgagggctcagcccctggctccaccagcccagattcacctgggggagccaaaggggaaccacctcctccagtagggcctggtgaaggtgtggggcttctgggaactggaagggaagggacctcaggccggggaggaagccgggctgggtcccagcacttgaccccagctgcactgctgtacagggctgccgtcacccgaagtcaggtaaagtatgggaaggctcccaagctctttccctttttccttatcctccctggggtccaagtctaatcccccacattatgctcaattttaagccattccctacttcacccttcgtaactatgttcccttctcctggattcttagtgacctctttccacttctaatcagaccccccccaccccatctctcctgcagaaacgtggcatctcatcggaagaggaggaaggagaggtagacagtgaagtagagctgacatcaagccagaggtaagtgatggcattacaagaattaatggcattcttgttttctgctaggggcagaaccaagctgtaatccccctcttcaacatgtaggtggcctcagagcctgaacatgcgccagtcactatctaccttcagctcagagaatccatcagatggggaggaaggcacagctagtgaaccttcccccagtggcacacctgaagttggcagcaccaacactgatgagcggccagatgagcggtctgatgacatgtgctcccagggctcagaaatcccactggacccacctccttcagaggtcatccctggccctgaacccagctccctgcccattccacaccaggaacttctcagagagcgggtgagtggcacaacagcaaaaagcagatattgaacagggagagctgtaagcagatgccttgtcttttaacagcttttggggagacagctgcacaggccagaaagtaccataaagagcaaatatccacgtggtggaatttcagaagcctcttgcacagagcatctattacgatgcctgaccagtagcttgtatgtagctataaattgcagccagggaatgattctgaaaggagtctgacaccttggagaatggcctgagcaactgaaatctggaaggaataaaaccagtaagctggctgggcatggtgactcacgcctggaatcccagaactttgggaggccgaggcgggtggatcacaaggtcaggagttcaagaccagcctgaccaatatggtaaaaccccatctctattaaaagtacaaaaattagctgggcgtggtggtgcatgcctgtagtcccagctactcagaaggctgaggcagaagaattgcttgaacctgggaggcagaggttgcagtgagccgagattgtgctactgcactccagcctgggcgagagtgagactctgtcttaaaaaacaaatcagtaagccactggctattaaaatgaccccagcaaagaaccccaaggaatctcactccatttctactctttctcacagggccctcccaattctgaggactcagactgtgacagcactgaattggacaactccaacagcgttgatgccttgcggcccccagcttccctccctccatgaaagccactcgtattccttgtacatagagaaatatttatataaattatatatatatacatatatatatatatatgcgccacataatcaacagaaagatggggctgtcccagccgtaagtcaggctcgagggagactgatcccctgaccaattcacctgataaactctagggacactggcagctgtggaaatgaatgaggcacagccgtagagctgtggctaagggcaagccccttcctgccccaccccattccttatattcagcaagcaacaaggcaatagaaaagccagggttgtctttatattctttatccccaaataatagggggtggggggaggggcggtgggaggggcaggagagaaaaccacttagactgcacttttctgttccgtttactctgtttacacattttgcacttgggaggagggaggctaaggctgggtcctcccctctgaggtttctcaggtggcaatgtaactcatttttttgtcccaccatttatcttctctgcccaagccctgtcttaaggcccagggggaggttaggagactgatagcatgtgatggctcaggctgaagaaccggggtgctgtttaagtccctgcttttatcctggtgcctgattggggtggggactgtcctactgtaacccctgtgaaaaaccttgaaatataacactccatgcaggcccagctgttgagggttttcttgatgaatgaatggggtaccatacatggttaagataaagccttgggctccggactttatctgaggtgtctggagaagttctcctgcccctccacttttttgcatctactctcactaaatgagtataatgtcaagccccaactttctaaaattataggaataaatggtagcagatacatccttctaacttgttatggaggactataaatgaagttactaaaaacaatagactgaaatttttagtttaaaatatgcaagcctgaacaaggggaccaacattcccaagaaactggaacccagtcagacatatgatcaactgcttaatgtgtatgccatgtatgtcatgtgtcattcctttcccccaccccctccctagtggaagtgcttgcctactcccctaggacaggtaagtcctcggaaagtctaatcctcaatcttttgggcacaagttttataagggccaaccaagcatggagtcagggaaaaataggatcgagggccacaaaaaaagatggaagtggtaaaatagaagaaaacatcttaaccggaataaaggcttccattcaaaacccaagaagggtcctttgagggataaaaggtacaaaaataacagcaagacaagaggaataaaacccacatgaatcactgtggcatccagtttctattcacaaagaaaaagctccagtccatcttttaatttttttgaaaaattcctgacattacagaactaaactgaaatgtattaatattccactcttacatttccatgacaaacagaaaaattcatgagccaaaaaaaaaaaaccaaaaaaaaaaaaaaaccagggagaagcttataaaactaaatatggatctcagcatcaacagctgaacagagaaaggaattaaaacgctttaattaaaaaatcacgagtggatgataaagtgtgtagaaactgaaaatttacaaactatttaaaacctggaatcgctgactgttcagaaactacacagatggatcatgggtggtggtgaacagcagaaagggattatggatgaatctgcattgttctagctgctccccatgccacccgtctccgaggaaagcctgtaacacagaaacaagaactcagttagtttccccagtgctcagctgcacctcatctctacctggttcatgaaatgtgaagagtaaataaccagtgctggagtaccaagggagacattttaaggtttcttaaatttaccagtaccatgatcctttaatccttgcaattcaagcatgtggaggtctattacctcagaaccaagggaaacagcccttgttatccaatgtccctcaaactatgttctcttttagttccacctccatggtgggctaaccaaggagtgtactttctggaaacaggcccctctaaagagtgctcacaatacacagaagcaatgtttctttattgctgagctcactttggctcctcccaaactgctgacagaataccagtttaggaaagaaagagtcatctgagagtagtctcaagggtttaatgctgagacaactcaaggcctttactttaaagccctggagttctatcaatgtgtagggtattatgaggtaataccgttttaaaggtaaaaaaaaaaatgttaaaaagagatgtaaaaagagtaactatgggtcaagaattatactcagatttacttatttattgagacagagtctagctctgtcacccaggctagagtacagtgatgtgatcttgcctcactgcaacttgtgcctccctggctcaagcaattctcttgcctcagcctccacctgatagctgggattactggcagccaccaccactcccagctactttttctattattagtagagacggggcttcaacaggtttcccaggcaggtcttaaactcctgacctcaggtgatctgcctgcctctgcctcccaatgtgctgggattacaggcatgagccaccgcgcctggccttatttatt

SEQ ID NO: 13670 - DNA, 11740 bp, Human
aggcgtctccacccacccacccccaccagccaggccttaggcaagggggccaacgtcatacaacccagtctagacttggccaggccctgtttgctctcctcgttttaccttgaccttggactccagcagcaggataagcagtttcctagcagagccggctcccagcaagaccctatcttccactgggctcatctctccccgcccctccctcattgccctcaatgcacactcgagctggtctccttatgtcttaactctctttctgttgtatttttcctcctaatgccagcccagcccgcagcctgctttctgaactctgagctgacccttctggatgaagatcacgcagataagaattactatcctaactcaccgatgtccgggtgctctcaaccgtcaaacaccaccttctccccacaaagaggaaggaggtggcccgaaggggtttctgcagacctgtccatttgctctccacttgaggggtgcagtaggtctggctgagcgaggcgctgctctgtggccatggtctgtgcgctggctgcacacgagcactcagcatttaaaacctgtggcagaggcaggaaagaaggaaacgctgcagcccctttcccctcttatttttctctcttcattacgatttctcagggaggtcctgtgctgaaagggaacttgactcaattccacggagatgctcccttagaaaggggtgactctattgaggctcctgacaagttgggagattgggaggaaagaagggagagcttttgaagaatcagtaagttggtgttaattttttctttgaaatagggggcagttttagatcatgaaactattcctcactaaaagagggtgacctaagaaagccgtgggagctccattgcgggtattcaaactggggactgtgtcatgtggcttaacccaggcccctgagggcagaggtgggttctgcagggtcccccagagtggcgccagagagaggtccctccaaaggtgtagcactgaatctcccccattttccacgttttcttttgtatacctatagaaagcgcgctctccttcgcatccagggcttttagctttcccaggctgaatcttgcgcccccaccacccgcatttctttgaaaaacctcactctgagattttttatttctattacatattgaaatatcagtctattctattgcttttatttccctcgttttattctttctccatttattgccgagtatattccattgcctctcgatcccctgccccaggtgatgaattctgtatttgggggttgtcacacccctctccgcttgagaaaaatccagcgaggtaaagcagagtgtccttttcagacatctagagttttggggaatgtggctgaaggtaggaaatggaaacacaatcccggcatcaaaggctcgctacgcagcatcgggttctttccagccgcgagcggaggcgagctgccagggccagagcgctcctgactgttttctattatcttcatttattattttttaaaacctggtttcttccccacccttagcttcaagccccaatccagagacttcagcagtcacagtgatcggcttggcggtagggggtctgtctctccggtgcacatcctatgcctaggcggaggcgcccagttacagcgctctcctccctacacccctttgcgtcggccaaattcagcctcccccccctccctctccctccctggggcctgccgggggcgtctccctgtccctttaaatctcccagctcccgcctcctttggcctacctgagatccaatcagcacagactttttccctttcgccccgccccacctcgaggggagggaaccccaggagacctggccggggcatcacgtgcgcagagcgggtcacgtgggcgcgggaggggtgctgagaggtggagagcgggagccggcggatttcttaatgaagtgtctccgcatgcgtagagggaatgtagggagggaggtggaagcactaggaggaggggaggggtggagagaaaagaggggagggatggggggaggggaaacaggagcgaggtgtctccctagctcgctgcctctggcaagtggagtttttaaaaagctccagcagatcatgtcatgacgacttcgctgctcctgcatccacgctggccggagagccttatgtacgtctatgaggacagcgcggcggagagcggcatcggcggcggcggcggaggaggaggcggcggcacgggcggagcggggggtggctgcagcggagcgagccccggcaaagccccgagcatggatggtctgggcagcagctgcccggccagccactgccgcgacctgcttccgcaccccgtgctgggccgcccgccggctcccctgggcgcccctcagggcgccgtctatacggacatcccggccccggaggcggcgcgccagtgtgccccgccgcccgcaccccccacctcgtccagcgccaccctgggctacggctaccccttcgggggcagctactacggctgccgcctgtcgcacaacgtgaacctgcagcagaagccttgcgcctaccacccgggcgataaatacccggagccgtcgggcgccctgcccggtgacgacctgtcctctagggccaaggagttcgccttctaccccagcttcgccagctcctaccaggcgatgcccggctacctggacgtgtcggtggtgcccgggatcagcgggcacccggagccgcgtcacgacgccctcatccccgtcgaaggctaccagcactgggctctctccaatggctgggacagtcaggtgtactgctccaaggagcagtcgcagtccgcccacctctggaagtctcccttcccaggtaaggaagggacccgagcgccgccgccgccggggacccctccccgccctgcctgccccggggctccgcgccccaaccacccccgccgtctggccccggcgcgcccgctcggctgggctgcctatggagccggccgggcgagctgcactgaggaatgcgccggggaagaaatctgctccgacacgttctctgtagctgcccggccgagaatgaagcaatcacaggcgcccgaaagccgggccgccggctctgctctgtccggtagctcgcctccgcctccccttgcaggctccagcctcccgccgggctcttggcccctaaacctgcttccggcaagggatgggggcggggtgggcctatagtgccttggaatccaggacaaaacccccaacccaccgaataactggggagggcggagaataagaacccccactttctttgacagaattcgcaggatcgttcaggcactagacagtattttttaaataggggactaatttgctggggtctacagaaatgtgagatttatttttttcctttcctgacttattttaaaaatctggccacgaatttcctgattgttgagggaacagaagatccaaaatctctggagagggagtggagaggaggctagaatccctccccagcattgtaaagttttccttgcctctttggtatattgagctcaaacctatagacatttccactgccaactcccccatatgtggtcgagaaagagagttagttattggtgccccagacacagaaagaagggcgtggggatgagaaatgggagaggaagacctgttcaagacctgttcaggggcttctggagtccagacccaggctggggaccccttggtcttgtctggctaaggatgggaagggagaattcattcccctcttgttccgtctccagttgaagagagaaaggctcctgtaaatcccaccgctctccttgcggacaagaccagtcccaggtttcccaaaaccacaccaagagctttggatcctgccttgtgctgagaaatcaggattccggtctagggagtccagcatttgagtctgttctccctgtaagcagagctcagtgggagagcgttctcccttctgatacctacagaggtctttgggggtggggggcccagggcagccacagatgtctcccgacagtgcccagctccccgaccagctccacatgccaagctcagggatgttttccttggaaagcatagacccaaagacctcctaagggtgggcctgaaattcctctgcatacggaattggaagaagaggtaggtggtttaaaaaaaaatactgagtgatattagagagtgtagcaaataacattcttgtgaatattatgaaattacttagtataacacaactcaataccagggtatgacctacactaggcaccctgacttctgattgccagaattaaggatggtgcaattttagtacatggtattatgcatcacctaccctgtattggctgtaatatttttatataatatgatttcttttattaactacctaatatgaaatatacaataatagatttctagaaagacaattcacatgttcataatacagcaatgtattttagagagatggccctttaattctctatctcaccaaaacacaaagcttcttaggagattggggtccagcaggaattcctggggcagggaagccaatgggctatgccaaggggctaaggggtaagggatcaggtgcccaccaaacccactgtggattgggggcacaggcccagagcaatgtgcaatgggtttagtgtgaagaggtagaagagaaggagctgttctatgtatgaatgtagtgtggagtaggggtgaaggattggagagaagctgagaaatatctttgagcaaaataaacatctcaaagattcctaggacacaaaacaaaacaaaacaaaacaaaactccactaaaaataaatacttttttgatcacagcctcctagagaaaaatatctttgaaataaaaaaagtatatcccaattgagatttaatacacttgcaaattatggcatggaaatggatataaaacctagcatgcctcagcagctatgtgctgccacaatccccgtgtggaaatagaattgggctgatgtatctcagtgagtgcagaggtacagacaagaggcagacgaataagaaattatcttcagacactctccatctttctacccactcagagatcttttagaagtagtgagatttcaagataactctgtctgtgcaattgtggtttgttcggcaacatgtaggcataaacactgctgtctctctacagtgcctctggctctgagaatcctcatctgtggtagtctgggctggtgtgggagatggaggcaattgttcagcaagatccagataattagggccaagatgtgtcgtggcttcttccttctcccaattatacagactcttgctttattgctctggttttttttttttctccctacggtgagtgtagactttttttttttttttttttttttttttgagagagagagagaagcagaaattccaggagagaatcagaaagggagaaaaagagagatggggtttaggagagagaaagagggagaaagaaacagtgggctatttggaccacactagaagtctttactgacaagcctttggatttgggttgggaagagtagcaagctggatttctagctggacaaggcactcttcagagcccagagcttgcctgtgggggggcgggtggtcaagggtgggtgggctgtggggagctgaacagaggggccccgaagcccaaaaagaaagccatggctgagcattgagatgatttttatttactcctcaaaggtgtctattaggtttccaggcatgaagtcattcgtgtatgtgatctggagggagactagggaaggggtgattgtaagattaataactaagcccccactcactttaggcagtgtacgcacatctccaggtccaagctaccagatgtttcttcatctctacataccatttcctttccagataaggcagcagacaaagaaagggggcttctttgagaaggcaagactggagttatttccccaggaggccaaaccaacctgcagttggtctgatccaggacaaattggctaaatcaatccttggcatcctatagagaaaaataaccagtttaaaccagttgtctactttttaaactgattttttttagggttgattaaatctcattggaaatttagagctagaatttaggaaaccaaaattggataggtaattgtgagagtttaaagagagtaaagtaaaaaattagggacaattatctggctaattcagaaacaaaaacccacctttaccctactgtattcttctccagggaaaaggaagtgttttaaagctggattgtattagctggcctatttccattttaaaacttactgtatcattttaagagtcagaaagtctggctttaaaatctggttctgccacttaagttattttacccactctgagcctcagattcctaatcttgtaaaatgagtttaacaaaataatcctgaaaaaatgttctgaggattaaaaacaacaataacaacaacaaaagcaacaaactcatggtatcactacatatcctcttcattctattcttgtcaacaaatcgtcaatttcccaaatcatggttacctctgtaagagtaaaacaaatttgagaactgagagatttaaagataatggtcgtgttcaaaaacaaatcctttttaacctaaaggatccatactgtttaaataaagttattttgttttttagatttttttaaatcatagtttattctcacagaggcagagaaaaatgccaggtccaacagttttcctgagaaattgtcaccagaagacagtcaaatgaggccattggaccccctgtctcccattttcttcctgagcattttgttttcccctgtgtctcactgtgaccactactcttcccattgtgtatagagtccatgagagaaagcagacccaatggggatgggtacagggaaagtgttctgtgagggtgggatgggaacaaacatttaagaaagaactttgtgtcttccctctgggctgtgtctatagtttcaaaatgtggtaggaatgaaggggaaaccccaaatattcagccctcctcattagctttcacctaaagtctaataattacatggaaaaaattgagggctgagctatccagataatctccctagttcccccacttccccttgaaagtgttgcgtgacctttattgacagggatgagggtggagtagaaaatggagttagaagtgatatatattggttttagtttctgtgaaattctcagagcctaaagaaacagaactggtaatattggtttggatgacaggcatctagggtttagggttatggttggtgcaagggatgtagacagtttccttcagctgtgaaggaatggagagggaaggcggttggaacagaatttgttctgttttggtgggactgcagtgtggaccccctacttccagagacacctgattccctatatctcaggttcaggaccccccaccttgggtgttaggtggttcataacattggaccccaattcctagagtgtggacctccaagcaggctggcttcacctggacacttatcttctatctgtgcctcacatccctaacgtagggccagtgtccaaaggcgtgaagactcatctggtggtctgggcccactgaagctgaccccctgcctgccatgccctccctgaaatatacaacagaatgtcttcctctggcaacggggcagaatataaactaataaggacccaagcgatctaactgcaggaaggagggatttttctgaatatctgaaattctgcaagcatggcaggccaggctggaatttggagggtcccttctaaatatacaaggatcctaatattgagtgctgtgaagagccatattggggcctgaaacaaaagaaaatcagtaataccgaacccatgtttatttttttaattgatattttgttcatcatggatgtttttgtattcgttttgcttttttaaacattgcattaaaatatcgtcttgattactgagtttttggcgccccctcccttaaacttcgagcccagtggcctcatcatagttgtggtcttgctaaaataacagaaatgaaaagcattagggagcttcactatgcagtgcaatcctctggccccgttgagcccctgccagaactctgtgcctaggcagcctcgggtcctctatctcagtccagccgcttgcctcacttcttcccgcttgccttatctccccgcagacgtggttcccctgcagcccgaggtgagcagctaccggcgcgggcgcaagaaacgcgtgccctacactaaggtgcagctgaaggagctagagaaggaatacgcggctagcaagttcatcaccaaagagaagcgccggcgcatctccgccaccacgaacctctctgagcgccaggtaaccatctggttccagaaccggcgggtcaaagagaagaaggtggtcagcaaatcgaaagcgcctcatctccactccacctgaccacccacccgctgcttgccccatctatttatgtctccgctttgtaccataaccgaacccacggaaagacgctgcgcgggtgcagaagagtatttaatgttaaggaaagagaagaaccgcgccgcccggaggcagagaggctccatggccgtgctgctgggccatccccaactccctatcccatccccagcctccacccccatccagatgggactcacgtggcttcaacagctttggaaatgggtcccgagtgggccgtgcgaggaaggctgtcgacctctactcctccttgcgctcaccttgccagaaagtctggtggcagcgcagagcccaatcattccaaccaaagcagggttggggaatcccgaatggccccaattcttgcctcatcctatgaccaggcttttagaggaccttccctaagggcgcagcttcggagcaggatctgtccagctcatactttccttcgctgtccctcccgcactccttaggcaagatttcccagtaaagattttctgtgcgtattttaaaagtcgtgttaatactcatgataattattagggacctggcagcgtgattggagtatggatgtttccgtaaaagctggaattccgtaaaagcattgacgcagcccctacactccatcccaaccaagaaactgcatttcctggggccaggtgggagctgcctttgccccactgcctcccctgttctgctctctcagtcaacatgtggaaatccaaggaggacaaagactccagccacgctgctaaatagggctcctctctcctctctctctctctaggtggtaaggttggggattagtccaggtacagaagcagaacttttttctaaggataaacatctcttccaaggggatggagagtgggtccctcaacaaagtccctgtccagtcacctttccatcagggcactagcccaggaatgactcctcacactttcacctttactgatttccagaggaaagctagaggatctagttcaagaggcaagaagatctggccctcaattagctagatgtagatgctgcctaacagttccctcctcaaaggccaccttggtgctgtgggggccccttgcctcttcccttcccactggtgcattacaaaacagtgttcttttgaaatgttcatcaggaataggcttttttaaaaaatgttgtgtatctgtatatagtattgtgatgtctgaatgacaatgtactgaatgcaaaaaggaaaaaaacccacaaacatgtttttaaaataaaatatctttttttgccttgattttattgctcagattctttctgaagtctattctgtccactggctcttcaggacggtctactatgccctgactcagccagaatgatcagggggaggagtatagacattgctcccagctgggtagattccaaacccttgttttgctccacttaagtttttgggttatctatactatctatataggagaaaactttccatcctgatgtccaactcagatgagtgtttgttgaggaaggaaagacgtaattggtgactgaaaggcctggaggcagtgacaaaaatacattgatggtcacttcggttaataattggggctcagatctggttctgggtactgagaaagtagcatcccagctgggaactggatgaggtaaatgcggcagccggtggcagtgaggaattaaccttaggctcctggtgctctattgccccagagggccccgaataccttcagccagttcaggactggagttggggctgggatggggtcagcacagcctgccaggggcagcttgaagctcagcttttcctggctgcacttttttcttccccccacttaacctatgtagagaggctgagctgctaggacccctttggcccccagtttgccaaaccaatcccacttttactctctgtattcctgggaaccccagtcttctaggcaatgaggagcctatgtagatgctgccactaatttgttttcctggtcgcatcagtgcctatctccctatctggcagagttaatgagatcattaagttgtcaggttaagagactttttaaaagcaatatagcctaaaacaatgttatctcagattaaatctttactgcagcaatttttatttatatataatatttttcctctcctgagacacagaaacactggagatgtcaggttggaaatcagagttctctgttatccctttgcctggtggggctgaagatttaataatttcatttaaataaattttcctggggaataaacatatgcacattttgcgcacgcgcgcgcttgcacacacacacacacacacacacacacacacacacacggagtctgagagaaaaagaacctgaagaatttgccctctgtggaggctctgctactgacgtggctgccagtgttgttcttctgggtctcaactctgggttaactactagagagccacacgctgtgcagtggagatttgagggagaataggtgaatttccaggaataaggttaattcttaattccatctgtcctttttctccccacccaccatcccaacctctctcccaaaatccctgggtttcccctgagatgaaaggagttggagactgagtgtgtgtgtttggtcagaaaaagaaactaagtggacaagaggcctggggctctgttactatgaccccacccttcctgactgctttgggtagtcccaagcacagctgtaggcaaactggaaattggggactctgattaaagagaagtctagagttctcagaggaatccctctgcttctgcacacaaacccatatataatcatatgaggtagtcatcccatattgagggaaccacccctaaggctctagaagggaataatgaaaaaaaagaagaggagccaggggcgatggctcacgcctgtaatcccaacactttgggaggctgaggcgggtggatagcttgagctcaggaattccagaccagcctggacaacatggtgaaacccagtctctaccaaaaatagaaaaacttaacctggcatggtggtgcatgtctgtggaggctgaggtgggaggatctcttgaaccccggtcgggggcaggggggtggaggttgcagtgagctgagatctcaccattgtattccagcctgagtgacagaccgagactctgtctcaaaaaaaaaaaaaaaaaaaaaaaaagaagaagaagaaagaggaggaggaggtgaagaagaagaaaaaggaaagcctgtgcaggctcactactggtgcattgggacactggtaagcctaaaaagga

SEQ ID NO: 13671 - DNA, 11673 bp, Human
gtatagtattaagtggtaattttttttcattgttgaattttgtacgtctttcaggcagtatagtgtaatacaaagaatagagccggccgggtgcggtggctcacgcctgcaatcccagcactttgggcggccgaggcggagggatcacgaggttaagagatcgaccccttcggccgggcgcggtggctcacgcctgtaatctcagcactttgagaggccgaggcgggcggatcacgaggtcaggagatcaagaccatcctggctaacacggtgaaaacccgtctctactaaaaatacaaaaaattagccgggcgtggtggcggccgcctgtagtcccagctgctcgggaggctgaggcaggagaatggcgttaacccgggaggcagagcttgcagtgagccgagatcgcgctactgcactccagcctgggcgacagagcaagactccatctcaaaaaaaaaaaaaaaaaaaaaaagatcgaccccatcctggccaacatggtgaaactccgtctctactaaaagtacaaaaataataataaaaataagactagaacctggactttggagtcagacctgcctaagttcaaattccagctctgctatttcctagctgaatgactttgggcgacttacgtaagttcagttttcttacctataaaatggaaataataaaaataataggccaggcacagtggctcacacttgtaatcccagcactttgggaggccaaggcgggcagatcacgaggtcacgagatcgagactatcctggccaacatggtgaaaccctgtctctactaaaaatacaaaaattagctggacatggtggtgcgtgcctgtaatcccagctactcgggaggctgaggcaggagaatcgcttgaaccagggagtcagaggttgcagtgagccaagatggcaccactgcactctagcctggtgacagagcgacactcggtctcaaaaaataaataaataaaataataataataaatatttcaggggagaattagatgagatgattgtaaaatgcatagccctagctgtgccccagcacatagtaggtgcttgataagaaatttgttacctccttaataatgggtatttgttcagcctgtgaaccaatgtgttttttttttttaagtaaaatccacggctaggcatggtggctcacgcctataatcccagcactttgggaggccgaggcgggcaaatcacctgaggtaaggagttcgagactagcctggctgacatggtgaaaccccgtctctactaaaaatacaaaaattagccaggtgtggtggcaggcgcctgtaatcccagctactcaggaggctgaggcaggagaatagcttgaacccaggaggcggaggttgcagtgagctgcgatcgtgccactgcactccagcctgggggagaagagcgagactccgtctcaaaaaaaaaaaaaaaaaaatccacatagcaaaatttaccattgttactgttttcaatgtgttttttaaaaattcaggtaagttttgtatactttctgattcttaagttggaaaacaaggtaacctctaatatgggctgtgaggccttcctctgcccaagcagttgcagatatgaaccctgaatataaagagatcttaggctagaaaggatcttgggcagagctgaatggctctaagcatttgacctcacattggtttcctcctgagaagagtcaacagagtccagcatcttcttccaaggtcagggaagggcaaagatttgaaattaggcatcactgggttctcagctgggcctccaagttcccctcctctcactatgcagagcaaagaggaggttgcagaagagaagaggatatgagattggttctctgctcctccctttctttccctgctttccccacacccaccctctcccccacagcagccttctcccccacagaggctgggataggatgaggggggcggagttggggactgagggatcagaagccccaggatgccctgtatctgaagaaagatttggccaggggcagctgtgctggcttatgctcttctccttctgctgctgccatcctccagcaagatgctagggtctttggggctttgggcattacttcccacagctgtggaaggtaagtgtctacagggaggggaagggtctctccatccatccagcaagggaaaggggcgcttgaagcaagagccacccctttggaagagtggtgagtgggctgggtgagtaagggtgaaggatagagccatgtgtccccatggcagggctcaggttccaggcctctgctgaccctgcttcctcctgtggctttaccatactgacgctgggatgtggaacatgttttgtctattcttttggccagttttttgcctctgcattcactcccaccttgaatcttttcctttccccaccctgggcctcagcacccccaaacaggcgaacctgtgtgttctttgaggcccctggagtgcggggaagcacaaagacactgggagagctgctagatacaggcacagagctccccagagctatccgctgcctctacagccgctgctgctttgggatctggaacctgacccaagaccgggcacaggtggaaatgcaaggtgaatggcaaagtatatggcaggtgatggctagggtgggagacagacacatcctggggtgtgggtggcaaccaagggggaaggggagaaatagaacatctggtgggaaagaaaagcccatgagagctggaagggacgcctctgatagagaagggatttaccctctgtttccacaccccattgtgctttcttccttgccccccctttctctcctcttcccctaatcccatcccatcaggatgccgagacagtgatgagccaggctgtgagtccctccactgtgacccaagtccccgagcccaccccagccctggctccactctcttcacctgctcctgtggcactgacttctgcaatgccaattacagccatctgcctcctccagggagccctgggactcctggctcccagggtccccaggctgccccaggtagccacccaagggtactgaagcctgatgggggctggggcccaggttaggatgagaggtggaaccagggccagttctcaccctactcccgccccacgctttcctcctcctggccttgggaagttggttgccctggtgactgggagataaggggtcttgtgaccagggtgggggtgggttgagacgcaagctctcaggaggggaagagcagagagcaggtttgggtcagtgctctccagcctgcattcttgccttgatgtccaggtgagtccatctggatggcactggtgctgctggggctgttcctcctcctcctgctgctgctgggcagcatcatcttgggtactaatccaccccatccctcccttgtgaccccaagacattgccccaaaagctctgacccctctccaggcacccctgaccccatggtcttgggatctctatagcctgattcccggactcccatgacctctcacaaagctccctttccacgaagtcccttttcctgtccctatgcatttgcaccctgaccctaaggctcttgtctgttccagccctgctacagcgaaagaactacagagtgcgaggtgagccagtgccagagccaaggccagactcaggcagggactggagtgtggagctgcaggagctgcctgagctgtgtttctcccaggtgccccagggagggagagaagggctcctctgggcactcctggaggttgtgctggggaggaatcctggccctgttatagctcagaggcccacactcagcacagtgtccccagcaggtaatccgggaaggaggtcatgcagtggtttgggccgggcagctgcaaggaaaactggttgccatcaaggccttcccaccgaggtctgtggctcagttccaagctgagagagcattgtacgaacttccaggcctacagcacgaccacattgtccgatttatcactgccagccgggggggtcctggccgcctgctctctgggcccctgctggtactggaactgcatcccaaggtgagcaccaaggagtgtatatgtgtgtgtgtgtgcctgtgtgtatgtatagaggtgggggctacatggcagctgggccctgttgattgcttctgctttcgattttctcttttctaaaacattaaaaatggccaggcgaggtggcccacacctgtaatcccaggactttgggaggccaaggtgggtggatcgcttaagcccaggagctcaagaccagcctaggcaatatgaggaaaccccatcactgcaaaattacaaaaattagctcagcatggcagtgcacacctgtagtcccagctactcaggaggctgaggtggaaagatcgcttgagcttaggaggttgaggctgcagtgagccgtgagcatcccactgcactccagcctgggagacagagcgagaccatgtgaaaaaatagtaacaggctgggcacggtggcagacgcctgtaatcccagcactttgggaggccaaggtgtgaggatcacttgaacccaggaattcaagaacagcctgggcaacaccgtgaaaccccacctctacaaaaaacaaaaaattggctgggtgtgatggcacatgcctgtggtcccagctacttgggaggctgaagtggaaggagcacctgagcctggggaggtcaaggctggcagtgagccaagattgtgccactgcactccagcctaggtgacagagtaagaccctgtctcaaaataataatttttatttatcttttttattacataaacaatacatgtttatatatttttattttattttggtgggaggacggagtcttgctctgttgcccaggctggagtgcagtggcacaagcttggctcactgcaacctcagcatcccaggttcaagcgattctcctccctcagcctccccagtagctgggattacaggcgcttgccaccacgcctggctaatttttgcatttttagtagagacggggtttcaccatgttggccaggctggtttcaaaatcctgacctcaagtgatccacccatcttagccccccaaagtgctgggattacaggtgtgagacaccgtgcccagccaaaaaaaaaaaaaaaaaaattgttaaagaaatatcttcaggcacagccctccaaactcattcgtattcattcaacaaataagtatgaactatatgtcaggcactatgctagaggccacaaaaaacacacagtccctcttttacagattttatagactagcaggggagacagaaatggatcaagtaaacacgagtgtcaaatgtcaagtgtgctaagtgctaggagagagggccaatgaactataagaataataagatgtgacttgaaggggagagcaatgagcaacaagaagaggaaaaggtaggcagaggccagccacaccaggccctgtgggcctgttaaatatttggggctttttaagttttcataccatttcccatctgcttcctgctaggcattacgctacccgctttttattttattttattttattttattttttagacagagtctcattctgttgactaggctagagtgcagtggcacaatcttggctcactgcagcctctacctcctggtttcaagcaattctgcctcagccacctgagtagctgggattaaggcgtgccgccactactcctggctaatttttgtatttttagtagagacgggatttcaccctgttggccaggctggtctcaaattcctgacctcaagtgatctgcctgcctcggcctcccaaagtgctggaattacaggcgtgagccaccccgcccggccatgctacacgctttaaacacatttccaaacttacccttcacaaacacattatgagataggaatgattatccacatggggctcagaaaaggaaagtcatttgcccagaatctatgtgactctagagctggctcctcatcatcgtgtctattgcctcctgtttacccctccatcaggactgtgtgtgtctctgtccacgtggaagagctccccacaactcactttgccctattgtaagtagttcaacctccaccacctgtttcagagcccaaatgcagtggctcttccctgaactttttcagcacctacagcttctgtacttctgaaatcttgaatgatggaaagtcccttctttgaccatatacctcctggcccagctcaaaaatcactgtttttttgtttgtttaatttctctgacttctccaggcagggttagtcattcttgctttatgccccttggcactcggttaattttcctatcttggggtttactgcattctttatctcttaccttccctgagccatcttggtgcctgaacacagttcgtggccaccgaaggtgctcgatgacacttgttgaatgaggggttctattgctcccttccctccaattcccacttgccctccacctgctactctgttatctactggctctgcccgtctatgtgtacacatgcctgacacctcagacaaggtgactcatgaaggatgcccctgactagcttgccctgcctcctctgttactgtctttgccgcatgtcttctgagtcagtataaggtggtggttattagtaagtgatcctgagtcagactgcttggattcaagctccactcctgcctcaccgactgacttcaagagagtttccttagttctgtaaggaaaagctcttcatctgttaaatgggggtgtgacaggagcacctaccttctagggttttcacaaggattacaggaggccacatccactgggtctggaccacagtaagtgcccagtacccttgatctagagttactatttttcatgtcaattgatgcacagtcttactcctctacctattgtcttggccagcatccatcagtgtgtctgtctgctggggagatgcagggagaagactgtcaattgatctctgctccctgggatggatcagccgtctccagctttgtgtaccatccttttctctctgcgtttccccagggctccctgtgccactacttgacccagtacaccagtgactggggaagttccctgcggatggcactgtccctggcccagggcctggcatttctccatgaggagcgctggcagaatggtgggtgagctgggcataggaagtcaagggagccacagtgctatgtttgtgattctgccttagtttggaggggaaagattgggtcaaaagagggaggaagagccgggcacggtggctcacgcctataatcccagcactttgggaggccgaggtgggcggatcacaaggtcaggagatcgaggccatcctggctaacatggtgaaaccctgtctctattaaaaatacaaaatattagccgggcgtggtggcatgtgcctgtagtcccagctactcgggaggctgaggcaggagaatcacttgaacccgggaggcggaggttgcagtgagccgagatcgcgacactgcactccagcctgggcgacagagcgagacgccgactcaaaaaaaaaaaaagagggaggaagaaaatccatgttccttcaaccttggattcccccacaggccaatataaaccaggtattgcccaccgagatctgagcagccagaatgtgctcattcgggaagatggatcgtgtgccattggagacctgggccttgccttggtgctccctggcctcactcagccccctgcctggacccctactcaaccacaaggcccagctgccatcatggaagtgagttctctggataactggtgaggcccaggatgatgttggtgctgctgatggcaatgcagccattgtgtgtcaacagttgtagcaatacctatagcatttgggacattgctgagtctgtagttggggggatattgcatggaccattgctgcaatgaggattgccacagagatgattcttggcccttcgtgccttgctctccaggctggcacccagaggtacatggcaccagagctcttggacaagactctggacctacaggattggggcatggccctccgacgagctgatatttactctttggctctgctcctgtgggagatactgagccgctgcccagatttgaggcctggtaaggatgggtggtacagtcccctctcctgggctcccccccgcccattctaggttcaccccaacctgacctggcctgagaaagctctgctcttccctgtcttgccctttctacatggtaggcacccctaggactaactgatacccagcccctctaccttcctccagacagcagtccaccacccttccaactggcctatgaggcagaactgggcaatacccctacctctgatgagctatgggccttggcagtgcaggagaggaggcgtccctacatcccatccacctggcgctgctttgccacagtaagaggcctaggctgttggtctgggaacctggagagtgggggctgggcatgggcttcaaggacgtctctgccagagtgtctgtctactcctatctccacttatctcccatcactccttggttcatgctcagctggaactgggcaagcctcctctccccgtcagttcatcctcttccaccctaagtctcacacagtcgattccatctacctgagacacacaccttcctcctgctcaaccttgcccagcctgtctctcctctctgccatcagttagccctgttcctcagtccccttctccaggaagccctccttggctttgctcttgccctgagctctgccccatctgctctcctaatacagtaaagcccaaaaatcaattcaataagtccccattctgtcatacattgatgatgtttctgctgtgacccaataaaaggcagttctaggtataaaaggtgaaagcagtggcgtcacagtgaaagttcagggctttgcacaaatacttttttaacaaaatgtcccttctgtacctgatctgaaatttccacggcacaagtcttaggttggctgacagaaactgggcattacttgcagaagactctggctctctgagaggaaagagagtaatttcccattagcatattaagctgtcaacctacattagctcctcagaggaaacagtgggctatacagaaggcccccagagagcctgtttcatagggagcaagactcagagggctggaattcagcaagagggagaggagggaggctccaggaaagatcagaagtggatgttgaaagcaggagagtgatggacactgaagatggcttttaaccctggggcccactcaagatcctagggtcaacccttcctccctgtcattccccccaggaccctgatgggctgagggagctcctagaagactgttgggatgcagacccagaagcacggctgacagctgagtgtgtacagcagcgcctggctgccttggcccatcctcaagagagccacccctttccagagagctgtccacgtggctgcccacctctctgcccagaagactgtacttcaattcctgcccctaccatcctcccctgtaggcctcagcggagtgcctgccacttcagcgttcagcaaggcccttgttccaggaatcctcagcctgcctgtaccctttctcctgtgtaaatatgcagtttatgtgtcatcaatgtacatgccaacataaatatggcgattgtatagctgtcttgtctgcctcatcactgcatttcccacctgccgaatccttggattcttctgcgggcatccagtccacatcagttctgaccagtgacttggggtaggtgtgcacaggaaagagaataaagtcagctttcctgatgcatatccttggtccttcctctattcctgtaatccagggaccctcttgtctctcttcttttccactaacatttatttttatttatttatctggtttctttttttggagacagagtctctgtccagtctggagtgcaatgacacgatcacggctcactgcagccttgtcctccctgggctcttgtgatcctcctgcctcagcctcctgagtaggagggaccacaggcatggaccacgatacccagctattttttttttttttgagacagagtctcactctgtcacccaggctggagtgcagtggcacagtctcggctcggtgcaagctccgcctcccgggttcacgccattctcctgcctcagcctcccgagcagctgggactacaggcgcccaccaccacacccggctaattttttttatttttagtagagacggggtttcaccctgttagccaggatggtctccatctcctgaccttgtgatctgcccacctcggcctcccaaagtgctgggattacaggcatgagccaccgcgccccacctgattttttattttttgtacaggtgaagtcttggtatgttgcccaggctggtctcgaactcctgagctcaagcagtcctccttcctcagtgtcccaaagttctgggattacaggcatgaaccactgcacccagcattttaaattgtttattattttttaaattttatttatttatttatttagagacgggggtcttgctctgtcgcccaggctagagtgcagtggcacgatcttggctcactgcaagctccgcctcctaggttcatgccattctcctgcctcagcctcccaagtagctgggactacaggcgcccgccaccacgcccagctaatttttttgtatttttagtagagatggggtttcaccatgttagccaggatggtcttgatctcctgaccttgtgatctgtccgcttcagcctcccaaagtaaattgttgattatttttatttttatttttgagataagctcttgttctgttactcaggctgtgatcatagctcacagcatccttgacctcctgggctcaagcgatcctcccagctcagcctcccaagtagctgggactacagatgtgtgccaccacacctggctaatttttgtattttttcatagagacaaggtttttccatgttgcccaggctggtcttgaactcctgggctcaagcgatccacctgcctaggactcccaaagtgctgggattacaagtatgagacaccacacccagcctcaacatttatttttaaaggtgggatctcatggtgggcactggggaaagaagggtaaagacaacaaaatcactgccctaacagtgcttaaagacctgcacaccacattgttgggttcctgtacgctgtcctgggggtaacaggagagacttgagcaggaatgcttcacagagcacaggatgcttgagctgtgtcttaactgagaggagtttcccaggagcatgttcttgtccctttctgtgacccagctctcatccacatccagtcagttctcaagtcccactgaggcagcctaggcaggggctacttctcctttttcttttcttttatttttttgagacggagtctcgctctgttgctcacgctggagtacaatggcgggatctcagctcactgcaacctctgcctcccgggttcaactgattctcctgcctcagcctcccaagtagctgggactacaggcgcccgccaccacgcccagctaattttttgtattttgtagtagagacggggtttcactatgttggccagactggtctcaaactcctgacctcgagatccacccgtcttggcctcccaaagtgctggg

SEQ ID NO: 13672 - DNA, 15368 bp, Human
  misc_feature (1)...(15368): n = A,T,C or G
cctttttggagcctcactgctcccttgcggatttgatttcttgcttcaagcctcgtagtaatagtcccaggattctcagcctcccctcagatctccactcaccagcaagtaaaataacttgttttgtatgacttatgcaggtgaaaacgtttttaaagtgtagttgagtctctttcaggagatactatctcaaggaccttgcaataaacagtccatataggtagcagtgcagaattgagttgcaatgcccttaactatagaagcagtgatgatgatggtgatgatggtggtgatggtggtggtggtggtggtggtggtgacgatgatgattttaatgctagcaattactgaactcttactgggtaccaagtaccttgctaaaagcttcatatgtattatcccaatattggctgtgtgataagtactattattcttctcaatttacataggaggaaatagatttagagggggttaaacagctagctcaagatcacacagcaatttgggaacccagatttgtctgaacgcagaacccattattctatgagggcaagggagtgttaaacatcgcaggctgtaacaacttttggaaagagccagctttagcttcctcccaggccccttctctgatcctcctctgggattgttagccatatctgagtgtctaaattgtcgcaacagctgcaacagccgtttgggggtggtggctcctaagaactgtggactttctctgccactgaggatgtgaagctgacagcttaaaagaattccgttttggtgggaatggagatgtctggagacctcaggggataaacttgtgtctttgctagcctgtctttctcctaacagcatctccacagtgcctggcaccacttggtacttgataaatacctgttgattgattcccaaagatcccagttccatttcccacgtacctgcccgctcggggcgcaatcaacaactaaaactggagatttggggatttcagaggaacctgtgagaatcctgatggagctggaaacgcgaatttaggaaagacaggcagtctaccaccctcctcttctcgcccgcttctcctatttctccccactccttcccctccctttcaggagctcagggccataaaaatgcagatggaggatcggtgtgaaataacgggcccatataaatccctctgccgcccgcctgcaagatggattggccgcattgaaattcctccgcgaggataattaaactcggggcctcatccgggcaaaattacattcctgtaatggcgtcgctcggggtcccgggaaattgctccgtgggctttcagcggcggtttttatcgccggccggggtgtgcctgtctgcggctcgcctctcctccgggaccgtaaagctgctgccgtgatttatcctccccttctcccaaatccgattaaatggaggagctcggggccggggcgccgcggggcccgggagccgggagggggcggcgggaaggacggggccaaggaggggaggacaaacggcccctcagagagtggcggatttgcctttatttacagccgcggctttctttttattttttattttttatggggtttggtgagcttttcccgtctttctcgtgctgcgttcaagcacgatgcagggacggcaggggtttggaactggataggccttgtcgccctgttccaaagggcagggcaggtcctgtctgggagacaaggaggcctaggaaagatgagggccaggaagcctcccccacctccttccatcaggggaagggcgagcgaaaggggagagaaaacccacgttcaggagagcatgggggcgggaggggagggcgctgcttatcccaactcgcgtagttgaaacctgagcagaggctcgggcaagcctggagtgacctcgcaaccttacagcgggtcgcaggtgcccgttattcctagactgtcccaggagccaggaaagagggattcggatcatatttaaccctatcttctggctcgctgatgctgcttctctcatggtttatcaccggaatggaaaggaggaaacggggagtgggggaaagggcgaagccaccagaagcagctgcggcattttgctgactattcgcccatggagccggtttgccatccagtgatgccagagtcccggcgcgacagaaagcaggactcccaagatcttcctcctgctgcattttaggcactgaaccccaatcccgaccgtatgttaacactgaattctgagtaggagttttgttttggcagtgtgacgactgcgcatgctcggaaaggggacgcaagtccgagatcccaaacgcggtacagaccaaaccgcagtccacgttacggatcggcttactccgcggagttggcctcatttctgcacagtcggcgctccctgtagtttctcctctcgaacgccaggtggagcaaccggccggataccgccacagccctggcaggcggcgctgtgatgcctgagctgatcctgtatgttgcaatcactctatccgtggctgagcgactcgttggcccgggtcacgcatgcgctgagccttcctttcgctcttcccgctgctccgcccctctctgtcttctctgcagtgggagcaggtaaggccttgggacctagagccctctgtgcgctgcgcacgcgcgcgggacacctcaccttgcgcggatgctttgaggcgcttaccttgcgtgctcccaccctggtcctctcgccctttcttgcttccgctatcccttagccttagagttggctcttccgcgtgccggtgacctccaaccgcgcgggcctggcgccatcttggatgtctcgcagggggaggataccttggagctggccaaagttagatcctggagtgctgcttttcacctgttccacccagtccctgcaaacactcttttctcgccctctggccctttcagattgtgacaacccccaggctctcccctcctatctctgctttctcttctcatcctgacttgtgccttctttattctgaaatctccagactttaggccccagaacctcaggtgctccgagcaatggagatagtggatcgtctaaagtcaccaatccctctagtcagcacccctcaatttaaaaagtaaaccttgaacatggtagaagtgggaaaaaaagccaaaacatcgcctcccgttaggttgtggcttgggatagctaaggcagaagagagaggctggttgctttggaatcactagttatttaccagtacctttctcgcatcccggcacgctggtgaagttgtaaaagtcacaaatggtgggctagagatgagggtttctgttgaggcagcaggcccagaaaggtggggtaaggccaagctagtggggccagcatgagaccctgcctgccagctttcctgtgaaggattaattaacctccccagattctgctgttacaaggaaaagaaggtttaaggaaaggaatagttaagttactacccctgtgactcatctacactgaggaaaaagcccgtgatgattttggagtcctgattctggatagtgcctttgcccaagttgtaggctaacaattgcagagttgccatggttagatagccaatggtgggatcacttaattgccaccccttgttgtgggtttattatatgccagcaccacattaaactctttatgtatgttaatttgtaaatgaacatacttaatccccctaagagctgcattttacaaagaagataataaggtataattcccttagaaaagaaccaccccttctttttctaaaagccttaaagaactattggattttgacccaagaaaacctgaatagtacggcagcaaaattgggttagagttacatataggcaaaaatcagagttctagataggacaagagttgaagacatccattaacttaaaagtaattaaggctgggtgtggtggctcacacctgtaatcccaacactgggaggccaaggtgggaagatcttttgatgccaggagttccacaatagcctgggcaaaaaataaattaagagcaattaagatgttggattcagaagtgttttaacctgggacaatctgagttcagttcatttaatgaagtggtatttaatagccctaagcattcactgagtatttcagcctgtgacatattagaaagcatgtaacttaaaagatccaagttcaagtctatcctctaccactaccacagtttcaagactgggtttagggtcacgctcttgcgttaagtatacctaataatcatctgggaaacttgtttgaaatacagggcacttgagccttattcccagagatcttttttgtttgtttatagacagggtttcacgttgttgcccatactggacaactggcgtgatcatagctcactgaagcctccagctcctgggttcaagcagtcctcctgcctcagcttctggagtagctgggactacaggtgcacttccacctcacctggctaattttatgttttgtagagatgaggtcttgatgtttgcccaggctggtctcaaactcctggcttcaagttatctttccgccccagcttctcagtgttgggattacaggaatgagccactgaacctagctcccccagagatcttgaccaggaaggtccaagttgcgcccaagaatatgcattttttaatacgtacaccacccagataattctagttcagatgggcttctcacttcacttggagaaaccctgcctttaggtttttaactcaccttctgtttgaggtaagttcacttctaccaacttagatacctatagggtgtcagatcttctttagatcttggggagacacaatttaatacttttttttttttttttgagacagtttccctcttgttgcccaggctggagtacaatggcgcaatcttggctcaccgcagcctctgcctcctggattcaagcaattctcctgcctcagcctcctgagtagctgggattacaggcatgcaccaccatgcccgactaattttgtattttcagtagagacggggtttctccatgttggtcagcctggtctcgaactcctgacctcgtgatctacccgcctcagcctcctaaagtgctaggattacaggcgtgagccactgcgcccagccactaataccttttggatagactaataacagagttcctccttgatcttcctcatcttattaatacaggaaattgaagtattttcaggaatcagatacttccagggatcagcaaagagattgttggagaccttccagtgtcttggccttcaacaaatatctcccaaaactacaaagactctaaagggcaactttttgtttgtttgtttgtttgtttgtttgttttgagatggggtctcgctctgtcacccaggctggagtgcagtggcgtggtctcgtctcactgcaacctccgcctcctgggttcaagcaattctcctgcctcagcctcctgagtagctgggattacaggcgcgtgctaccacacctggctaatttttgtatttttagtagaggtggggtttcaccatgttggtcaggctggtctcgaactcctgacctcgtgatccgcccgcctcggcctcccaaagtgctgggattacaggtgtgaaccacgtgcccagcctaaacggcaacttttaaaggtccagatgatgaagtcttgagaagcgttccttttgaataaaaactaaggaaaacttaggcaaaagacactctgggaaaattcctgtggcaactgcaaatcatgaggctatggaaatgggtaacaggtcttacctgaacccaagtgttcacttgttcagaccaggggaagtcacttcattataaggaaatcttgggagctgtgtggggtttctggaagaagtcatgacttcagggttttaattctatttctgccaatgacttaaggtcagtcactgttttctgggccagttaagctttctagggccccttttctgctaataaggatatagtttagtgaataaggagcgtttacaatactgcttctgtaattccagctctcctgccacagctcctcaccccctgaaaatgttcgcctgctccaagtttgtctccactccctccttggtgagtacctgcttttctgggagagttttaaaggagagacatcttgtctctctctttccatcagaccttgttcttcacagcaaggctgggggagaggaggtccaggcgggcagatcacttgaggccaggagttcaaaaccagcctggccaacatggcgaaaccccatctctactaaaaaaacgaaaaccagttgggcatggtggcgggcgcctgtaatcccagctactcaggaggctgaggcaacagaatagcttgaacccaggaggtagaggttgcagtgagccaagatcgcaccactgcactccagcctgggcgtcagagcaagactctgtctcaaaaaataaataaataagtaaataagtaagaaagattcttggggagggaaggccctctgctatgattgcgtaacaggatagagtgaatgcttgctagatactctcctgccccatatcccttggcggccagttaattttttttttttttttttttttgagacagagtttcgctcttgttgcccaggctgcaatggcgcgatccaccacaacctccgcctcccgggttcaagcagttcacctgcctcagactcccaagtagctggggttacaggcacctgccaccatacccagctaatttttgtatttttagtagagatggggttacaccatgttggccgggctggtctcaaactcctgacctcgtgatccgagtagagacagggtttctccatgttggtcaggctggtcttgaactcctgacctcaggtgatccgccgtcctcggcctcctaaattgctgatattataggcatgagccaccgtgcctggctgtgcccagttaattcttacccagccatcttaggagaagaatagagatgagaatctagaccaagatcaagttattcctactcctgaaactatatgtcgtgtaagctggccatccagagtggtaaatataagtagattacataacttggactgagtatgcactgtgtgtaggatcttgtcctgagttagccatagctaaggagttcattctgggacttaaatttggataggaagctaaaatttacataaatacacattggaaaagtatttgactcagaaacaacagtatggaagaaatttttgaaatagtagctagaggaggcggttggttcattcacaaataaaaaggagtaccatttattgagcatttaccatgtgccttagcactcactgagtttactaattggtatacataatctcatttactcttcaaatcaaccccaagagatgatattttgatttcataaatgagaatacaggcttagaaaggtttaagtgacttatcctgagaatacactgctgataatagaattaagatttgaatctcactttatctgatgcctaaagccctggctatgaatcaccatgtgtctgttttggtgtcactggcttggggttagtcagaaaaggctaccagaaggaggtgagttttgagcatgaatctttgttcctattttccaaaaggatgtgttcagggaaagttactggcttctttcttgtgggctgaccattacccatacagaaggcccccaactttagattaagattttttttttttaactttatgatgatgcaaaaatgatatgcattcattagaaaccatacttcgggctgggcgtggtggctcatgcctgtaatcccagcaccttgggaagccgaggtgggtggatcacctgaggtcaggaattcaaaaccagcctggccaatatggtgaaaacctgtctctactaaaaatacaaaaattagctgggcgtggttgccggcgcctgtagtcccagctacttgggaggctgaggcaggagaattgcttgaacctgggaggtggaggttgtagtgagccgagccgagatcacgacactgcattccagcctggcgatacagcaagactccgtctcaaaaaaaaaaaagaaagaaagaaagaaaccatacttcgaattaggaatctttatcttttcccaagctagcaatgtgtggtacaatactctgttgcaatactcagcaggaacccacagctcccagtcacctgcccaatcacaggggtaaacaaccagtactctacggtgtactgtgttgctaggtgatttcacctaactgtaagctaatgtaagctagtgtaagctttttgagcacattgaaggccagactatggtgtttggtaggttagcagtattaaatggtttttcaaagtatgatggatttattggcacataaccctatggtaagttgaggagcatctgtatatatttcccttgttgagtgaggcaaatgcttctgaggcttagatttcttcttaagttctcaagagctataaaaggatatagcaaggttggatgctcccttatggcccaaaggaagtagactttctttccttaaagcaaagtctgagaagcaagagaaatggtgtggttctttaatttagactttgctaaaaggaagaatgatccaaaactctaacgtacatgtgaagatggaaaggccatgagaggaaagaaaatcttgtctgatgatgtaacaacgtggcatagttctgaaactcctctccagtcttccttgaccttcctgcccctgtatgtcattcctgctaggtcaagagcacctcacagctgctgagccgtccgctatctgcagtggtgctgaaacgaccggagatactgacagatgaggtaccttacagtggagttgggactgtggttttgggggtgatgggtggggagggttacctgccagaaccaggaggtagaatgctgaggacagtcatcacaggctaaaattcatgaatggccaaggccatgggctttaggtggagatggaggacacttaatacgctgtatgctatagtgctccagcttttgccactggcagcacatgcccctgtgcactgctgctaactggtattacttggcctagtctactgacttcagttggaagcatttagtcctaggaagatgatctccttggggcagcaagaatagactagggcctcagtcttacacttcttgaccacacctgaatcttaaaggcatttgaagtctacatcctacgttaaaaggttctacttgccagcattttagggcgttaaacaattttctgtttgggggagaaacaatgggatttggcagcttaaagggttttaaatggtacaaaagttaccaaagcaaaaaactttaccttctacctgcctctttttcacagagcctcagcagcttggcagtctcatgtccccttacctcacttgtctctagccgcagcttccaaaccagcgccatttcaagggacatcgacacagcagccaagttcattggagctggggctgccacagttggggtggctggttctggggctgggattggaactgtgtttgggagcctcatcattggttatgccaggtaagataagttggaccctccactggttatctgatatgctttccaaaggtcagaaaatatttgggggtctagaactatactatcccacactgtagccactagctacatgttgtttgtttgtttgtttgttttgagacagtaacgctctgtttcccaggctggagtgcagtggcgcaatctcagctcactgtcacctctacctctgggttcaagcgattcttgtgcctcagcctcccaagtagctgggattacaggcacacacaatgacgcccacctaatttttgtggttttagtagagatggggtttcgccatgttggccaggctggtctcaaactcctgacctcaagtgatccacctgcctcggcctccctaactgccaggattacaggcatgagcccccgcgcttgacctgaattttagttttaattaattaaaaatacatagtttcagttttcagttcttcagtcacgctaaccatatttcgagtgctcagtagccagatgtggctagaggctaccatattcaacaatgcaaatatagaatgtttggctgggcacagtggctcactaatcccagcactttgggaggccagggcaggtgaatcgcttgaggtcaggagttcgagaccagcctggccaacatggcgaaaccccatctctactaaaaatacaaaaattacctgggtaaggggggcgtgcacctataatcccagctattcaggaggctgaggcagaagaatcgcttgaacccgggaggtggaggttgcagtgagctgtgagccgagatcatgccactgtactccagcctaggtgacagagtgagactttggggaaaaaaaaaaaagaaaaaaacaaatataggctgggcgaggtggttcatgcctgtaatcctgcactttgggaggtcaaggcgagtggatcacctgacgtcaggagtttgagaccagcctggtcaatatggtgaaaccctgtctctgctaaaaatacaaaaattagccaggcgttgtggtgggcgcctgtagtcccagctactcgggaggatgagacaggagaattgcttgaacccgggagacagaggttacagtgagccaagatggtgccactgcattccagtctgggcaacagagtgagaccatcaaaaaaaaaaaaatttatatatatatatatatatatatatatatatatatatatgtgtgtgtatgtatgtatgtattagaatgtttatatcattgtgtcattgaagaaagtttcatgaacagctttggtctagagcatgtgttggcaaactaaggcctaagggccaaatctgggccatagccaggttttgtatgattgagctaaaaataattttatggccgggtgtggtgccttacgcctataatcccagcactttgggaggccgaggcgggcggatcacgaggtcaggagttcgagactagcctggccaacatggtgaaaccccttctctactaaaaatacagaaattagccaggcatggtggcagatgcctgtaatcccagctactcaggaggctgaggcaggaaaatcacttgaaccctgaaggcggaggttgcagtgagtagagatcacgccactgcactccagcctgggcaaaagagtgaaactccatctcaaaaaaaaaaatagtttcgcatttttaaaaggcttcatttttgttttaaagcaaaagagactatatgcggcccacaaaacctaaaattatttacaatgtggccctttacagaaaaagtttaccttccctgttctagagactcagtgaacatagtggctttactgctattttttcccatctctgggaatttccctctgtcactcctgggaaaactggcactgcagccagcccctggtttctgacacctgggactgtttagtactcccagctctggataactcagttaaaaccaaattaatcctctagagaccaggaagttctcttaatgtcttttgagaaatagagttctttttaagaatttgtattaaacaagaagtctgactgctgctttattcactattctgttaaatgttggtgtcgatttaccttacccatcaagacttctggaggtatcagagtaagggaaatacagattatatatgggccttcaacactgggagtcctttatccatactacttcaactcataaaccccatagaccatttgtaacttcttttttttttttttttttgagactgagtctcgctgtctcccagactgaagtgcagtggcacaatctcagcccactgcaatctctgcctcccgggttcaaatgattctcctgcctcagcctcccaagtagctgggattacaggtgcccaccaccacgcccggctaattttttatttttttattttattttattttatttttttgagacagagtctgactctgtcacccaggctggagtgcaactgtgtaatctcagctcactgcaacctctgcctctcgggttcaagcaattctcttgcctcagcctcccaagtagctgggattacaggtacgcaccgctacccccagctaatttttgtattttttttctttcttttttttttttgagacagagtcttgctctgtcgcccaggctggagtacagtggctgcggtcttggatcactgcatcctctgcctcccgggttcacgccgttctcctgcctcagcctcctgagtagctgggactacaagcgcctgccaacacgcctggctaattttttgtatttttagtagagacagggtgtcaccgtattagctaggatggtctcgatttcctgacctcgtgatctgcccacttcggcctcccaaagtgctgggattacagacatgagccactgcgcccagcaatttttgtatttttggtagagacagggtttcaccaggttggccaggctggtctcgaactcctgacctcaagcaatctactcatctcggcctcccaaagtgctgggattacaggcgtgagccaccgcgcctggcctaatttttgtatttttagtagagacggggtttcaccatgttggccaggctggtctccaacttctggcttcaagtgatccgcctgctttggcctcccaaagtgctgggattacaggtgtgagccaccgcacccagcccatttgtagtttcttaaagccccagatcttctgactatttgaaatgagagaacataatctgtccctcttactcttgtcttctagaagagcggtgttccataaatccttaggattctgaggttatgccccagagactgtcttagagaataaaggggagaccaagccgttaaaatttccccactacttttgtaccattgcagtttggcttttagatgtttactatattggagttctgcttaaagtttgaaaacactgctctagatagacccttccactctggatgcctcttccatcctatttgggccctggatattaagtgtctgggccaagaggtcttaatttgtggtaatgagatgggtgaaccattagtgaaggtcatgattatacctgggccatgttacaggattttagattgcctgctcccccttcattcagttcctgtagagcctttggggaatcagggcaagaatttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttcttgagtctcctgtgtatatttcttttccacagttggctgagtgccttcgtgagagtacaaggcccgaagggtagtgatggtgctaaactcaacatggatttggctgagctcactttttcttaattctgtttcaggaaagctttatttgaaatagcataacattttaaattattttcacctggcatggcctgctacttgcctgggaagattggggtcagtagcaacttcaagttctggcttaaaatgttggctaataggctttctgtttccactgtcactctcctggctcaggcccttattgtcatccacctcgtctattgcaagaacctcttaactggccttctgcctccagtctcttccctccagcatttacttctccttaccactgccaggtgaatcctccttaagcataagactggttttatcagttaatggttcaaaaagtcacctcaactttctctgctttatctgtttagtcctatacactacataaagtgactgtcatttttcagatgttttcctgtctttaccatatcttcctgccttttcctttctctgctcatttctgctttctttccctgcatctttgctcactttcctctttttcgaactctgttatccctaaagacttaaatttaacctccatgaagctattttctggttcccatccaccctcagccaaaagagcattaaagagccaaaagagatcacaccactgcactccagcctgggcaacagagcaagactgtctcaaaaatttttttccaaatccttcattggattatttatttatttatttatttatttatttatttatttatttatttttgagataggctcactctgctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13673 - DNA, 9013 bp, Human
ttatccctggctgataaatatgacgggaaattttcgttgggtcctcgtaaaagggaacggtttcgatcaaactggtggggaaagactaatgcagataatacaaacagagtggccataaagtctcgcccgtttcccgcgggatgggcggtgggacaaatggctccctggattgactgctgcccggactgtcccaagtctggggcctaaacagcctaaccttgccctggataacccccatgctgaggccacggtgaccctgcatatgaaaacacaaaaccatttcaaatctcccctggccggtcctgcaagcaaatcatacactccacatttccttccagttttccggaggttcaggaacccctgcgtcttctctctccacccctggatggggaaattcggcggatttctttctgcggtcttctagccgcagcgggcttgggcctccttagaaacggtctagcctcctcactcctccactccagggcgctgggctccagtcctttccccgccaaactccagcccttcggaaagtctgaaccctaggctctgtccaaggaaaaatgtggggcgacaggaaagacaagttgttctccagattccgtttcctgaggaaggggtggagagtttagttcgctttggaagaaggcgatggagaaacggaaataactgtttgaaacatacggttccccttatttcttccttttatttaaaaacaaccacaaaaatagactggtctgtcttctttcaaacatgctcccagcccgtgcgctctgtaaaggacgcttctctgggtcgggttttgttgcgtcttgtgtgctggtttcccgtgtgatacgtgactcctccaaactgaccgaggctccgcaggttccctctttctttcccggaatattccctgttttagcgggggcaaggtcaagcggaaagcgaggaccgccagggcctgaagtaaagcagcagaaccggctccaaggccaaagccttgtgggcccctgagatggtgacccaggagccgcccaccctgccaggcccaggccacagctctcgggtcggggatcgggtgcctctggtctctggcttcctctttcccctaccccgcgtccattcggaacctccttttccgagcagccatgaagtgaccgtgaccccctccctggcccaccctagaggctggagattcccagtcaacccccacaggaaacttgcaactccagcgccgcggcccccaagcttccagccccgagggccaagcccggggaaaagaggaggcgggagagcagaaactttagtcctgtttgggattccttaactttttttcccctttctctgctcatcagatccccccaaacccccccccccacaaacctcaccccactcccatccccaaggtaagaagtgggagtcgggtccggggatatggaaaggggagatgaagagtggggagaagtacctgattcgtgtctcgaccttttaatttgaatttgactgttttgagccccgggttgcctcgctctctccctctctcccgcatttcccccctctccgcccccttctccccaggagttacaggctggttactggataaacaaaccccactcttcctagaacccccacccccacccccacccccctccacccctctacctcccctgccgcccggggggcgcttcctttgttcgcggggaagggctccggtgcccctaccccgaggcagctgctagatggcgctgttactccactctgcgcgctccgcctgccgacaacttgaccccgctgacgtcacggccgtctgaatcatcaaggccattttcaaatcccattggtctagccgtcacatggtgagaaccgaatgcgcggataattacggagctgatatttccccccctccccttctttttcctccctcccctccaaccgcgccccccctcccggatggggaaaaaaaaagatgtcagctcctccgctgtagtattgctccttaaaaacccctctctctgaaaatgacatgccctcgcaatgtaactccgaactcgtacgcggagcccttggctgcgcccggcggaggagagcgctatagccggagcgcaggcatgtatatgcagtctgggagtgacttcaattgcggggtgatgaggggctgcgggctcgcgccctcgctctccaagagggacgagggcagcagccccagcctcgccctcaacacctatccgtcctacctctcgcagctggactcctggggcgaccccaaagccgcctatcgcctggaacaacctgttggcaggccgctgtcctcctgctcctacccacctagtgtcaaggaggagaatgtctgctgcatgtacagcgcagagaagcgggcgaaaagtggccccgaggcagctctctactcccaccccttgccggagtcctgccttggggagcacgaggtacccgtgcccagctactaccgcgccagcccgagctactccgcgctggacaagacgccccactgttctggggccaacgacttcgaagcccctttcgagcagcgggccagtctcaacccgcgcgccgaacatctggaatcgcctcagctggggggcaaagtgagtttccctgagacccccaagtccgacagccagacccccagccccaatgaaatcaagacggagcagagcctggcgggccctaaagggagcccctcggagagcgaaaaggagagggccaaagctgccgactccagcccagacacctcggataacgaagcgaaaggtaaggccgcctgggccgcgggcgccactgggacgttccggcacttggtcttcgcggccggggaggggggcaggggagagggttgggcccaggaggccccagaccatttcgggaatgcgaccctggctttcgactagcgtccgctgagctccaggctggtggcgcgtcacttagctggggaaggtaagcggcgacgtggaggtgtcggccctgccccggccatgggtgctaaggcgggggcggtgcgcaccgcgggccgcctgcaggcgcagtgtgctgcaccggacgggtggctgctcccaggcgcgtgctggctgtggtttgctttctcaatgctggtgtcctggggagctgacgtcccccagctcaggtcaggggcttgcaaaaagcctaaaatggcgatcttgggccagggactagggaaggctggggagatggggggagttctctttactgcgttttcccagttgaaaattgtttcctgcgaaacgcgatttgttgtttgtgggtctgatttgtgcgtgcggcttgggctcctgcggcttttggctcggccgggggccttgggcagcgaggctggagccggaagaggtggaggtgaagggctgcccgccacgtccctccctcctccagatgcctggcttggatggcgttggaacagggcatttggaatgttgtaagttttctgtttcctcttttaattttttcttttccatttttttctagttaaattatcttttttcattggtttccaaaagcagcttacaaatgagtggttgggaaatttctgtgtgcgtggcaagaggttttctcctgaaagggaatgtggctttggttggatttcactgtaattttggttgagagaaagcccagccagagttcaagctcagggttcaagattcatttctgctgtaggagctgggggccttcgggatctttctctgatacttggggaaagaatgtggaggaaacgggagcaggggaggaaaagctgaggggaacgacttttcctgaaaagttgtagcaagagcctcagaaaaaggcccaaccaacggggaagaataaacctgctccccacaacaccggctactggtgacagtatataaggggctcattgggtgtagaggaagatgaaatactgagagcggagcaggctgggggcggcctggatctcctggtgctttgtatatggatgcgacgcacacgcatgcctacgggcgacctgtgccacactcacgcacatccatattgcatgatccttgcacactcacgcatgcccgctcacacatgcacaggcactcttttggcgggcaagggcagagcctcatccccttgggtctgcaaaggtggtcttggtaaatcatccccatagagacactgactggaagatgagcgctggtgtgttcatgaggataagggggagagtgaggcgcctacagcctcaaagcctttcgtttggcacgtgtgcagtgtgaaggtttaatcttataccctctctacagaccctgagcttggttagggagcagatttggggcaggaaaacctgcattctagcccccaccaaaagcaaagtcaaggttaacaagttcacctcttaactcgacctgcacccattcccataggctctccctttcctctagctgtccccacagcaacctaatccctcccaccccaaggaatccctcttaccctgtaccctctctgtgcccttctttcctctcctcctgttttgatgtctccaccaggccagaggcaagagagcttttgattaaacttccccatttataatttgtcttgtccccccaccccaccaaacctaacaactccagtaagaaaataaacaggacgtagttagatgtggagagcttgtaaacaatctggcaagaagctgcaggtgcagagacaggagagaaaattcgggacattcagatttttttagactgcaacctcaagtttgccttttttgtgtgttttctggttcctcttaggcccccgcctcaccccgcccccaacaagataagatccaggaacctggcagcctcattggaatagggaggagagagagctcagagccatcagcagagtcctttgctgggtgtcctctcaggtctttggactctgttttttgcccttaaaaagatggccaggttcccttctgctacttgagaagcaaggctggtccatttcagcaagaatgtgtgtcagggatagaggctgtcaataagctcatgggaaatacacagtattctatagtatctccttacaaaaaaagactcatgtacatatctatgtgtgtgtacttatgtgtataggtgtgtgtatctctgcaggtatacatgtgtacttgcaggcatacacatctacgtatgcacagactgggcagggggtttctaggaggctgcatttcctcaggatatgtctctcccttgaccttaggtcctttggccaggaaagttgtttgaggaccccttaggttgccccagctctgttgcccctgacctctgctgctcttacaagctcccctcagctgcacatacctgggagaaatgattaagagaggaagagatggcaatgggagacctaagggagcagagtcactctgtggcagctcaggttggggtaagagctgggggcccaggacagggaccactgcagtggcctctggccacagatcctggaacaaagtccctccactgagttgaaacaggtcaaagctctctgggaatttctctggtctgtgggtggactctgctctggtctggggcctggaaaatgcttttccatctggttggatttttccagagctggaatggaacagagagaaggggggatctggcaaggtttagggaatctgccagggtcagccagctgggggaaagccagggtactcaggatcttttagattaaggtggacttgggtaatttaaatttaataaatgcttggaggcaagaacttcctccctttatctccctaagtctaaaccccaaagaaattgtaagaaccttgagcctaagaggagcccaccgccaggcccctggggcaagagcagctcccctgtgctccctcagccaccccacagcaggctggcaaaggctgcagcgctgagagggttttcgacttcgagggatacttatgtaaataatgttatttttaacagaggagataaaggcagaaaacaccacaggaaattggctgacagcaaagagcggaaggaagaagaggtgcccctatactaaacaccagacgctggaattggagaaagaatttctgttcaatatgtatttgacgcgagagcgccgcctggagattagcaagaccattaaccttacagacagacaagtcaaaatctggtttcaaaatcgcagaatgaaactcaagaaaatgaaccgagagaatcggatccgggaactgacctccaattttaatttcacctgagagcgcggcctctcctcctcccttcccgctccttcctctccccgcccctcctccctttgtgcctggtgatatatttttttttcctccctgagtataaatgcaatgcgactgcaaaaaaggcaaagacctcagactctccttccaagggacctgtggttcgtgctgcgaagatgcttccacttaaagcatgagaaatggggtgccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccgcttgtaggggaaaaaaaggaaaaaaattaaccagagagggtctgtaatctcgcagagcacaggcagaatcgttccttccttgctgcatttcctccttagactaatagacgttttggaaagttcggctagtgttcgtgtgtttgtcgtagcacccagagcctccaccaaaccctctccatgtctttacctcccagtcgctctaagaatctgcttgaagtctcgtatttgtactgctttctgcttttctcccacccctcctagcacccccacatcccccatctagtaacatctcagaaatttcatccagaggaacaaaaaaattaaaaatagaacatagcaaagcaaagacagaatgcccccccccaaatattgtcctgtccctgtctgggagttgtgttatttaaagatattctgtatgttgtatcttttgcatgtagcttccttaatggagaaaaaaaaacctaataaatttccagaatcataatcctcaaatggatggttttttgtttttagtgatttttagcaacacccctcccccgaagaggctgagtgtgtggatgtgtgtgttttgtgtttgactcatctcctagagcctttctagaacgtctcttggcgggtttaatgtaagtgagagaccataacgttgatttaaatattatccaggtgaccacaataagtcaaggtcataaaacagtaatgtcaggacggtcttggtgcgcgcgagaggtggattttatgatctgcaaatataatgtggtgctgcagtaaaagatgcatttaaaggtgactggaggagggaaagaggcagagagcaagctgcaatcttgaggagcagacggatctgattgcctggggtgctgggctgggcgcaccccactgctgctgggggtcaccccaagagccccccacccatccaaggaaaggaataaacttaaccgctggaggggcatgaggagctcagcccccccaacctcgacagcagctaacagaaacgccaggagcagcaggaggaggaggcagcgacaaggtaagagaagcggtttcttgttcttctcttggcggcggagtggggatgagcggtgtccccaggtgtccggcgtgcagcggacagagcctggaggaaggtgtttagggcatccgtgcttgccgagaacccaggctttcctagtggccgctggcagcggagggcagcgactgggagctccctctccttccctcccgggcccattgccatgggggttccacagttaaagggataaattgatggtttttggcttctttatcttttcgggcactttgggtctcctcgaagtcgacactctggtctaggtgttgctcagtctggtcgtctgttggtgggggaggaggagtacagagggttgaagcttgaagcttaggttttcctgcttttcgctggtttggatgtgagcctcgtccagcctcttgttccctgtgctccctggctgtaacgttttgccaggcaagtggcctgattggaagtggctccagagcacagggctatgattcagctacccacattcgctgagaagcctaaaccgagctgagagggagaggatcagagggagtctagcaggagagtgcaggagagccagatggacaagacaggggacccagctccagagtggaaggaagatccagcttcccccagggccagggccagatgcaggggaatagctccactgcggtgctgggggtggggcaggtatttggccgccagtggtcccatttcaccagatttttcctgagcaatttgcttagaccagaaactaatgaaggcagtcagaccccttacccacccagcaacccaaagtctactctctagtccttagggaggttgtgggggcggaaagggggacggggctgaatttcttccttccccaacccccttcccttctcctccagatagatgcaaagctgaatctcccgccctgctcgctcagctgatctgtggcttaggtagtttcatgttgttgggattgagttttgaactcggcaacaagaaactgcctgagttacatcagtcggttttcgtcgagggccccaacccacctctcccactcctaccctccccagtgggactgccccactgccccctcccagatagggcaaagtgggtgcagaccaaggaggacaagctgtgagtggggttgcagaacaagtctggagaaccctgctttatgccgtcctctcaacctatcccaatccctgtgattaagggagaggagtctttcctgcagctattgtctcctgggcccagctgatggagacagacaaagagggtccagccaattccaaggaaattcaggagtttgagtaagaggtggcctggcgggccagctcagttgggcagcagggtggggcagaattattagcagaaagaggagcacagaaagagaagacggtctctggaatggttagcctctcccacctaccacctccagtcgactggggctcaagattctcctt

SEQ ID NO: 13674 - DNA, 18107 bp, Human
gtatggaaaacaaccatatgaaataattaggacactgcaaatgagaaaagtgagactcaaagaattcaatgttttttccaaagtctgtaagaggggcccccattctctttctttctttcctttctttctccctctcccttccctcccatttttttttgttttgttttgttttttgtttttttttttttgagacggagtttcgctcttgttgcccaggttggatggagtgcagtggcgcgatctctgctcactgcaacctccgccttccaggttcaagggattctcctgcctcagcctcccgagtagctgggattacaggcatgcaccacaatgcctggctagttttgtattttttagtagagatggggtttctccatgttggtcaggctggtctcgaaatcccgacctcaggggatcagcccacctcagcttcccaaagtgctgggattacaggcgtgagccaccgcgcccggctctttctctctggcttgcttgacagggtcttgctctttgacccaggctggagtgcagtggtgctatcttggatcattgtagtctggattctcctatctcagccttctgagtagctggactaaagacgcttgccaccaccacgctggctaacttttgaattttttgtagatacagggtcttgctattttgcccaagctggtcttgaactcctgggctcaagagatcagcctcggcctcccaaagtgctgggattacaggtgtgagctaccacacccagccttacttttattcttaagtgagaataactggtttgggtgtatctaggtccaatctctctgtgactcactttcctcatggtgacagaacagcacccaccttatggggttgtaaagattataaaagcacttatcgtaacaagtgctcaggaaatagttttgcagcccggcaaggtggctcaggcctgtaatcccagcactttgggaggccaaagcaggcagatcacttgaggtcaggagtttgagaccagcctggccaacagctaggacatcgtctctactaaaaatacaaacttagctgggcgtggtgaagcatgcctgtaatcccagctactccagaggttgaggcaggataatcgcttgaaccggggaggcagaggttgcagtgagctgagatagcaccactgccttcatcctgggcaatagagcgagaccctgtctctcaaaaaaataaaataaaataaagttttcctttttgagacgaagtttccctcttgttacccaggctggagtgcaatggtgcgatcttggctcactgcaacctccccctccggagttcaagagattctcctgcctcagcctcccgattagctgggattacaggtgcccgccaccacgcccgactaatttttgtatttttagtatagatggggttttcagcatgttggccaggctagtctgcgaactcctttcagatgatccacccacctcgacctcccaaagtgctgggattacaggcgtgagccaccgcgcctggcaggaaatgttagttttccaaccgtccccacctccctttccaggacgcctaaccgtgtgggtgcagcactgttcctcctctctgaggcttttccctcagctttccagccagctgcctgtgacatagcctgtattttcctctgggtgatccacaggcctgggaggattaatttggtacttccctgaatgtggcttatttcgggctttctaagcgctaagatagtgagtgggagaaggtgttcgggaattcggagctgggaaaaacagtagtctcatggaaaacaacagaaaaaaaccccactccagcctggtaaccaacggttggccgggggacgtgtccgcgctgctccccctccggccgccagggggcgcaggaagaagctttggaggtctgtcccgggaccgcgtactcgtccttctttcccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagctatgagagcccgccccccgacttccggggccaggtggccagggcgaggagggaggggacctacaggcatgggggcggagtcggggactactggggaaaggaggcagtgtgacaggggcagggtcacagagtctggcggagtggaaacagcttggccccggcaggagactagaagggctggaatctgttttaggactgggattggagtataacgggggaacggttaaggagctgtggaggaggcctagagggaatggagagaatgagggagaatctagggagtgtgaggatgcgggagaactatctaaaagttggggacagtatctggggaggatcagaaggatacaacatggaacttttttccatggtgttcctgggaaggacaaggaagggaaactgacatttattgagcgtttgctatgtaagaaagaggctgagtcaggtgttttctaaaaatgtcatatggtttcataatcacagcaaccctatgaaatattattctagttgcacagatacgggagctaagacttgtttcccattctcacaagtgttagctttgtggaaatgggaaacagacctctggaatctcttatacttagcccagcggtgggttggagatggcacggaattaaagatttgggaagagactgactcaccgtcacacccctcacttttgtgctatagtggatcaatcttcctgtcctacaactgacaaaggatcccctaaagacccctggaaggctggaccatggcacaagaactgccttcatccatcaccgggagcaagtgtggaagagatgcatcaacatttggtgaggcatggcaaagggtttcctgggtcacagtctgcagatcctggaaaatgagtcaccacccctttaccttggggtgttcttcaaaagacttttattcaggctgtctccacgagagctgtatatcctaaatcatatgaaatttttagtccttattatagaactcaaatgctcaataaatgtcaggttcccttccttgcccttcccaggaacactatggaaaaagtacttccatttcatctctagtaacttgccttgctttctggcttgattaggtgaacctgctccctgcccccacctcatggcattaccacttctgagcttttacctgaagctcagcaagatcagatataaggttgcactgaataatctcctacataggtcatccactttgcacttgtaggagtggagctacactacctggtttcattttcttttttttttttgagatggagtttcactcttgttgcccaggctggagtgcagtggcgtgctcagctcactgcaacttccacctcccaggttcaagcgattcttctgcctcagtctcccgagtagctaggattacaggcatgtgccaccacgcccagctaattttgtatttttagtagagacagggtttctccatgttggtcaggctggtcttgaacttccgacctcagatgatgtgcccgccttggcctcccaaagtgctgggattacaggcgtgagccaccgcgcccggctcattttctttttttttttcttttttttttttttttgagacggagtcttgctgtgttgccaggctggagtgcagaggtgcgatctcggctcactgcagcctccgcctctctggttcaagcagttcccctgcctcagcctcccgagtagctggtactataggcatgtgccaccacgcccagctaactttttgtattttagtagagatgagatttcaccatgttggccagggtggtctggcctcctgacctcaggcctgccttggcctcccaaagtgctgagattacagctactgcacctggacctattaatggcacatattaattcctttaagggttatttatgccaggcacagtgactcacgcctataatcccagcgctttggtaggctgaggccagcagattgcttgagcttagtagtttgagactagcctggggaacatggcgaaaccatgttcttttctctacaagaaaagtacaaaaattagctgggtatggtggtatgcacctttattcccagctacttgggaggcttatgtataggaggatcacttgagcctgggaggtggaggttgtagtgagccaagattgtgccagtgcagtggcactgagtgagaccttgtctcaaaaaaaaaaaaagggttacttaatatttttattaataccattaccatttgtaggataaattcctagaaattaagttgctggctcagagggtatgttcatctgtaattttgtgagctgttccaaatagccctctgtcaaaatggtacatgtatatggtcccaccagcagtgtatgggagtgcctgttttccaacacatgtgctgtcaagctttgatctttggtacttcagtacagtttaatgggcatgcctgtgtgtgtgaagttgaatatcagtttgttgaaaagccattcattcccaggctccttgtctcctacttctgtggctgctgcttctcagggtttttggtggctcctcttcctgatgtcccttaaatgttggtgttcttggggctagatttccagttgatgcatcagacctggtgttcacgtgtttgccaaattatcctgcttgaatatttcgcagacttcatatattcagcatgctcaaatccagtctctttatttctctctccaaatctgcttctctggatggttcactttaaggaatgatcatattactcattcaggaaaaagtggtttgagtataggttctggggtagatagatggttgaatcctgactgctactttctacttagattaccttgttcatattaattagcctcttcacacctttgttctctcatctaaaaatgcagtgatagtctgggcgcggaagctcatgcctgtaatcccagcactttgggaggccaaggcgggtgtatcacttgaggtcaggagttcgagaccagcctggccaatgtggtgaaactccgtgtgtaatcctaattactcaggaggctgaggtgcaagaattgcttgcacccaggaggtagaggttgcagtgagccgagttcacaccactgcactccagcctgggtgacagagtgagactccgtcttaacacacacacacacacacacacacacacgcacacacacacacacacacacacacacactgaaaccccatctctacaaaaaatttaaaaattagctggggatgatggtgtgcacccgtagtctcagctcctcgggaggccgaggcaagaatacctgagctcaggagattgaggctgcagcgagccgtgatggtgatattgcactccagcctgggtcacagagcaagaccctgtctcaataaaataaaaataaatgcagtgataacaatacctatcttgtaggattgtcataatggcttgattagttaatgtgaggcacctagtccagagctggcacattgtaagcatattagctgatgtaattattacctaggtgtttctgttgtattgctctttcctttactaatgtctgattagtcttcacatcttgtttatgctaattcctaaatctctcaaatctgtctctttttcttcatccccaccagttcaggccactttcacctttttcctaggttcctgaagtagattctttttttttttttgagacagagtctcactttgtcacccaggctggagtgcagtggcgtgatctcagctcgctgcaacctccgcctcctgggttcaagcaattcttctgcctcagcctctgagtagctgggactacaggtgcacaccaccacgcctggttaatttttgttttgttttatttttttggtttttttttttgagacggagtctcgctctgttgcccaggctggagtgcagtggcatgatctcggctcactgcaagcttcgcctcccgaattcactccattctcgtgcctcagcctcccgagtagctgggactacaggcgcccaccaccacacctggctaattttttgtatttttagtagagatggggtttcaccgtgttagccaggatggtcttgatctcttgaccttgtgatccgcccgcctcagcctcccaaagtgctgggattacaggtgtgagccaccgcacctggccaatttttgtatttttaatagagatggggtttcaccatcttgaccaggctggtctcgaactcctgacctcgtgatccacctgccttggcctcccagcgtgctgggattacaggtgtgagccaccgcacccggccctgaagtagattcttaactgatttatttttctctattattattattattttttgagacagcatcttgctctgttgcccagtgtggagtgcagtggcgcaaacatggaacacggctcactgcattgtcagcccccagggctcaagtgatgctccttcctcagcctcccaagtagctgggactacaggcatgtgccaccacacctgcctaagttttgtatttttttttgtagagacagcatttccctatgttgcctaggctggtctcaagctcttgagctcaggcgatccacctgccttggcctcccaaagtgctagggttgagccactgcacctggactttttctattttttctcttctttttttttttttttttttttgtctgagatggagtcttgctctgttgcccaggctggagtgtggtggcacgatgttggctcactgcaatcgccgcctcccgggttcaggcgattctcctgcctcagcctatggagtagctgggattataggcatggaccaccacacctggctaattttcatatttttcaacatgtttcaccatgttggccaggatggtcttgatctcctgacctcgtgatccgcccaccttggcctcccaaagtgctgtgattacaggtgtgagccaccgcgcctggccttttctattcttttttttttttcttcttttttgaggcagagtctcactctgtcgcccaggctggagtgcagtggcacaatctcggcttactgcagcctccgcttcctgggttcaagtgattctcctgccctgcctcagcctcctgagtagctgggactacaggtacgcaccaccacacctggctaatttctgcatttttagtagagacggggttttaccatgttggccaggatggtctcagtttcctgacctcgtgatccacccacctcagcctcccaaagtgctgggattataggcgtgagccaccacagccagcctggccttttctattcttatcactctctaatctgcagccagactgctctttctaaaatgctgctgtgtgatctgtttattcttctccttagaacccttccatggctttccattcattgtcttagagcaagtcccaactccttaacctgctcacaaagccccaaaagtcctctgagccttggttgtctcatccgtaaatgggtagaatctcgttcagatttgtgagatatgtaaatgaaaggacagcacgtagagtgcctggtacatagttggcactcattaaatgtgagtgcccatatttttaatacatgtatattgaatgaatgaaactggtagagagggacagaggggatcagagtaagctgacccacattttcctcccttatcaggcgtgatgtgggcctttttggggtgctaaatgaaattgcaaactcagaagaagagggtaagtatttttccctccagccttccctagttttgtggttatctcctctccatattcttgaactcacccccgacacctgttggctcagcctcttttagccctatttttcctgtcctctcctctacctacccaaataacccagagtgggtgtccagagtgggtgtccagagtgtggtgttgagagcacttactgggcagaaggacctggggagtgcctgtccttccttgtctttcacctagaaggtacctggtaagaggcctgtgaatggtttaatcagagctgcttcctcaaccctacagtgtttgagtgggtgaagacggcatccggctgggccctggcactctgtcgatgggcctcttccctccatgggtccctgttcccccatctgtctgtaagtttggcttcctccccagccctctgcatttgctgtgtccccatcctactctgccctcattcctatccttgcaggtcagggttgggtgtgatgacttcagagggtaggagtggtccagctcccctgttggaatattgaggagatggactccttttgccccagtgtgtcctgtgtctatcttgttcttacagctcaggagcgaagatctgatcgctgaatttgcccaagtcacaaattggtgagtgcacaagccctggagctttgtggaaaggaagtcctgaacctcaaaactccctttggggagaaggcaaagactcctactccttttctgattgctcaccatattctcattcctcctgttcccccaaaaaagaatacaagaaaaagtaggaaaaaaccatgtccttactggaaatgaatgtgagcttctgggctagggtagggataggtgcaggaactcttcatgttaaccccttccttaggtccagctgctgcttgcgtgtctttgcatggcacccccacaccaacaagtttgcagtggccctgctagatgactcagtccgtgtgtataatgccagcaggtgtgtgtggggacaccaggtgggctctgacttgtcaatatcaccttcccttgccagccttggttccggggagtcctgtagttcttgaacctgattcatggggctccttccagaactggggtcagggaagctccataactggatgcgtgcttcttctagacctaacctttatcccctcctgtcctatggtgcccctggcccctggatggatcatccttcttctctgtggctttccctccttaactgcactctggtccctggagccttagtgttcctgccttgactcagtttcctgccccttcaccctagcaccatagtcccctccctgaagcaccggctgcagcgaaatgtggcgtctctggcctggaagccccttagtgcctctgtcttggctgtggcctgccagagctgcattcttatctggaccctggaccctacctccttgtctacccggtaagtcctagtagcctgccttaccttggcctgagagttgtgcaatgctaggcatggtgggtggtgaggacgtctgaaaggagaagttctttgtcctcacagcacttcccagggctatgggaaaagcagaagtaagatcaaggtgggttgctgagaatactctaatctggagaaagagaactaggggctttttggattgtggggacaatgtgtctgtgggttacggggtggaaagactctttcagaggactatacacttcctttacacttaaaggaagtgtaaagaaaattagtactaataagatcagaaactaataaaattagaaaaagaatacctgtgaaaactaactaaaaataaaaccagaaactggttctttaaattatgactaagctgggtgcggtggctcatgcctgtaattccaacactttgggatgtggaggcggttggatcacctgaggtcaggagttcgagaccagcctggccaacatagcaaaaccttgtctctactaaaaatatgaaaattagctgggcatggtggtacacacctgtagtcccagctactcgggaagctgaggcaggagaatcgcttgaatctgggaggcggaggttgcagtgagccaagatcatgccactgtactccagcgtgggcaacagagcgagactctgtctcaaaaaaaaaaaaaaattatgaataaaggctgggaacagtggctcacacctgtaatcccagcattttgggaggccaaggcgtgaggatcacctgaggtcaggagtttgagaccagcctggccaacatggtaaaacctgtctctgctaaaaatacaaaaattaggccaggcgcagtggctcatgcctgtaatctcagcactttgggagaccaaggtgggtggatttcttgaggccaggagttcgaaaccagcctggccaacatggcgaaaccccatctctactaaaaatacaaaaaaattagctggacgtggtggtgcgtgcctgtgatcccagctacttgggaggctgagacccaagaatcacttgaacccgggaagcggaggttgcagtgagttgacatcatgccactacagctgtactctggtctgggcaacagagtgagaccctgtctcaaaaaaaaaaaaaaaaaaaaggccaggcgcggtggctcacgcctgtaatcccagcactttgggaggctgaggcgggtggatcatgaggtcaggagatagagaccatcctggctaacacggtgaaaccccatctttactaaaaatacaaaaaatcagctgggcgtggtggtgctcgcctgtagtctcagctacttggcaggctgaggcaggagagtcacttgaacctgggaggcggaggttgcagtgaactgagatcacgccactgtactccagcctgggcaacaaagcaagactctgtctcaaaaaaaaaaaatatatatatatatacacacacacacacatatatatgttatatatatacacatatatatacacgtatatatatatatacgtgtatgtatacgtgtatatacgtatatatatgaataaagaagaaaacctcttggttagcctaattaaggagaaaaagaaaaccaaagtatactattttcagaagtggaaagatatagatacgggagaaaatagaagaattataaaagaatattgtggacttgtttaggccaacagatttgaaaatctgaaggaaatgtttgatttctttttttttttttgagaaggagtttcactcttgttgcccaggctggagtgcagtggcacgatctcgactcactgcaacctcagcctcccgggttcaagtgattcttctgcctcagcctcccaagtagctgggactacaggcacgcactagctaatttttgtatttttagtagagatagggtttcaccatattggccaggctggtcttgaactcctgaccttgtgatccgcccgccttggcttcccaaagtgctgggattatagaagtgagccaccgtgccctgtggaaatgtttgattttctagcaaaatataagttaccaaagtggattgtagaagaaaataatgagattttttttttttgagatggagttccacttttgttgcccaggctggatggagtgcagtggtgcaatctcggctcactgcaacctctgcctcccgggttcaagtgattctcctcttgacttcgtgatccgcccgcctcagcatcccagagtgctgggattacaggcgtgagccaccatgcccggcctgtcctcccttttttttgttgcaggatcttcctgatttatttttataaagctaatgtaaccctgatacctaaaccttgacaataggtactataagaaaaaaacacgtgatcacagattttttttggggggggatggaatctcactctgtcgcccaggctggagtgcagtggcgccatctcagctcactgcaacaacctctgcctcctgggttcaagcgattctcctgcctcagcctcccaagtagctgggactacaggtgcgtgccaccacaccggctaattttttatttttagtagagacaggggtttcaccatattggccaggctggtctcaaactcttgacctcaggtgatgcgcctgcctcggcctcccgaagtgctgagattacaggcatgagccgctgcaactggcctgttttttggtttttttagagatggggtttcattatgttgcccaggctggaatacagtggctattcacagactcaatcattgcacactacagccttgaacacctgggctcaagtgagccccttgccaagtagctgggactataggtgcgtacaccacgcctggaaggttgttggttttttttgtttctactaaaaatacaaaaattagctgggtgtggtggcgtgcgcctataatcccagctactcaggaggctgaggcaggagaattcacttgaacccaggaggtggacgtttcagtgagctgagataatgccattgtactctagcctgggtgacaagagcggaactcgatttaaaaaaatttttttaaataaatgaacaaaaaacaaggccaggcgtgatggctcatgcgtgtaattccagcactttcggaggctgaggcagatggatcgcttgagcctaggagtttgagactagcttggtcaacatagatgctgtctatacaaaaaataaaaataaaaaaactagctgggcgtggggtgtacgcctgtagtcctagctactttagaggctgaggcaggagcctcaggactttgaggctgcagtgtgctatgactgtgtcactgcactccatcctggagtgtgaaccaccatgcctggcccaggaaatattttttacagcattatgtataataaaaaattacaaacaagtcaaatgtccatttgtagaggcatgactcaataaattatagttcatctattgagtggtatacaatggagccactgaaaagaatgagatgaatctgaacccacctgcaaaggcagctgtgatttatcataaagttcaagagaattaaattgtacatccatgactaagacttcactggagctgaaggtggttatagttaggtggaaagagaggtggcattaattcaggtagtagccttcgtctgtcaggccaggcacatggctctggaaatacacagctgcagacacatggcaggtgccctcaggtagttccctgctggtgatggaggccgagccacatgctgcatcttttttttttttttttttgagacggagtctcgctctgtcgccaggctggagtgcagtggtgcaatctcggctcactgcaacctccgcctcccgggttcaagcaattctcctgcctcagcctcccaagtagctgggactacaggcgaacaccaccacgcccagctaatttttttgtacttttagtagagacggggtttcaccatgttggccagaatggtctcgatctcttgacctcgtgatccgcccacctcggcctcccaaagtgctgggattacaggcgtgagccactgcgcccagcctgcagcatctttatgataaggagcaaacgcgggagctgcagagttgggaggtactttgataaggcaaggcaggagggctgtttgggagcacaggatgtgttctgaggagtgttagataactggagagaaaaggttggaaccttgaagtaatgtcatagattattaatcctggatagatggatggccaggctggatggcctgtgggcggagagctgtgttctggggtagggcctgatatcgccccaggggcagtaccttctaggttactggttaggttttgcctcatggcctatctcgtgaaagcactctttcaccctggcctgagaccttgcagattacctcttctctgttgacctgctcgtggtgacttggtcgtttttccccttcgctgtttttttcttttaactttcacaatccttattcctttttcacaacctggatttgagcccagagtgggccatcaggataggaggttttagcaggaggcaaagaaatagaattttggggatggcttcttgtcatcttctgactccacatcctctgtgttcccctccagaccctcttctggctgtgcccaagtgctgtctcaccctgggcatacacctgttaccagcttggcctgggcccccagtggggggcggctgctctcagcttcacccgtggatgctgctatccgggtgagtgggtccctgcccctcatgcacatttcagtcctggcaaaagtgttcctcactcggttgtggaaacatcttgggggaaggaggagggaccttggtccattcagtcttaaacttacccagagaggagctttgccatcagactcgtgaggtttaaaattccgctgtctgtaattgtcagcatgaacccgtgcctcatgtttcacagtccctctcccgcttcctctcgtttctggctctttgtacattagagaggccagcccactgtgagatgatggggtgcttgagttttcccttatctcctgccccactctcctaggtatgggatgtctcaacagagacctgtgtcccccttccctggtttcgaggaggtggggtgaccaacctgctctggtccccagacggcagcaaaatcctggctaccactccttcagctgtctttcggtgagtgggacaaggatggagggagggcaaggacctagagaaaggcacttagctcctggaagctctgtcaagggaggtaggtccaacttttagaacttagaggtcctgagctgtaatttgcttttctctggctcagagtctgggaggcccagatgtggacttgtgagaggtggcctactctatcagggcgctgtcaggtaagaggggactctgattcacagacactggggaggagatgattccaatgggcccctgatgctcccaaacctggccacctctactttccctcctgcattctactatagacataccttctcctgccttttgctccctgaccccagactggctgctggagcccagatggcagccgactgctgttcactgtattgggagagccactgatttactccctgtcttttccagaacgttgtggtgagttagggcaacacttcagtatttggggtggtcagagggaggcagcaacctttggtaagatgcagctctgagggataaagggaaatatagaagcttaggagatttcgaggtgttgatgcctttggtgagctggcgggggaccagtgagaggcctgtttcttgcaagaacctctctgctcttatttgtccacaggtgagggaaaggggtgcgttggaggtgcaaagtcagcaacgattgtggcagatctgtctgagacaacaatacagacaccagatggtgaggagaggtgagctgagtggttgagggagtggcagtgaaaagcaggtgggagggaccacactgaaactctcctaacctgtccttacccacaggcttgggggagaggctcactccatggtctgggaccccagtggggaacgtctggctgtgcttatgaaaggtgagaggcaaggatgaagggctcagcccacagccatcttcccagttaatctaatgaggccgtgccctggcctggagttctcctctgcccatgtcctgggactctgccttcagagttcctcccctatccctggatccatttcttacaggaaagccaagggtacaggatggtaaaccagtcatcctcctttttcgcactcgaaacagccctgtgtttgagctccttccctggtaagtgccatgtgggcccttaggtctggacttctcaccagccttcctgcacaaacaaacccacatcccactacattcagctcccttcttgcctccggttgcctgctcaccttttcttctagtggcattatccagggggagccaggagcccagccccagctcatcactttccatccttccttcaacaaaggggccctgctcagtgtggtgagtgcgccaggctgctggggcttccaggagttggatggagaagctgagggccttggctgctgtatggctctgccaggtggcccttctttgggcccagactctgatccttttctttcccttctctgcagggctggtccacaggccgaattgcccacatcccgctgtactttgtcaatgcccagtttccacgttttagcccagtgcttgggcgggcccaggaaccccctgctgggggtggaggctctattcatgacctgcccctctttactgagacatccccaacctctgccccttgggaccctctcccagggccaccacctgttctgccccactccccacattcccacctctaagaataaataagttttccttttgttttccactcagttaccagtctgtcttttccagggagttgcagtggggtacagtaggggaaaaaagcatggactttgggttaaggccctgttctgtcactttttagccacttgtgaatttggtcacgttatttaatcctagaaactgtggtttcaaatgatttgggaagcaaggctgagaagttactgtgaagaaaatatatctagcacagggtcttacacataaatagttgtttcacttttcacaagtttctggaatggtgtagggcaagaataagtcaaggactgggtcagtatgagatggaaggttttattagactaggagatttgtgggaggtatgagcgctgggccaaggtggcacgggccatgctcaaggcaccctctcgggtgcggtgaccgccaatgaagccgcttgcatggacgaagatgcagccagggatcccactgacctggtccagggcctcgtcccgaagaccccgccatggctctggcaggggcagcctgggcagaaagagggagtacagcaggggtcagagttggcagccttctcttaacaaggctgagacaagcctgaaggtctgcagagtggttccctagggcctcaccggctttggaatgagtggggctccttgggcacacactgtattcgccactgtccagcctggtcagtgtagataacaaagaagatggccactggaggggacagcccagattccaggtggtagagatgctccttccagggacatgcacctttcgccagttccacaatctctccacttgggtccacctgaaagagggagagcatagctagaaggtttaaggtaggctgggcatggtgatcatgtttgtagtcacaacattttgggaggctgaggtgggaggatcagttgagcccaggaatttgagactagcctaggcaacaaagtaagaccctgtctctacaaaaaatacaaaaattagctgggtgaggtggtgtgtgcctgtagtcccagctactcaggaggctgaggtgggaggactgcttgagcctaagaggttgaggttgtctgccactgcactccagggtttagggtagaagaagcaggagttcctgttgattggcagtcagtaatcctcaagccataatgcctcctccaaggcctatacctggaatcgctgggcaagggcctcttccaccaaggcccgggctggcagccagctgtgttggtagaaatctaatctctgcagaaactcctcttgaaccagatccattgcacgcttgaaccctgcctgggaatgatgagaattagaaccatgatgctggcccaaacttggaatttgctagggcttaggaggagcaaatgctcccattttccccccacccaaggttcttacaggtctccgggtctcctcccaggccaccttacctcagtgtcttggtcggggtggttccaggtaggattaagtcgagcaactcgtgcactcagggtagtggtcagtgcatatcgaggctccccctctgcccactgggagatcccattgtccacagcatccacctcctccacaaagttctcatacatctaaggcagcagcaggggaaaccttcttgaggctacctgctacttatgtgaaatcttacatgattcaaagtatgttcatacacactctttcagccctgtgaggatctctcaacattaactggatgagaaaagggagaattggcaagttcagcagctcgctgaagctcagacagctcgttgtgctgtgactggaattcagatcacctgatttctaatccatgctcattctgctgcacaaagcccaaaccaaagccaacacgtgtagggaggggactgctaacttttgaacaaggaaggtctctaggtgctagaggctctctgtgggagtgggtccctgtggctgaaggctggtaaatctccaggtggggtgagtaggtattcagtgacacggttaatgaggtgcaggagcggctctggttgagaacacaagtcaagtgggagaaaatgagtgt

SEQ ID NO: 13675 - DNA, 235452 bp, Human
  misc_feature (1)...(235452): n = A,T,C or G
cacaggcagctcagcccaacagagctagagccacgtggctgccccagcagggagggggcagggcccacagcagctctttagaatcaccccatccacctgactgctggggttttcctctccctagccctttgattgagtcaggggtggggatggggttgggggaggagccactgtttgcagaggccaaatcaaaaatttcacagcctgcactctcctgggtgcaagagtacacgtgagaggaattaaaaaatactactagattaattactatttgcaaatatattttcacatactctcatttaaccatcacaacagctctatataaagttagcactattattaatctcattttaccccagggtggggggcgggtgccttgccccaaagcccaaaacccagactcacctgcctccaaatccctacctcgtaacccctgggcaatactgtctggtgggcaggtgtgatataggcaagtgaaaggtacatcaatgtgcttgggagcctggttgtctatgtgtgtgtgtgcgcacgtgtgtgtgctcgcgcaccaggcttccccaggggattcacagggatagagactgaaagggtctcaagtgtcctgatttctggtcgaaggatccaacacttctctagtcccttgaagcccacctccctccatcagaaaacatctccccagtcaaagggctcagtctgaccctcctctgctagattatgggctccttgaaggcaggaaccagggccctgaagcctcaaacaggacctgattcagagaagtcctcagtgaatttggagggggggagagtcagtcaatgtatgacttttaattcagttatgtatcaatataacaataacatcaataattataataaatgctaatgcttattgcatgcttaccctgggactggcactgttcttagcacttgacatggattctttcattcaattcttgccacaacccttgaggaaaatactttcattaaccccactttgcagaggaggaaactggcttggagagagttagtagctcacccaaagtaactcaattaggaagtggcagcgttggggattggaacacaggaagtctagttaccccatttagtaggaagatcactacattcagaggaaggctttgtcctcagcgagcctcagtttgccatatttgtccaaagaaagggttagttttccacggtgctctggcctggaatattctatgatcctatgattctgtgacgaagagcttttgaagtgtcagggttagttttaaaatgaaagaggccattctgccgggtggtgagcttcctgacatgggcatatgtaagccagctcaggcctgaaatgggagggaggggatgagacttcggccagtgaccatggaagcgttgatggagtggaccatcaggaggggaaaagtcactgagaagagtggcaaggcgggcacgacaggatccagaactcgcttttacggaacgcctactgtgtaccagacctatgcttgacatttaacttacatcgctaattctcaggaaaacattgtaagatttatggttgacgaaattcagatccagagaagtgacttgttcagggtcacgccggacgaagtggtaggacaggcgatccaggtgagtctcctcagggtcacttccctagatcccctctgaccaacccctctacctagtaaccttaggagcagtaccacgtgtcaaattgcttcacacttttgtcatatgacgtcacaccagtcaatccaggaactccctgcccttccctcccctgacctctggggtctatcaaagcagcccccggctcagtgtccccgccggacgaggctacacctgcagcccccgccccttcccaactgcgactctcgcactcctctgcccgggcctccccctccccgccccgctgatcggcagttgcctgcgccaatcagagggcctagcgggcggggcggggcctcacgatggagttgccctgtcagtgcaggtggaggccccggcggggcaaagtggcaggaacctcttaaagggcgagagcggcgcggagccagaacgcggtcggcccggtccccgccgcacccagcccaggtgagcctggaccacctggggggcgaccctcggtccccgggagggacggggttagggacagaagaacctacccccaagggctcggaccgtcccgggagaggcgagaccagggtcgaagggtccagggctgaggggtccagcggtcccgaattccagaatccgaacttggggtccaaaggagtctgggcatcttaaagttcagggtgcagggaggggcgtgggagtctggagagggggtccgggagctcggatccggagctagacacgtccgggtccggccggtcctggctgtctggggcgggggtcctgcattcggtgtccgcgggagagtccctgcaggtcggcgcagcccccggccgccccctagccccgccttgcccggccccgcatgctcctgccgggcccgcagcagcgctggagcgggctggcggctagcagcgggagggggctccggggcctggagccccgcgccccgctccggcccttacgtaactgactttgagtttccggacccaggaaccgacccgccagctggggcgccggctgtgcccgccagggtggcccccccggccgtcgcgccagccccacaccctccctgccaggcttggtctaggggacttccctctgtctgggtctcccgggtctctctgtccggttcaggctcaggttccctctcatctctgggttccctgtatctctcatctgtcgtctctgttttgctgtcttttcctgtctctgtcctctgtctttcctcaagaattgtctcgccctcacctacacttcccggcaggccccacctcttcagggtgggacaggacccctcctctccagctagttggaggcagggacctgtccagaccaacccgagcccgagctcgctccaggagtggggaggagagaggagggttggggaagatgattctaggacccttagctcctgggtccgggaacggacgaccccttctccgcctctggagccctttcctccagaaggaggaggcttggacagaacctggctggggctgggcttagggcaactgggagtccctgtgagagctgcctagtgtctcgtcagggtcaggtcctcagctattgaaggggagcgggaggggctggggaggggccagagccctggcacgcgccccggagcttcagcaagctccctacctccacccagtttcaggcctggaggatggtcttggcaggaggctgggtggggaagggatctgcaggaggaggctcaagggacttctgcatgttggggaggagggtggagatagaatgacagacccgcaagtctaaggagcacctactgggaacactccctgccttgaaggctctccggggtgtcagacagacacttcggaaatcactgtaaataaggcgttaaagcaggtgtgaggtgggaattattatttcttcttttttttcttttgagacggagtctcgctctgtcgcccaggctagagtgcagtgtcgcgatctcggcccactgcaagctccgcctcccggattcacgccattctcctgcctcagcctcccgagtagctgggattacaggcgcccgccaccgcgcccggctaattttttgtatttttagtagagacggggattcaccgtgttagccaggatggtctcgatctcctgacctcgtgatccacccacctcggcctcccaaagtgctgggattacaggcgtgagccaccgcgccaggccgggaattattaattctaagccaggagaaactttgcgcaaggaggtaggaggcttgagaagaaagggagccagaagctgaagggagcagagggagggatgaaaggggacatccagtgcccagtaggctctgcacacagcagaactgggttgaatcctgacccttccactttcctgctgtgtgatcctgcatgagtcacttcacctctctgagtcccaggcttgtactttgtcaataatccggaccttgcaggcataagcagcatcaaataggcaatgtgtatgcagaccagaacggtagctggtctgatagcaggccagtagtgtgttttaagaagggaatggagtggggaagtcctgaggtttccgctgtatgtataggagagccaggcaacacctgccaggtctcagcaacatggggcatgggtggagtgcctgggtgtatgggtgatactcattgaggccacactggctgtctcctgattggcccatccctcctagaccagggctggcctccctcctgtaggctccaggtgccaacagaagctcccacccaggccgccttactccccagacgagtgcgggtagagccctgtcagggcaggaccagcaccctctctgcagaatggaccatggccaggagactggctggccgtgctgggcaggaacatccatctggctaggaagatgctgacgctgtgcaggccccatggaggtccagacctctgttggctggggctgggcccagctgatggaacctaggctgcagggtgagacagaggctggggtggtgggagtgaggaggggaggtgcaaggagggactcctggagaggaatcctgagcccaggtgtggaaccaaaccgagcttcattcggttattctctaagcctttcttgagcacgtactgtgcaccatatacaggtctgccagccacagacctgaacaggatactcacagagggctcaccacagagttatggtgtcctgagatttgttaggggtttgcagaatgggcctgtatgacagttcctggggataggggagttcagaattttcccagggccttagattctgatattttattttatttttatttttatttttattttattttattttattttgtttttttgagacagagtctcactctgttgcccaggctggagtgcagtggcatgatctcagctcactgcaaccttcacctcctggattcaagcgattctcttgccttagcctcctgagtaactgggattacaggctcctgccaccatgcctggctaatttttttatttttagtagagataggattttgccatgttggccagggtggtctcgaactcctgacctcaggtgatctgcccacctcggcctcccaaagtgctgggattacaggcgtgagccaccgtgcctggctgattctgatatttattaaagggggtgggattccactcctttatagtctgcaggctagtcactttgctccctgggtttcagtttccctttctgtgaaatgagtaggggagataagtctaaagtctctacgggtcttccagcgcctattactatagcctcgggacctagtttgggacttagtctaccccctactctcactccacgtgaggggataggatggagcaagatgaaggctgagtatgacgggcccacaagtcctgttcttggcccgtgttctctaatcataattacagccactgcctgttaagcacttactatgcacagcattctgttctaagcctttaatacgctgcattaactcattcaatccttacaatctcatgagggaaatattatctttgttttgcaggagtttagggagctgaacagacttgaccaaagtcacaaagctgggaagtggccgagctgggatttgaacttaggttcaactccaaagcccagacctaactaagagtgggagcctccaccccacgggtactgaggtgcccacattgctcagcccttacctgtggaactgtttgacccctgctggagcaaagctctgagctctgggatcttgaggctggggaactggggaacaagctgtgctgcctctgttgggtggcccctggggccagcatagagagaaaggggcagagggagcaacctccaggtcagccagggcccactaggggtttccccagaggggcagccccacgcagctactgcccaggtgcaagactgggcactgaaaggcaaccttgggtatgtggccaactttggacctcagttgcctcatctgtaaagcatggacttaaatgagtgtagacactccttgacccctgggttagtggctgaggtcagcaataggataaagggttagaggagagcttggagtgacagtgactgagtctgtgaaggaagagtttgggtcaggaacatcttggatcctgggccagctgtttgatagctatttcagaggaagagactgaggttggagaggttcaaaggcttgtctggggctgttcagccagtaccccagagactgaagggaaataaaccaagggaaaacccggagaacaaaatccaggcagatatgagctagaatcctgggttggccacttaactaggcttggaggtgtgaagtggcacccctgaggacacacgagagtcccttcacctaactgtcctcatctttaaagtgggaatagtaacaatttctcctttgtccacttcctgggttgttgtgaaggttaaaggagatgaggcatttgtaaaatcaggtgagaatgtggttgctggtcatttttcagtccaaagctgcagttccgggtttgtgtttgtggtggtgggagcatttctgacagctcctctgttgagatgctttatccaggagttgtgctggagagaagccctaagaataacaccaccggccgggcatggtggctcacacctgtaatcccagcattttgggaggccaaggtgggcgggtcacctgagatcaggagttcgacacagcctggctaacacggtgaaaccccgtctctactaaaaatacaaaaaattagctgggcatggttggtggcaggcgtctataatcccagctactcgggatgctgaggcaggagaatcacttgaaccgaggaggcggaggttgcagtgagccaagatcgtgccactgcactccagcctgggcaataagaacaagactgcatctcaaaaaaaaaaaaaaaaaaaaaagaataacaccaccatttattgcacagttgccggtaccaggcattgtactcaacttcacctctcattgtatcattaaccccctacagcaactttgtcaggtaggtggtacccctcacccatgctgggtccctccaaaacccatgccaacagcccctgtaatgatagtagcaaacgcttctgaatggtttactgtgtgccaagcatccttccagacgtgttacatgtattgacccatgttaatcctcacatcaaccctgtgaggtggatactaatattatctccagtttgcagatgaataaatgaggcatagacaagtaaaaacgaggccaggcgtggtggctcaagcctataatcccagcactttgggaggctgaggtgggtagatcacctgaggtcaggagtttgagaccagcctgactaatacgatgaaaccccatctctactaaaaatacaaaaatacacggtggcatgcgcctataatcccagctacttgggaggctgagacaggagaatcgcttgaaccaaggaggcggaggttgcgccattgcactccagcctgggcaacaagagggaaactctgtctcaaacaaacaaacaaataaacaaaacaaaacaaaacaaatggccccaatgtcacaaaaggtagagccataaatagtgaagtcaggattttcccaggttcttttttttttttttttttttttttgagacagaatcttactctgttgtccaggctggagtgtagtggtgcgatcttggctcactgcaacctctgcctcccaggttcaagcaattcttgtgccttagcctcctgagtagctgggattataggcacccaccaccatgccaggctaattttgtatttttggagagacggagtttcaccatgttggccaggctggtctcaaactcctggcttcaagtgatttgcctgcctcggcctcccaaagtgctgggattacaagtgtcaggttcttttattctgagatagggtctcactctgtcgcccaggttagagtacaatggggtgatcacggctcacttcagccttgacctcctgggctcaagggagcctcctacctaagcctcctgagtaggtgggactccaccacacacacctaattttcgtattttttgtagagatggggtttccccatgttgcctaggctggtcttgaactcctgagctcaagcaaaactcccacctcagcctcccaaagtgctgggattataggtgtgaggcaccgtgcccggctggcccaggttcttaaagtctcctccttgacacaatcatcacagttgtaattcagtagttatttacatgattgtctcctcactgcattgtaagctccataagtacaggggccatgtctgtcttcttcaggctgtatccccaacacctggcacacagcaggtgctcagttaatgtttgttcacagggacgctgctgcctctagtgggctgggccctggaggcctgatgagctgagggtggattatcagattattgctgactagggcgtctgccccagcaagaccccagaggcagaggaagggcagggttccctcctggctcaggccctggctgaagaaggggacccaaagggctttttctttggctgtgctgtgtgtctcactgctgtcctttgcttccatgtgccactgcggtgatggctccatggcctctcctggactggctgcgtgaccccgacggctgcttctgggtgagtaatggtttgacttaatgactgccacatgagctgattttaatgcatgtcctgtggctctgaggccactgggaggcgtaaagagaggcccgggggtaggggtggaaatgctgagagagggcactctgtgattttaggatcctaccataagcagggcctaccaattaaacacactgggtgctgattttttggtcacatgatacaatgcaaaggtctttggggcagactgggctggaatagaatcctttttctgttgcatacaggtgggtgattctttgcatctcagtttcacgtctgcaaaataagaatatgaatacttatgggacacaagtatatttgttcttttattcatgtaagccccacaagggcagggatttttgttcatctgttcaccaggtgctgtatcttcagcgcctagggtatagtagcacgtagtaggtgctcactgaatgtttccaaaggaatgaagatatttattgactgtttatggtatacctatcaatgtgctttgtattggattaaatggctaatggatataaagggcccagcatgataggggctcagtgaatgtgaattccctatttgctcaatagactgtgactttcttggggatcagggctctggtaaagtgagctctgggtcttctgaacttagtaaggggccaagtaccaagcatgtatcaatcagcacagagaggggcctggcaactggacttcctggagagggagtgacagagcctctagttttcatcagaagagagaggcagctgggaagatctggggcagaaatgggagggatggggagggactctgccttctagtactgccacttttccttgtccaggtgtgaccctggacaaggcatgctcttccctgagtcttggagacctcatctgtgatgtacatatcacaacactttccccgcataggtgtgggaaggagttgatgagaagagcccacacagggccccatttggtaacttcccagccctgggctcattctgggattctgggaggggactatgtgttcctctttctggcttttttctcctacttttaactgctcacccagctgggactggaatccaaggagcccctgaacttcccagcagactggccagggccctgggataagggctgggctctgcctggtgtgggaggagctgagtggaggttccagctctgccactctcgctgtgtgacttggttctgtaaccccttctctgcctcggttgccttacctgtaaagtagggttattaaaagacacctcccttgaagaattgtttaattagaaaataggtggattaggcattattatccataatgctatttggctctggctgaggtgactctagggagggccctgaagaattacatcccactgtggcccagggagcctgggactcactagtcatcatgtgtattattgccatttattggctatttcttatgggctgggctggttatatgctattttagacacattatctcatgcattcctcctagtgacctaggagaccctctgaagcaggcattattatccccgcttcatggcactgggtaagtcaagtgagtcacccagaatcccacagttctttaggggtacagctggggctcagacccaagcctgctcactccagggcccaaattattattattatttttttttggatggagtctcactctgtcacccaggctggagtgcagtggtgccatctcggctcactgcaacctccacctcctgggttcaagcaattctcctgtctcaacctcccaagtagctgggactacaggcgtgcaccaccattcttggctaatatttgtatttttagtagatggggtttcactgtatttgtcaggctggtctcgaactcctgacctcaggtgatcaacctgcctcagcctctcaaagtgctgggattataggtgtgagccaccacgcccggccctaaggcccaaattcttagtgtgaaactctcatatttctcccaaggaggtagagtgtacatctgaattctctttgtccatctcccatgaccagtacacggctggtgggagctactgacgtgtttgtcggataaataaattcatgcacacacactgcacccccacccaggcctgctgctgtaagagttttaaagagaaaagataatagaaaacaggagaaggctggacagcttggcacttgagggtcagacaggcctgactttgcatcttgcatctattgtttaccagttgtgtgaccttaggcaagatatctaacctcttggagcctcagttttcttacctgtaaaatggggaaaataaaagaacctacctacctcttaggcttcttgtgaggattaaatagtgaggcacatggtgagcattcaacaaatagtagcaatggttattgttattattataattatgaatattatttggggattataaagatgttcctcttgggacaaaagagaccaggtctgggagggaacttctggggacaggtggtggatagcagcctagtctgacagactcctgaaggcatgtgaagggagggaggtggcctcatggaagtaagaatgtacctcccttttctagtcatctgcttttcctctgtgtcaggccctgtgctgggcatggggcccagagatgaatctgtgtagtccttccccaccttccccaccgggagctcggagtctagttgggaagaagatgcagaaatcaccaactccacctttattgaataggtgttcttatgcaaagggcaggaaaaaagacattcctagtggaaggaacagcatgtgccaaggtacacaactgcctgcacttgggggaatgcagctgaagagacaggctcaagacaatgagtgaggacttgacctatggcaatggagagtcactggatagtaagcagggaggggcagggacaggggcaggaggaactgtccaggtgagagatgccgagatcttgggctggggactgtgccatgggataaggagcagtgagcgatgtgaagtctgtttaggaggcagagccagcagggcgtgataatgaactgcagtggccagagaggagaggagagggccagagggagatcttggggcctggggccaatggggcccactggggtctctggctgagggacatatctgggaggaggaggcagagctgggttgagggtaaaagccattcagctgctctcactacctttcccctcagtttcccaggcagcagctatgtctgagctggacactggggcaaggcctgtggccaccagggcccagggtacccactcctatctcaggggtcccttgtggtgaccctggtaggtctggtagggatgagacctctttggggtgggggccaggcaggagctgtgtggtgcagaaaagccctgggttctagacctaccagtgttactgagtgtctgtgccacctcaggaatcaccaggcctggtggctcacacccgtaatcccaacattttaggaggctgaggcaggaggatcacttgtgcccaggagttcaacacaagcctagggaacatggagcaaccccatctctacaaaaaaatacaaaaatcagctgggcgttgtgcatgtgcctgtcattccagctacttgggaggctgaggtgggaggatcccttgagcccaggaggttgaggctgcagtgagctgtgattgcaccattatgctccagcctgggtgacaaagtgaaacccctgtaggtaggtaggtaggaaggtaggaagggaagggaagcggagggaagggaagggaaggggaggggaggggagaggaggggagaggaggggagaggaggggagaggaggggaggggacaggagggaagggaagaaaggaagggaaggaaaggaaggaaagaaagaaggcactcccatcactccctctctcttgccctccttttccttgccttgaaagtgagaataagaaaacctgttttgcttgcctcgaagattcagtgataaaatacaactacagacagtaaacatttattgagagctgatgggctaggttctgggggcacaaaggtgactcactcagtgttcctgctccttaaggacgaactgccatgtgcagagtgagcccaggggagcaggtggttaactcaggggcatcaaggggaaaagagctaggttgggctttgaaggatgagtaagagctctctaggtaggcaatggcaggaacaactttctaggtacagggaatggcatgtacaaaggctcaagactgcatactgtgctcaggatagatgagcactgtcgttggtgtggctggagcacaaagggaaaggctggcagtgacaggagatgaggctggtcagggaagtagggcccacgtcaggcagacctttggggatgtcactggctcccctctccttcctgcaccctcacaactgcctgttctgctcagagagacaaccaggaccttcccatgctgctcctccccttgagttcccaccttctcccctcatcttcaccaccccagccagatcaagtggctgcctctctcaggagtcaataacctggctgccctgccagccctgccactgaaaagccatgtggcctccagtcactcacataccctgtctatctcagtttccacctcagtgaagtgggaacagcaggctttcctcccagagaagggcggaggcttcaatgagataatctccacaaatggcctggcccagtgtctgtatatattgggcacccataaacaggagctaattaagccatcattatttagactcctcaatctccttggccccacccactgcttcccctttacctctcctggcagcccgttctagccaagaaaggaaggaaaagattaagaaacaagcccaagtcttcagaggggtgctggcccactgccaagctggctcccctcctgccccttgcccgccttggccttgggccccaggattctcagtcctgaggcctgggcactctcccaccccctgcactagatgccctgccctggctggaggccaaagccagcagcagccttgaaacaggacacatatttagaaaatagctttattttttttttcctctgggagtggataaggaagccctttttttctggtgctttcgtgaagagtgtgatgttcagtatttctggaggtccagtggtcggggtagagctggatccctcagccttctggatcatgcaacagacgctagccaccaagtcccttatggaacagacacggacctcagatcaaagcaagtgtctgtcagtgcaagatcacacagtagaagcccaggtctccagaccctctgtgcactgtctcatagatgcatgtggtgcagtggccttggctgtcactttacctctctgagcctcagttttctgcactgtagagtggcaccgattttaccataaagatcggcaataatgtacagaaagcacctagtgagtcctcagtggcaggaagctactgttagagctgctgcctcttaaaaacttcttctgcccttccccttcctgatctagggacttggaatatctgctatgatttctattgaacaaatgacacctgataagccagttttaaagcaggaggctcagcatctgttatgcttccctcccctcttccccctttcctgggacattctagccccacccatgacagtttcccttttgcagcctccgatgatgccactgcaggcactcaagaaaagcagagagtaggaagggccccatgccatccaggcttaggctggggggaaagtgatggactgtgaacttggaaccatcctcgggagctaggatgacttgaagacttccacagatgctgggaaataggcctaaaagagaaaacctggttcacagccccaaaaatggtagagtggaaggaacaccagccctcctagctctccacactgtgagatcttgggcaaattacctacccttcctgagccttcattttctgatttaaaaaaggaaggggatggattgaggtcagaggtttctactaatactacaggattaaaagtagggatttgtgagcagagagactttggtttaaatcccagcttcaccccttaccagctgtgagacctctagcaagttgttttacctaagtgagcttcagttttttcccctataacgtggggaaaatattagcatcttctcataggattatttaagggctaaattaaataatttgtatgaagtactcagtccgtagctgacagacatggtggaattattattgttgtttttgtcatcgttattctatgatcggtagagataataagaagtcataaaagagctcattgagaaggaaggacttgagaaatgtacaggattgattgaattattcattcattcaataaatatttagagtttccacagataggccagagactagcagcagaaaggtggagtcagacagagctgcctattctagctgtgtgatgtgggatcatttacttcttcttctttttttttttttttgagatggagtctccttctatcacccaggctggagtgcagtggcatgacctcgggttactgcaacctctgcctcccaggttcaagcaaacctccaacctcagcctcccaagtagctggggatataagcatgcaccaccatgctaggctaatttttgtatttttagtagagatggggtttcaccatgttggccaggctggtcttgaactcctgacctcaagtgatctgcccctctcagcctcccaaagtgctgggattacaggcatgagccactgtgcctggctggatcatttacttctcttctcttggtctcatgcctttgtttgtaaaatggtgagaatagtgggcaaaatgttacctcccgggctgtcctgaggctaaagagggtttaagtgcactagtctgtctgtgtctgattcctttcccactaggcccctcagctgttaatgacgagaggcatgatcccaggcaagtccatcaagcacacttccaccccagggactttgcacttgccagtcctttggcccagaacactctacccccaaacacttttgtagcttgttctctcatctctttaaattttttgtttaaatgtcaccttctcaataagacctttcctatctttttatttatttatttattttgagacggaatctcactctgttacccaggctggagtgcagtggcgagatctcagctcactgcaaactccgcctcccgggttcatgccattctcctgcctcagcctcctgagtagctgggattataggtgcctgccaccaagcccggctaattttttgtatttttagtagagatggggtttcactgtgttagccaggatagtctcgatctgctgaccttgtgatccgcccgccttggcctcccaaagtgctgggattacaggcgtgagccactgcacccggctatttatttactttttgagacagagtcttgctctgtcgccaggctggagtgcagtggcatgatctcggctcactacaacctccacctcctgggttcaagtgattctcctgcctcagcctcctgagtagctgggactacaggcgtgcgccaccatgtccagctaatttttgtatttttagtagagacagcgtttcaccatgttggccagggtggtctcgatctcttgacctcatgatccgcgagcctcagcctcccaaagtgttgggattacaggcgtgagccactgcactcggcctatttttatattattattattattattttgagatggagccttgctctgttgcccaggctggagtgcagtggtgcgatcttggctcactgcaatctccgcctcccaggttcaagggattctcctgtctcagcctcctgagtagctgggattacaggcacccgccaccacgcccatctaatttttgtatttttagtagagacagggtttcgccatgttgaccaggctggtctcgaactcctgacctctggtgatccacccacctcagcctcccaaagtactagaattacaggtgtgagccaccgcacccggcctcctgacttcttacttaaaattgtaacacctttctgtcctctaaccttagcactgtctgcttatttttatccatagcacttatgactctttgacatactgtattttattatttgtttattgtctctcctcgcattggaatgtaagctctgtgatgatggtgatttttgtctatattattcagcgttatatcccttgtacctagaacagtgcgtggtgcataggaagtgctcagtaaatatttggggtgtaaactgatgactatatgaagcctgttctctctggatctaggaatattttgagcacacagtagaatctcaataaatgtgtgaatgagagaaaaagtgagcggtcatcatcctttccatttgtcagatcatactttagctgggtcaaccctgaggctcttttgcttctgattgcttctgatattttctgccagggcatcagtttcaattggagtgcccaaatcttttgttctggagcctgagctttgcagaatttctagttggggctgtttggctgttgggtccgcaatggttattatgtcattattggtaattagcacttaggcctagaggattgagctttttgtttttcagcagaaatcatagcagagagctgtgctagacactgggagccaggcttggagcagcttcctctggaactttccccttcccagctcggggtccatgatttagggagaccaagacagaggtgcccaaagctaggggcacataggtcaccagctcaactgctattttccccagacagtatcctgcaatgttttcccacaacacccctgggtctctatgcctggcctggtacaggggggttcgtcacaccttcaggggagctaggtgtagggtttccaaatatccagtggacaggggcattttctgatgctcaagattataagtggaggaaattatcctgggtttgagactcaggagcctgagcttaagtggctgtgtagctactgacttgctgtgtgttcttaggcatgtcactgcctcttgttgggcctcagctttctcacctgtcaaacagagataaagacgcctacttgacctcactagggaagagaggcaagatagtgtcttgagcaaggagttgggttctggactcacacacagctggcttcccaaccataccccttcctagctgtgtgacactgggcaaatcacttcacctctctgacgtcagttcccaaagcaataaaatggggctaaaatagtacccactctacagggttgttgtgagaattaaataagagaatgcagttaaagtacttaggcacttagctggtactctgcacatctttgctggtattatgataatgaccatcatggaaatgtaggcaatctgtaaaaagaatactagcaacagggccaggcagatgtggatttgaattctaactctgatacttactagctgggtgatcttggacaagtttttcacttatctgagactctatttctttttcttttctttcttttttttttttttttgagctaaggtctcactctgctgcccaggctggagtgcagtggtgtgatctcagctcactgcaacctccgcctcctgggtgcaagcgattctcctgcctcagcctcttgagtagctgggactacaggggcccactgccacacccggctaatttttatatttttagtagagacaaggtttcactggccaggctggtcttgaactcctgatcttcaggtgatctgcccacctcagcctcccaaagtgctgggattacaggcatgagccaccatgcctggcctgagactctatttcttcatctgtacaatggaaattatagtcatatcttcctcaagggggtgttgtgaaggttcagtgacatattgtatataaaacacttggtgtaatggttggcacatattagctccactttatagaaaaggaagggaggggaagtgaattgcctggactcgcatagcatctcagtggtgaagttctgatttgaaccaaggtcggcctgcctcaaaagtgcagttttttttttgttgttgtttgtttgttttttgagacagagtctcactctgttgcccaggctggagtgcagtggtgtgatcttggctcactgcaacctccacctcccgggttcaagcgattctcctgcctcagcctcccgagtagctgggattacaggcacccaccactgcacccggctgatttttgtattttcagtagagacagggtttcaccatcttggccaggctggtctcgaactcctgaccttgtgatccatctgcctcaccctcccaaagtgttgagattacaggcatgagtcaccttgcccggcccagctttttttttttttttttttaaactttttcttgccatcactcaagtatgggatcataatgatggctgttattatagagccactggactcattcatgctaggatccccagtgcccaataaatgtgtgatggatgaagaaaggtgggaccactgtgtccccacttccagggaggcttttaccttgaggttgaggattctttctggttggttgctagcagatttaaaataaaaatcatacttagtgtagtatggggctttgtaatctgcagaaccctttgcattctccacatcatttgacccttcttcctttcttatattgaagctctaacctctaaggtaatggtatttggaaatggagtaattaatcagggaagtaattaggataagatgagattatgagggtggggccctcatgacagtattagtgcccttataagaagagacaccaaggccaggcgcggtggctcatggctgtaatcccagtactttgggaggcggaggcgggtggattacctgaggtcaggagtttgaggccagcctagccaacatggtaaaaccttgtctctactaaaaatacaaaaaattggccagccgtggtggctcatgcctgtgatcccagcattttgggaggccaaggctggtggatcacaaggtcaggagatcgagaccatcctggctaacacggtgaaaccccatctctaaaaatacaaaaaaattagctgggcatggtggggggcgcctgtagtcccagctacttgggaggctgaggcaggagaatggcatgaacctgggaggcggagcttgtagtgagccgagatcatgccactgcactccagcctgggcgacagaacgagactctgtctcaaaaaaaaaaaaaaaaaaattagccaggcgtggtggtgggagcctgtaatcctagctacttgggaggctgaggcatgagactagctagaacccgggagatggaggttgcagtgaggcgagattgcgccactgcactccagccggggcgacagagcaagactatgtctcaaaaagaagagacatcagctgggtgcagtggctcatgtctggaatcccagcactttgggaggtccaggcaagtggatcacttgaggttgggagtttgagaccagcctggccaacatggcaaaaacccctctctactaaaaatacaaaaatcagccgggcctggtggtacgtgcctgtaatcccagctactcgggaagctgaggcaggagaatcgcttgaacccgggaggtggaggttgcagtgagctgagatcacgccactgcactcagcctgggcgacagaggaagactatgtctcaaaaaaaaaaaacaacaaaaaaccagaaagcttgctgtctctccaccatgtaaggacacagcaagaaggtgaccatctgccagccaggaagagcaccctcaccagaacctggccatgcctgatctctgactccagcctccagaactgtgagaaaataaatttctgtgtttaagccaccgaatctatggcattttgttgtggcagctgagctgatgaagggtgggtgacttgcctagagtcatacagcaaatttattgtggaactaaggctgcaacttatttgcagtctctcttatgacttctctctttctttttctttctttctttttttttttttttttgagacggagtcttgctctgttgcccaggctggagtgcagtggcgcgatctcggctctctgaaacctctgcctcccaggttcaagtgattctcctgcctcagcctccagagtagctggtactacaggcgcccaccaccatgcctggctaattttatgtatttttagtagagatatggttttgccatgttggccaggctggtctcgaactcctggcctcaactgatccacctccctcggcctcccaaagtgttgggattataggcgtgagccactgtgcgtggccccaatttctcaatttcttccccactaaagtgctcccagtcaccggaagtcttggaaactgaggttagtcaaatgctggctggccggctcagaacctgtcctatagtagcagctttggagggtcttggagcaagtcaaacctggcaatttctgtgcccccaatacccctgcttccttatatctccccttctgccctgtccctctgtcaagtgagggttgggccaggctgactttaccagttttagaagactgtcagctagtaggtggcacagagcctgtttcttggaaaaccctctacgccttgagggttccctcccctagtaagagagaattagtgggttaaggctgagtgagctgaggctttgctggatcagggtcattaggctcattccagctggtaagagaatagggttggagagggtcatgggaggccagatcagtgggtctctccctgaatgtcccagggctattatcagaagtagtcaggacagcctttccctgaggtcttgggacagatattaatattactcattcacatcatttccaaagtgctttcctgagagtgctttcctgaaagcagtacatagtagaggacagtggcatcagacagacctagtttaagctgcgatgttaggcaaatcacctaacttttctttttttttctttttttttttttgagacggagtctcgctctgttgcccaggctggagtgcagtagtgcgatctcagctcactgcaagctctgcctcacgggttcacgccattctcctgcctcagcctcctgagtaggtagctgggactacaggcacccgccaccaagcccagctaatttttttgtagagacggggtttcaccatgtcagccaggatggtctcaatctcctgacctcatgatctgcctgcctctgcctcccaaagtgctgggattacaggcgtgagccaccatgcctggccttttttttttttgagatggagtctcactcttgtcacccaggcaggagtacagtgtgcgatcttggctcactgcaacgtccgcctcctgggttcaagcgattcttgttactcagcctcccaagtagctgggattacaggtgcccgcgaccacacccggctgatatttgtatttttagtagagacatggtttccccatgttggtcatgggctggtctcgaactccctacctcaggtgatccacctgcctcggcctcccaaagtgctgggattacaggcatgagccactgcacccggccttctttttttttcaatagagatggggtctcaccgttacccaggctggtctcaaactcctgggctcaagtgatcctcctccctcagcctcccaaagcgctgggattacattacccctatgcattggggttgctgtgcagacatgccaagaaacaagggccagagggaagaagattgaaattgtaaaagtggacctggtggatggttgttaaggcattccttgacaacaagtgagccactgtgcctggccttttttttcttttttgagacagggtcttgctctgtcacaaagtgatgaagtgtggtagtgcgatcatggctcactgcaacctagacctcccaggctccagtgatcctcccacctcagtctctcgagtagctgggaccacaggcaggtgccaccatgcttggctattgtttttttttcctagactccaaagctagtgccagattggctgattttttaaaaattttaattttttttttgtagagatgaggtctcactatgttgcctagactgatctcgaactcctggcctcaagcagtcctccaaccctggcctcccaaagtgttgggattataggtgtgagcccctgcacagcccctaattcatctaagctgtagtttcttcaactgtacttgaggctaataatattgcctaagtattactgttaagaagttaaatgcaataatgattaaaaagtacttactgtgtgcctggcacatagtaaatacctcataaatctagttgttatggctgggcacggtggctcacgcctgtaatcctagcactttgggaggccgagtcgggcagatcacctgaggtcaggagttcgaaaccagcctggccaagatagagaagccccgtctctacgaaacacatgaaaattagctgggtgtgacggcgggggcctgtaatcccagctgctcgggaggctgaggcaggagaatcacttgaacctggcaggcagaggccgcggcaagccgagattgtgccactgcactccagcctgggttacagggcgagactccgtctcaaaaaaaaaaaaaagtagttattattattattattattatttttttttgagatagagtcttgccctgttgcccaagctggagtgcagtggcatgatctcgtctcgctgcaacctctgcctcctgggttcaagccattctcctgtctcagcctcctgagcagctgggattacaggcgtgtgccaccacgcctggctaattttcatatttttagtagagacagggtttcaccatgttggtcaggctggtctcgcactcctgacctcgtgatccacccgcctcggcctcccaaagtgctgggattacaggcgtgagccactgtgcccggcccaagtatcatttttaagagagaaaaatgggaaacaaactcaatgtccaatagtaggattaactaaattatgatatatccgcttgctagctttgttaaaaatgatgatacaaatgttcacaacatattgttaaatgaaaaaagtcagttttaggctgagcctggtggctcatgactgtaatcccagcactttgggaggccgaggcaggcggatcaccagaggtcaggagttcaatactagcctatcccacatgtctctactaaaaatacaaaaaaaaaaaattagctgggcgtggtggcgggcacctgtaatcccagctactttggaggctgaggcaggagaatctcttgattctggaaggcagaggttgcagtgagccaagactgggccattgcactcatcctgggctatggagtaagactccgtctcaaaaaaaaaaaaaaaaaagtcagtcctaaaataatatggtataaatttttaaaaagcgttaggttgagacatatgaaattgttcacatttgatcatttttaacctataaaatcagcaatttcatatgacttaatatatgtacactgaaaagtacacaaataagaagctaggtacagtggcctgtgcttgtaatcccagctacttgggaggatgaggtgggtggtttgcttgagcccatgagttcaaagctacagtgagttataattgcacagctgcactccagcctgggcaacagagtgagaccctatatcttgaaaaaataaataaataataaaataaataaaaaaataaaaataaggctgggtgcagtggctcacgcttgtaatcccagcactctgtgaggccaaggtgggaggactgcttgagcccaggagttcaagactagtctccacaacatagggagacctcatctctaccaacaataaaataaaaaattatctgggtgtggtggcatatacctgtagtcccagctactcaggaggctgaggaggcaggattgctggagctcagggaaaggctgctgtgagccatgattgtgccactgtactccagcttgggtgacagagtgagatcttgtctcaaaaatagataaatacaatagatagatagatagatagtatacataagggtgggtgtggtgtctcatgcttgagaccaggagttcgagaccagtgtgggtaacactatgagaccctgtctgtaccaaaaaattaaaaaatttggtggacatgatggcatgcctgtagtcccagctacctgggaggctgaggtgggaggatcacatcacttgagcccaggaggtcgaggctgcagtgagctgtggtcatgctactgtacaccagcctgggtaacagagtgagaccactgtctcaaaaaaaaaaaaaagtgtacgtataagaaaaggtactagaagggaaggtcccaaaatattgatggtagttatttttgactggtggctttatagtgacttacattttttcttgtgtttctaaattttctatgaacaattcaagtactactagtaaaattaatccccatcccactgtatgaatggtaattcccatcccattatagcctgtttgatttatcatttgtgtttacaagtctaaaataactgtgattttttatcctgccataggcaggatggcaagcactactcttcatatacttttggtaccagcatcagttttcattcaacagtactgttcagaacactttgttggtgggcccagcttttcaaagccctcttcaatctcttgccaccctccacaacagacacagggcttcaggccagctgtgtccctaatccgcccacgtcccagatttgggtatggtttccccgcccctccccgctttcttccagtctcatctctaccaggtcatctgaggcctcatctacactccctggccttccccactggtcaccacctaatttcaccatctaatttcaccctcttatgtgcagctggtgtttgcttttgcttgggctcagtttgctgtggggaaggattaagaccctttcacactgtctttttttttctttttctcttttgcttactgcccttgactgctccaggggctaacaggcagctagcggggcctgtattccctaggaaggaacacaaggggtagggggtggggaggtaatggtgggctcagctggcaggcgagatagagatggtccttagggaccccatcctggggcttggggcatagcacagctgccacccagatgtgagcatggagcagagctgtttctgccttggaaattagcctcagagacggtgcttgggacctttacccttggtacctgatggcagtctctgcagggtgagctgggactggatacctggtttgcagaagtctgagagggcagatgggcccaggagtaaaggtagtttttccaccttcatattaggcattacttatacccccacatcttcctatgtgataggcctggcaacactcagagattgggcacttagcctaacaactgaagatgtgtgtctaaaataacaaaaattcctcatgtgtggatagtactttacagtttacaaagccctttcatctccaggctaagaattaaaagccagcactggaattcaggtctttcagattctaaagcctgagtcaatggattatggtgtgttattgcatggcactctgaatttcagagtagttcatacctgccttgtgtctagccttttgctgttagcctgagacctctacttatttgcagagtaaggattattaaatgctacatattctttgcatccaattagatgtgccattggctagcacttcatggcatagagaatactgggctttcatgaatctgaatttgctggataacttggtggtggtggagatggtaaaccactggtaattggtcttctatactcatccttcaaggtaccagattttcctgtctgattggtgaaggaagcctgaggcacagaggtggtaggactagaactctgaataaaaagcacagctgaacctgaggacttgaggcaggagaccagagtatttaagaacaggtgtggccaggcatggtggctcatgcctgtaatcccagcactttgggatgctgaggtgggtggatcacctgaggctgggggttcgagaccagcctgaccaacatggagaaaccccatctctattaacaatacaaaattagccaggcgtggtggcacatgcctgtaatcccagctactcacgaggctgaggcaggagaatcgcttgaacctgggaggcagaggttgcagtgaggtgaggcgagatcgtgccattgcactccagcctgggcaaaaagagcgaaaccccttctcaaaaaaaaacaggtgcttcacccctcatacacagaatgaccctggccaagtcacctgacctcactaagactcagtttccttatatgtaaaatgaggatgttcattaactcattcaacaaatatttattgagcgtatactgttctgggagatgaatacagatacagtccctgccttcctgagcttgcagtctagtgggtctagattacagcaatttatttgagaggcacaataaataataaatatatagtagaaagtcaagtagggtaagtgctatgaagcaaattaaagcaggataagggtgtttgagtggagggtgttttagatggtatagtcaggtggttttcaaggggttttatgatgtttcaaatggacaatttacataacgtgctcagctcagtgctaacaacaattgcatgcttaacaaatatattattatatttgccagttccacacctctcagtccacattttagtctctgaatagtaataataattaacacacatagatcttactatgagctaggcactgctctaagtcctttacatattttaactcatttaattctgttttcctttttcttttttttgagatggagtcttgctcttgtcacccaacctggagttcaatggcatgatctcggctctctgcaacctccacctcctgggttcaagtgattctcctgcctcaacctccgagaataactgagattacaggtgcctgccaccaggcccagctaagttttgtatttttagtagagatggggtttcaccatttggccaggctggtctcgaactcctgacctcaggtgatccgcctgcctcagcctcccaaagttctgggattacaggcatgagccaccatgcctggcctaattcttacagtaactctgtgaggtgggaactattattatccttctccctcccccaaccctcgtttttgtttttagggatggagtcttgctctgttgcccaagctggagtggaatggcatgatcctagctcactgtggccttgaactcctgtgcttgagcaatcctcccacctcagcctcccactataggtgggagtcccagctacttggacatattatccccttttatggtgttgaaaaatgaggcacagccgggcgcggtggctcaagcctgtaatcccagcactttgggaggccgagaagggcggatcacgaggtcaggagatcgagactaacacggtgaaaccccgtctctactaaaaatacaaaaattagctgggcgtggtggtacacgcctgtagtcccagctactcgggaggctgaggcaggagaatcgcttgaacccgggaggcagaggttgcagtgagccgagattccggcaccgcactccagcctggtgacagagcgagactccgtctcaaataaataaataaataaataaaagaaaaatgaaaatcaaaccattagaaaaggctggagactaagaattgaacccaggcaatctgtttccagaggctgtgctgggatcgtgaaggggctgtgattagatatcaggaatgtctagctggcatctacagactctgctgtcagatggcctggcttcttatcctgtcagttttaagtctctctgcttcagtttcctcatctctaaaatagaacaccagatcctatcttaccttctaggtatcatgcttaaaacaaaagccttctttctgcactgtgggtccgaagcctgttcacagaccagcctagcagggagtaggaagggtcaaggggtctctgacacttctggaaggaaataaagacacactaagcaattgtcagagcaaccctcagttcatctggagaccagacctcggaagctaggtctttataatgttgagattgccaggggggaattaggagatccttaaatgcagaagacaggttcaatcttggcgtggtctcaacacttagcttccatttcaggccttacacagctggcacgagaggtaaagtctcatcgaatgtcagggttggaagggcgcctagagacagtcaaactagtggatggggaaactgaggtacagagaagctgagtgacttacccgaggtcactaagcgtttagggggagtcagttggggtagcctggctacaacctctacgcgagttacttccctgaggcttccaaatctcggcctcttacttggaaggaggaaagggcctcaccgtccagggctctagctgcctcatgccccacgtgggtgctgcgggatcccggaacaccccggctccagaccgggttcgacttgcgcgtgcgcacacgcggccagccccttgccttttcctctctctttttcgttcccctctcctctccttaccggcctaggggaggggggaaacaaggggagctagaagttggcctcagccaatgggcggacgggccgcgggcccggccccctccttccctccggcgcggcccaatagaaatttactacaatgttgtggcgaactgagggggaggggcgcgggccggcgggcgggctgcgggccgggctggcctcgcctcgcagagggaaggcgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccggtgaggcgaggcggcggcggcggcgcgggagccggggcggtgggcgtggagctgtccccgtggggacggtcctggcggccgcggcggcgctgcagcctctttgtctgcaacccccgacaggccccgggccggggcgcgggctctcccgcggaggagcctcgtgtgcacgccgagtcgccagccgggacgcggcccgaggagcgaggggcgggccagagccgctgaggaaaggggaaggggttgcgtcgcgggagtgttggaaagttaggcttgagatgtatttttgacggtcccctcgggtgcgtcaatcacggtgcggtgtgcaggagcctcgggaggaaaccaaatgcggagaatcgcaggtttcagacggtgaaggtgttgcgtgcagccgcggagcgatttcttcctggcgagggagctgggctgtctgcagaagtcaggcggaatctgaggactgcagggagccctggcaagacttcgcaggccttcccgccaccgacgcctgcatcattgaaaaacatgttcccccttagtcttctgggttcccagcgagcagagggttaaatctattctctcagcgtcgtgacctcctttttcagttcgcgcatctgtcggcttggaaatcttcctccgtgctcgctgggctgctgtacctgtggagaggccgggtctgggctcgccctccgagattgaccagcaggccattattcctggggaggttttgccaaaacaggtcatgctccccaagaacaggcattctcttgagaaaaagtgatctcacgtgaaacagattgctgatggactggtttctggccacatgatagcgactgtcatcctgttgtttctttaactgtaccctgtaccctgccataaatgactagtctgtggagacttgttttttggcatgtagttgttcattaggagatagttttttctttttcctttttttttttcagatgctttttttttttttttttttgtagtctgggtgatttcacagctgctattttcttcccttctgtttttagggaaaattgcaagaaatggttgtgtcttgtgtcttggatattattatagtggatttatactctcttgaggatgtactgtagtcaatgctgttgctcattgttgttttctgtattctcagtcctggcaaaaattttagttggtttgatccctttaatcaaaagcaggatatatagcccgtatatgtttcttcccgtcccagttttgttaatgtagcactaacccctactttttatggaaacttgatgtactcttcattttccttttctgtaaattgaaagtgtaatcagttcttcgccagttgtaaaatttttggtttggggtgttattaatataatccatgtagcgtacatgctatctggcgtacagtaagcactcaataaatggcagattcaaaaatagatgtaataactgaacaccagattgccttagaatcaaagtagttaattcagtgtgctttctataagaagcttataattaaggtaaatatagatattattcatacacctggggaaacaagtacagtatatctttggcactattaaaagtgaactatgtcgggcacggtggctcacgcctgtaatcccagcactttgggaggccaaggcgggtggatcacttgaggtcaggagttcgagactagcctggccagcatggtgaaaccccatctgtactaaaaatgcaaaaaagtagctgggtgtggtggcatgtgcctgtaatcccacctactcagtaggtggaggcaggagaatcgcttgaacctaggaggcggaggttgcagtgagccgagattgcaccactgcacttcaacctgggcaacagagcaaaactgtctcaaaaaaaggtgaactcattgttgaacataagttcagaatgccaaccttctgattcctctgtcttctaccaacaaaactatacatttttccttgtatgtttgaattcaggcttagaaataaatgtttttaatctgtaggttttaccaaaattctcccaacaattttttttttttttaaacagggtctcattctgtcacccaggctggagtgcagtggcatgatcacggctcactgcagccttaaactcctgggctcaagtgatcctcctgcctcagcctccctagtagctgggactataggcgtgtgcccccatgcttggctaatgtctttttattttttgtagagacagtctcactatgttgcctagggtggtcttgaattcctggactcaagagatcctcctccctgggcctcccaaagtgctgggattacagatgtgagccacctcacccggcctctcccaacatttattaagtgttttataccaaatgtcttgtaagttcttatgcaatatggctacaatctacctttccacctttattctccttattttttgtattgtgcaaccaaatagaactactctgtaataacccttgctttgccatctctctctctgtgtgtgtgtgtgtgtgtatgtgtgtgtgtgtatttatttatttattttgagatggagtcttactctgtcacacaggctggagtgcagtggcatgatctcagctcactgcaacctccacctcctggatttaagcaattctcctggctcaggctcccaagtagctgggattacaggcgcttgccatcatgcccacctaacttttgtatttttagtagagttggggtttcaccatgttggtcagtatggtctcgatttcttgacctcgtgatccacccgcctcggccttccaaagtgctgggattacaggcatgagccaccgtgcctggccctgtatacatatgtttttagagacagggatcttaccttgttgcccaagctggagggcagtggcatgatcctggctcactgccgccttgaactcctgggttcaagtgattctcccacctgagcctcctgagcagctgggactacagacgtgcaccaccatgcccagcttttttttttcgtttttaaaacacggggtcctgctattgtttcccaggctggtctcaaactgctggtctcaaactcctgagctcaaatgatcgtctcacctctgcttccaaaagtgctgggattacagacatgagtcactgtgcccagcttagtctgtattacagacatgagccaccatgcctggtgtgtaatttttggtgtgaatgatagagtttgcttacttttttttaatgtagtaatccagtttcatattgctaatctgatttcataactttagaatatcagtggccatgagaggctgagtttggttctgaaatcaagaggagcatagatgtagaccacagtctgtttccttgttatctaagaggcaggacagcataagtgttgccagtgtatttttgtttttcttgtcttttctgtctcagcctcctgagtagctgggactacaggcacacaccaccacacccagctaaatttttgtatttttagtagagacgaggtttcaccatgttggccaggatggtctccaatctcttgacctcgtgatctgcccacgtccgcctcccaaagtgctgggattacaggcatgaaccaccacacccagccaatggcctgtatttttctgagtttcatcaagtttgtgtttggttaaatgcatattcagatgtggattcattgctacctctatatttgaattttttctttaattacttgaacatggaatcactttattttgtgagctaaacaacaataattccaataacttttcttatgaataactttgtttttttcctctaaataaagcccccaaagatggcctctgaattaatcagttatgggccttatgtatgtgaaggatccaaaattattgaaaagtaattgctagctaggtgcagtggtttatgcttgtaatcccagcactttgggaggccgaggcccacggatcacttgagcctttgagtttgagaccactgcattccagcctgggcaacagagtgaaattctgtctcaaagagaaaaaagaaaaagtaattgcttgattgcatttatcatagcatttagttagaggagaggagaggcagatgccaaatgtatgttattttttgttgttcatttaagtttcttggtatgtcactggtggcttttactgtgcgtcctttttaagagtgggttcatggtgtgtttagtcaaatgcaatataacttactctggagtgcacactgggttagattagtattttgatttactctgctgctatttaatgaatacatagaaagataaagaagaatgctgtagcagtgaggagtattcagaacttggaggtgttagaaaggagaactttgatattttatattgagtgctgatctcatttagaactacccaccttactgacactttgcttcaaatattggttttgggaaaatccgattatgatgaaagtctgtttatacttattttgctgattttttatttaaattgaattgtatccacttaaaatatttgaaaataaattggctagctctttgaactttggagaacagcagccagtataattcaaggagtagcttgaagagactttaatatcccctacccgctagcttcgtcagcttcccactaagtcaccctaagtaaacatgcaatctgggtaggaactgggagcttgatatccaaatattctgtctctccttccagtcaaattgctatccttaaaagtcctttctttcttttttttttttgaggcagggtcttgctctgttgcctaggctggaatgcagtggcatgatctcggctcactgcaacctctgcctcccgggttcaagcgattcttccgcctcagcctcctgagtagctgggactacaggcatgcacggctaatttttgtattctttggtagaaacggggtttcaccatgttggccaggctggtcttgaactcctgatctcaagtgatccatctgccttggcctctgagagtgctgagattacaggcatgagccacagcatccagcccaaaagtcctttctatatagaaattccagagacattctggcgtcatgcttttaaattatttattgttttattatttttattattttattattgcaattaagagcagttctcttttttgcaagttatctcttatctccaagttaaatctatgtggattaaactgtgattgtttattgaattgctgctctccctcttccgtagctgatgactctttgagtcagttctacccaattaatctaggccctcaactctcagggtgatctctgcttgtggagattaaaattgtttctaagctatgtggaatagagcttgggtaaggttaaagaaattttggcagggtgggtaggaaggggcaagattatctgtctgatggaatggataagaaatatgactgtgagtttatattgattagattggaagaagcaatagatgctctattaagattattttctattacctaattctatattcaatgtatatctacaattctgttctgttatctaatatctattaatagagacaggaacacctccatctttttttggaaataggtggaaataatcaaataagattggatataatctgtactcttgtagttaattgttatttatagatgcaacctgattccatcctccacaaaagtcaccctaatgcagatcagcttttggtaggccctctatatgtttgaatcatagcaccggacacaacatagactgaggttttggtactttctacattaatattcactcagaaaacttttgcccatgcattatatttgttatatctgcattaaatcataaaaaagttatgatagaaaagtttcaagtgagaaactccccgtgatttaactatattagagcacaggattattttatttttatttatttatttatttattttttgagacagggtcttactcctgtcacccaggctggagtgcagtggtgcgatcatggctcattacagcctcaacttcccaggctcaggtgatcttcccacctcagcctcctgagtagctggagctacaggctccacacctggctgattttttatatttttagagactgggttttgccatcttgaccaggctggtcttgaactcctaggctcaagaaatctgcctgccttggcctcccaaagtgctgggattacaggtgtgagccatggcgcccagcctattttaatttttaaaaatttatatggggagtctctctatgttgctgaggttggtgttgaacccctgggctcaagtgatcctcctgtctcagccacctaaatagctgggactacaggtgtgtgccatcacatctagctaatagagttgttttgaattggttaaatttaagcctgtaacccatacgtgtaatagaaatgtatatttttggtgatttatgaatacatagtattaggccaaggtttagttgtgattgatatacagctattagtacttacatatactcttaagtaatcctattaaaatcattttaacacaatgggatcttaatggcatatctttaaacctatcttataaagaaatgctgctttaacttagatgccaagcacatattttaatttaccaattagaagttctatatgtattcaagtgaagagtgtttcaccttaataatacatttcatacagattgttgaaattcatcccattcccccttccctccccagtttttggccatatggacacaggcaggactctcaggagtgccaaggatttaagccctcaaattttacctgcctaccatttcagcatgcgatagggacacatggaaggcagcttaaagtaaaggctttaaaaaattttttttgctaccacccacttgctgtttcttgcccttttctcttttttttaatgattcagaggatcgacactgttgccagcttactacctgcagtctttccagtcttgatggtattacgtaattatataaaccttttgcatggtatcatatgatattgtatatttgtcttcctacacatgtgtctttagagtaatttctttccatctggtgttgaaaatgagctctttgtgaggttatttttaaatcttcaagctttctggcatcctcaacacttgaaataacacaattgcttttggaggcaagaaaatccacatagtatactttgtggtttttccagtgaaaatgtaaatagtattttatttatgaaattttatatatatatatatatatatataatttttatatatatacactttttttttgttttttttttttgagacggagtctctctctgtcacccaggctggagtgcaatggcatgatcttggctcactgcaacctctgcctcccaggttgaagcgattctcctgcctcagcctcccaagtagctggcattacaggcacgtgccaccacgcctggctaatttttgtatttttagtagacacggggtttcaccgtgttggttagactggtttcgaactcctgacctcctggtccgcccgccttggcctcccaaagtgctcagatcacaggcatgaaccaccgcacctggcctataaaattatattttatatttagatagtcttgagataattgtgttaggttggaaatagttgttgccaagtaaataaagtaaaggagagctacttaagggaaaggagaccaagaataagaagcctggtagaggaaagaggttttaaagatatcttcttctctgaagatttattgttatctttttatcctctgtctcattctgttgcccaggctggagtgcagtggggcaatcatggcttactctaaccttgaactcccgggcacaagcagtcctcccacctgagcctcctgagtagctgggactacaggtgcatgccaccgtgccccgccagttttaaaattttttcttagagacaggattttttttttttttttttcgagattgagtctcactctgttgctcaggctgtagtgcagtggcgcgatctcggctcactgcaacctctgcctcccgggttcaagcaattcttctgcctcagcctcccaagtacctgggactataggtgtgtgctaccatgcccggctaatttttgtattttttagtagagtcggggtttcaccatattggccaggctggtctcaaactcctgacctcatgatccgcctgcctcggcctcccaaagtgctggaattacaggtgtgagccattgtgcccaggctgagatgatcttatgatattgcccagcctggtctcaagagatcctcctgacttggcctcccaaagtgttgggattataggtgtgagccaacacactcagccgtgatgcactgtttgattctgataatcaggtatgtgtaattagccttaaacctttttcttccttctttcctttcttttcttttcttttttttttttttttttgagatggagtctcactctgtcacccaggctggagtgcagtgatgggatctcagctcccggattcaagcgattctcctgcctcagcctcccaagtagctgggattacaggcgtgtgccaccacacctggctaatttttgtattttagtagagacagggtttcactatgttggtcaggctggtctcgaactcctgacctcaggtaatctacccgcctcggcctcccaaagtgctgggattagaggtgtgagccactgcgcttggcaacctttttatttcttaacagtagattgatatatcctctagcttactaagtaacctttgaatttttattatttctttaattgtaatataaaaagctgatcttttattaagtgccattccgtctcctaaagatgatgcctataatgattaaatagtaaaggtcagtgtcatctacttagcaagatttacccagtaagtctttttttctccagatgctatttttgttgacttatccttgctagttgtattatctctaatatgaccattaatggacactggttaacaagatatgttcaatatttaatgtattctctttggtattttgtaagatggaaaagactagcattgggatgaataattgcataatgatcatagaatcatatttaaataaatataccaaagaatatataactaaagggcaagtttttttgttttatgtttttaaatttttatcatgcgtactgtggtaggcagcctttattatggcccccaattatccctccctcctggtatgcatacccttagtgtaatttcctccccttgagtgggggctattgaatagaatacagcaaaagtgatgggatgtcacttctaagattaggttataaaatactgtggcttctctcttgggattctggctttctccctctccctgggaccactagctaccatatcctgagaacactcaggcagtctgtagtgatgtccatgtggttaaaaacgaggtctgtcagtaaacttggatgcagatcttcggtgtgagtgatcttggaagcagattctccaggcagagttgagcctagaggtgaatgcaaatgcagtagacagctttactacaacttcatgaaagcccctggccgggtgcgtggctcatgcctgtaatcccaacactttgggaggccaaggtgggtggatcacctgaggtcaggaactcgagacctgccttgccaacatggcgaaaccccgtctctactaaaaatagaagaattacctgggtgtggtggtgtgcacctgtagtcccagctacttgggaggttgaggcaggataatcgcttgatcctgagaggtggcggttgtagtgagctgagatcgtgccactgcactccagctctgggtgacagagcgagactacatctcaaaaaaaaaataaaaaagaccccaagccagagtcacctagctaagtcatgcctggattcttcatccacagaaactgtgcaataataaatgtttgctgttttaagccaccatgttttggagggtaatttattgtaaagtaatagataactaaaacatctaccacttattcatgtaataaatacttattgattgttcactatttacaaggcactatcataagtacattgggacatagcagtgaataaaatagaggtatctgttcttgtgcagcttatttctttttctgggacagggtcttgcactgtcacccaggctggagtgcagtggtgtggtcacagctcactgcagcctcaacctcctgggctcaagcagtcctcccacctcagcctcctgaggagctgagactacaggcacacaccactatgcctggctaactttttttttttttttttttgagatggagtctcgctctgtcacccaggctggagtgcagtagcgcgatctcggctcactgcaacctccgtctcccaggttcaagcttttcccccgcctcagcctcctgagtagctgggactacaagcacccaccaccatgcccggctaattttttatttttagtagaggcagggtttcaccatattggccaggctggtcccgaactcctgaccttgtgatccgcccacctcggcctctcaaaatgctgggattacaggcgtgagccaccgcgcctggccattctggctaatttttaaatgaaattttttgtagggatggggtctccatatgttgcccattttggtcttgaactcctgggctcaagtagtctcttgccttggcctcctaaagtgttgggattatagtcatgagccaccacacccagcctggagcttacattttagtggtaggggataaataataaatgtataaatcagggatagaacataagacatcagattttagtgaggatcagggaaagtagaatgggagacagtgaggcaggtggggtgtacattttagataagggtgatacttctgataaggtgacattggagcagagtcctaaatggagtaagacagtgagctgtgcaggtatctggggaagagcatcccaggcagaaggaacaaaatgcacaaaagttaagcgggtttggtgtgtatgagaaacattgatccagcatgttgggtcaaaatgatctagggaaaagtagcaggagtttaattcagagaggtcataggtaggagaaggagcaaatcattgtagtgccttattgcctgtgttaatgacttcgcattttatttggagacgggagttcttgggaggattttgagcagaggaatggcacgatccttcatttagtacatgttaagtgagcaggactctgtttatatatgtgatcacaaaaatataaaagatggggctcatgcctgtaatcccagcattttgggaggccgatgtgggaggattgtttgagcccaggagtttgagactagcctgggcaacatagagagacccttgtctcaaaaaaaaaattataggccagatgcagtggctcacacctgtaatcccagcactttgggaggccgaggcaggtggatcacctgaagtcagaagttcgaggccagcctggccaaacatggtgaaatcccatctctactaaaaaaaaaaaaaatacaaaaattacaattcaagatgagatctgggtggggctacagagccaaaccatatcacctcacttctaatcattctgtaatgtaggtatgatacaaatacatatcttttaaggttattttgatgattaaatggattagaacagtgcccagcaccagataaatgttacccattattatttttgcatttaatcttcaccacagctctttggagtaggtattaaccaggccaaaagttaagtaacttgtccaaagttacacaactagcaagcgaaaattcgcttcaaagccagtattttttacgactatacctttacttatgtccatgagtgggtggggaaggagagatttggatcttctgtcaaagccaatgatttcttactaattgtgatcttgtgaaagtacttttccacacctcagtttcttctgtagaatgagcataatactcacattgcagataatctatagaataactaataaaaacaaaccttgtagtgtgcctgtcagaggtactcaataaatgttagttcccttttccctttgataaaatctgacctcatggagatgggagagaataatcttgcaatgagaataatttttacctcttgacttatgcatttttctacttaaattggatgtctgtctaatgcttattatatataaacatgtgtaatatagctgcacctggttttgtctagtgttgatctttggatttgatccagacttatactgtaacatttttatgcctgagtgtgagtattctaaagacccatttcacagcaagtctggcttcagagctttatttccggttgggtagaacacagtcatgtggttgatgtctccattgttgcttttatcttttgcagcagatgtgaaagtaaacatacaaggttgaaaaacaggaaggggtttgagttgggagggtgtttttgaaaggggaacttgtacacaagtgacctgcaatctgaagtgtagcttttagcagttacagaaagatataccttattgtcttaaagtaaataaaatagcaagtgattttgcagtttaatgaattcgtgaatttacatatatttttgcttttatacattttggagaagcgcatattgtgttcctctttttgattgaaacagagaactgatgaattcaccccaattctgggttctttttacctgtgaaaaaaaattttcagtaaggaagcatggagttttttgttgttcgtgttgggtatctgttctaatatcattatatttggacttcctcaaaagccaaaacataagaccgcatttttctacttggctctatggtctttgttcctaaggaagggaattaacacatactgaatgctagctatgtatcagatactactctctgtgtatgctaattaatttaaatatttctgtgttttacatccaatctacaaggagtttttattgctttgatgaaatccctccctcccccttctttcctctcatctctccctttctccttctcctcttaaatgattctctggctgaacaattttctattaatagtatatttgggaggcagtatgatgtaacagccagtaaggatatgggatttggagtcagacctggatttacagtaaggttttgtttttgatagggaaaaactgctttctatctcaataaataaaagccagggtcccacagaactggctttagaaggagattctgcacatggggtggagtaattggagctcacagcaaggacttttgttcctgaagattcactttcccctggggaatcccttgctgacctcagaggtgctgctttcttttaattttctgccccagaggagagtcttctcttaatactcctgcagaacacagctgagaccaggctgtaacatctggtatgttactaaaggctcagagatgaaaaagggaaataagtacagagttactattatgcttctgtaatatctggctcacgagataaaacacacacctctgtaatttgtggtattctattgggatacctcccttacttgacccacaacacatatgttttctagtggcagaagccatctttatttctgctacttgggagtgcctccagcatatccagatttctctaaatacagaggagaaggtccagagggaaaaaaaaaattctttatcttaccagcctgtggttatatctgatacaggccccacttctttcatgtgatcaacaccaggtctatataacccttaggggagaccacagttacccacggaatatctaattaccattcacagaagagaaacacaaacagtacaggggtgttgggttagaggtagggaggccttccttttaccatttaccacagatcatataatctctgattatagctccacaacttggaacaaaatagctctcagtaaatattcccttccggttcttttaagcttaatgccatttgatacctgagaaaactacagtttagtttgttgcagttttatttctgagagttttgtttgaggagatctagtacttaatcaggtccaaagttaggctgaggaaagtggtgataagggtaggttggtgtgatcaagatagaacacctggtgcctagagcaggctgagtttaaatgttaaagggggtgtcctttgtaacatataacattaattatagaagaactaggttactgattcaaggtccttgggtttgtttctaaggaacagtgcaatacagtcaaagatctttggaatcataaatgtggtttagaatcctggctctggtactgactgctgtgtgtctgtctttatgcaagttacacattctccctacttctcagtttcttcatctgttaaatttgtataacatttaacatgatatacctcccttttagaactgccgaaatgatcagaaataatatgtaatatgcttaacatagtacctgtcacataatgtgctcttaatgaatgggaactaattattattttaaatgatgttcctttataatctcactggtacttgacttatacatgctgtgaccttggccttctttttttattttaatttttactatttttttttttttgagacagagtcttgctctgtcgcccaggctggagtgcagtggcgctgtctcagctcactgcaagctctgcctcccgggttcacgccattctcctgcctcagcctcccgagtagctggaactacgggtgcctgccaccgtgcccggctaattttttgtattttttttttagtagagacggggtttcaccgtgttagccaggatggtctcgatctcctgaccttgtgatccgcccgcctcggcctcccaaagtgctgggattacaggcgtgagccactgcgcccggccaatttttactattttttttgagacggagtttcactcttgttgccggggctggagtgcaatggcgcgatcttggctcaccgcaatctctgcctcccgggttcaagcgattctcctgcctcagcccgccgagtagctgggattagaggcatgcgccaccacgcctggctaattttgtatttttagtagagacggggtttatccatgttggtcaggcggctagtctcgaactcctgacctcagatgatctgcccgccttggcctcccaaagtgctgggattacaggcgtgagccaccgcgcctggcactgggccttctttttttttttttttttttttttaaagactttattgagatataattaacatatcatatgatttaaccatttaaagtatacgatttaatgttttttagtgtgtttatggggttgtgcagccatcatctcaatctaatttttgaacattttcatccccctgaaaagaaacttcatattcattagcagtcattccccattccccaccctgcaaccccagtcctaggtaagcactaactactttatgtctctctagatttacctattctagacatttcatataaatagaattatacaatatgttgcttcctttttttttttttttttttttaaagaaacagagtcttactctgttgcccaggctggagtgcagtggcaccaacataactcactgcagccttgaactcctgggctcaagtgatcctaccgccgcagccttctgagtagttggaattacagacacacaccaccacaccagctaattaaaaaaaaaaaaatttttttttttatagaaacggggtcttgtcatattgcccaggctggtcttgaactcttgggctctagacattgtccttcctcagcctcccaaagtgctgggattacaggcatgaaccactacatctggccctgaactgtgtgtgtgtgtgttttttttttaatttgagactgagtctctctctgttgcctgggctggagtgcagtggcacgatcttgactcactgcaacctccgcctcccaggtttaagtgatccttcagcctcagaccccctagtagctgggattataggcacacaccaccatgcctggctaatttttgtatttttagtagagacggggtttcaccttgttggccaggctggtctcgaactcctgacctcaggtgatccgcccgcctcagcctcccaaagtgctgagattacaggcgtgagccaccgcacctggcccatttcatcaccttttttacctgtaatttttctctggctgaatatgcttttaagaaataaaagttctcaataaaaatcctgtggtatattgtaccttgtgataaataatacccaagatccatgatgggaagggagatttttaaacatatcttaaatacatgatactgaaagtatgaggcagactaaattattccatcagtattcagaatacttatcaacagagactttttaggaaaaaatacaaaattatgaatacaaaactagggatgaaaacaaatacctatctagaatgagaaaaccacaagttacatattttaaaaagctgaaaaataggctgagcatggtggctcatgcttgtaatcccagcactttgggaggctgacgtaggaggatagcttgagcccaggagtttcatactagccagggcaacatatgataccacacctctacaaaaaatttaaaaattaatgggacgtggtggcatgtacctgtggtcccagctactcgggaggctgaggtgggagggtcacttgagcttgggaagctaaggtggttctagccttggcaacagagtaagactctgtcattaaaaaaaaaaaaaaaaaaggctgaaaaatagcacaaatatcacaaaatttagaaaaatagcttaacattttaattaactgatatggtgtcatagttcatttttttctgtatttttggcttcatactcctctaaagagttttatattatgactttgtaattttttttttttttttgagacaaagtctcgctctgttgcccaggctggagtgcagtggtgcgatctcggctgactgcaacctccgcctcccgggttcaagcagttctcctgcctcagcctcccgagtagctgggattacaggcgcccgccaccacgtctggctgattttttttttttgtattgttggtagagacagggtttcactgtgttagccaggatggtctcgatctcctgacctcatgatccactcgcctcggcctcccaaagtgctaggattacaggcgtgagccaccgcgcccgaccaatgactttgtaatattttcaatagagacagcacaaagataattcagtcttccttttagcttggtggccttggcaggggccagtacaaatgagggccctgagcttaagcttattttaacagtaaatctacttctgcatagtaagtaatcttaagagatgaaccaagaggttgtaatatgcctagtctatattttaagcatttattgcaattgtttggttattataagttgcttcatgtgaatcattttcttggatttaatgttcaactagaaacttgtagtgttttgttttgttttttgttttttttgaaatggagtcttgctctgttgcccaggctggagtgcagtggcactatctcagctcactgcagcctccgcctcccgaattcaagtgattcttctgcctcagcctcctgagtagcagggattacaagtgggtgccaccacacctggctaatttttgtatttttagtagagatggagtttcgccatgttggccaggctgatctcgaactcttgacctcaggtgatccactctccttggcctcccaaagtgctgggattacaggcatgagccatcatgcctggcctctatatttttatcttttcttccaggagccaaagctgctgctttttctccttttttttttttatgcttctctcctacctcctttaaaaaaaaaaagcagatatcttttttttcccaaataattcatgttattgttaatgtggagatgaaaaacaggccaaactagttatatattttcagtctaagatctttctcctctgttaagttttagactagatattcttgttttgtcaggctctcagtacattttctcttccatgtcaactctaattctcttcatctcttcttttggtagtgaaaatcaagtagaatattaaaagaccatatgctctgcaaatcacttagaagcaaacttgctctgtgatagtatggccttgatatttgtcattaatattattcgttgttttatttttggggtagctttctggaggtcaagggtttacaagtagaacaaagaaatatgagtagttagtgaccgaagaactaaagcttttttccaggattttcttgttttacaaagacacgtatagacattttgttagatttttaaatacctcagttgacaatttaaatgttgagagcccaatactgttagtattgtgaatatatttgagttgaatatatttggtatatttagtttgtatatttaattttttgaaaaagttttgtctttatgtatttttttctttaacatttgagcttgaatcaataaagggcagcaacagaaaagcattttggatcaaacatatttgccgtgttcactatattttgatgataaatagatggcaacatttgtctttgagtctgtcttgttctgctcaaaaagcagaaaagataggaagagagaaataagtaagatttactgcactttgcttaatattcttacagcaataacacaccttagctggtggtattttccttttatgaatcataaagtcagactgggagaggtaacttatctaaggtcatgaagctagtaactgagggtgctaagactcaatgtttagctgacttcaaaactgatgtgcagcactgtgattggatttggaactctcttctattgtggttagggtagtggtaaactttcatcctattcagattttcacaagtcataatttattgtcacctaggatgaccaggattcaatctaggctatcacattgcatttagtggttatgtcttccttagtctcctccaatctgtgatagtatctccttgcatttcatagcattgatgcgttcatagagtatcggccaggtgttttacaaaatgccagtcggggtttgtctgatttttttccacgattagatagtagatttttgggaagaatacagaggtgatgtgtcctcagtatgtcatgttgggcaaagcaagacctagtctaaaaaaaccacacacacggttttagatttacagatttattgtgaagatagtacagagtccctatataccccacactgcagtttcctctattattaatatattagtatagtatatttttaacattagtaaactgatattgatacattattgttaactaaagttcatattttattcagatttcctcaggtttttttcctaatgtctttttcctgttcctgaataccatccaggataccacattatgtctagtactcatttctccttacagttttcttggttgtgattgtttctcagacttgctttgtttttgatgatcttgacagttttgagggttgttggtcagatatttgtaagattgcctcagttgggatttgtgtgatgtttttgtcattattagacttgataatgtgtttttgggaggaagacccagagaggtaaagtatcattctcattacttcctatcaagggtacatcctatcaatatgacttatcactactgatgttgaccttggtcttaaggtagtttatcaggtttctctgctgtaaagatactttccccccttttccatactgtactctttagatgaaagtcactatgcatagcccacacctaaggagtggagagttgtactctacctccttgagggcaaaatatctacacaaattatttgtaattctgcatcagagactttatttttcctcatctgttcaatcatttatatcagtgtggagtcatactgatatggatatttattttacactttgggttttaatccagtattacttcatttattttgttgctcaaattgttccagctttggccatcaggtgctcttttggttggcctctggttcttttgacattgtgtgtgtgtgtgtgtgtgtgtgtgtgtgtgtgtgtgtgtgtattttaatactttcctactttgtggtactacaaaatgctccaggctcatcttgcatatttcctgcccggctcctagaatcagtcatttctccaaggagtccccattccttttattggataatggcattagaaaccaagatctggccaggcacggtgactcaaacgcctgtactcccagcactttggaaggctgaggcagaaggattgcttgagtcatggacaacatagtgaggccttgtccctacaaaaaatgaacagaactagccaggggtggtggcgcatccttgtggtcccagctactcaggaggctgagggaggatcgctggagcttgagaggttgaggcagctgtgagccatgttcatgccactgtactctatcctggttgacaaagtgagaccctgtatcaaaaaaagaaaaagcataaataaataaatcaagatctggccaggtgaagtggcttgcacctgtaatccaagcactttgggaggatgaggcaggctgatcacctgagctcaggaattcgagaccagcatgaccaacatggcgaaacgctgtttctacacaaaaatacaaaaaaagttagcccggtgctgtggtgcgcatgcctgtagccagctactcgggagtctgaggcacaagaattgcttgagcctgagaggcagaggttgcagagagccaagatcacgccatttgcactccagcctgggagacagagcaacatcctgtctcaaaacacacacacacacacacacacacacacaccccccccccccaagatctacgcactaactgcttataactgcttagttgatcttcttccctctagtctttttccttttgccatattcattccagtttatcttgccatactcatcttcttcaaatagagcttccatcgagtaggtaatctctctccttaagagttactgtaggccaggcatggtggctcacttctgtaatctcagcactttgagaggctgaggcaggcagaccatgcggtcatgagatcgagaccatcctggccaacatggagaaaccccgtctctactaaaaatacaaaaattagctgggcgtggtggcacatgcctgtaatcccagctactcgggaggctgaggcaggagaatcgcttgaaccagggaatcagaggttggagtcagccgagactgtgccattgcactccagcctggtgacagagcgagactctgtttcaaaaaaaaaaaaaaaaagttactgtagtttattattgcttatctgatcaaatatccttagcctagcttcctttgcctcacctagtatacttctcattattaaaggtttgtctctcatatccttcttacgctgttctaaccttggcatgatttatttgccctttcttctctggccttccaagtctaattcccactttcttcattcttatcttagggtgctctagctttttgcatttattagacttgtatgttttttgtacttggtaattaatagtcaaaattagaagcacaatctaaaacttcagaagggacttcagaagtcatttggcctatttcttcagttagagataagaaaactgtggccccaagatgtggagtgacttgactaagtgatggcaaagacggagctggatctttggctttctctcactttgtacagtgttttcacatatgcagctgcttcatgccctatcccctaacttgtatcctaaaaaaaaattgagatataatttacatataaaatttaccattttcaaatgtacaattcagtggtcttttagtatattcatcattaccactatttcagtccagaacattttcattactccaagaaaccccttacatgttagcagttacatttccccatccccccagactctggcaatcaccattctttctgtttgtatggatttgcttattctgaacatttcacataaatggaatcacataatatgtggtcttttatgtctggcttcattcacttagcatgtttccaaggttcatccatgtggtagcatgtatcagtacttcattcctttgtatggctgaataatattccactgtagtatcacacaaaaatattctattgtatatcacattttgtttatcccttcatcagttgctggatattgtgttgtttgtgctttttggctattataaataatgctggctatgaacattcataaacaagtttttatttgaatatgtgtttttggtttttgtggatatgtaactaggagtagaattgctggatcatatgtaattctatgtttaactttttgagaactgccacatggtttttcacagtgactgcaccattttacattcctaaaggcagtgcataagggtaccaatgtctctgcatccttactaacacttgttttcctttgtaaaaaaaaattatagctatcctaaagggtgtgaaatggtacctcataggggttttgaattgcatttccgtaatgactaatgatgttgaacaccttttcatgtgctattggccatttgtgtatcttctcttgtgaaatgtctgttcaagtactttgctcatttacattgtgttatttgtctttgaattgtgagagtactttatgcattccatagactaaacctttatcaggcatataatttgcaaatttctcctgttgtttaggctgtatttccacttttctgacgcattttaaagcacaaaagtttttatttatttatttttttttgaggcagagtctcgctcttgtcgcccaggctggagtgcaatggcgcgatctaggcttactgcaacctctgcctcacaggctcaagtgattctcctgcctcatcctcccaagtagatgggatgacaggcatgggccaccatgctcggctaatttttgtgtttttagtagagatggagtttcaccatgttggccaggctggtctttaactcctgacctcgtgatctgcccgccttggcctcccaaagtcctgggattacaggcgtgagccaccgcgcctggccataagttttgaattttgaagtccaatttataaaaaaatttttggttgtttttggtatcatatgtaagaaatcattgcctaaatcaaaatcatggaaatttacgtcttatcttttcttctaggaattttatgttagctcttacattcatatctttgatccatttcaaattaaattttttatatgaggtgagacaggggtctgtctggattcactcacttgcaggtagatgtccagttgtcccagcattatatgttgaaaggactttcctttcctccattgaattgtcttggcacccttgttgcaaccaactggatatagatgtatgagtttatttctggactctcagttccattccgttgatctacgtgtttatccttatgctggtaccacattgtcttgattactgtaggtttgtggtaagctttgaaattggtaagtgtgagtcctctaactgtggtcttatttttcaacattgttttggctgttctggctatcccttgtatttccatatgaattttagcatcagttttgtccatttttgtggaaaaggtagttgggattttgatgtctactgcactgaatctgtagattaatttgggaatattgccatcttaacaacgtgaagtcttctaatctatgaacatgggattttttccgcttatttaggtcttccttaatttctttcattgatgggttatagttttcaatgcaaatcttgtatgtactttgtttgttaaatttattcccaagtatttcattattttgcatgctaaatggaattttttaagttataattttcagattatttattgcaaatatatagaaatacagttgatttttgaatttttttttttttttgacacagtatctggctgcgtcatccaggctggagtgcagtagtgcgatttttgctcactgcaacctctgcttcccaggctcaagcaaacctcccacctcagcctcctgagtagctgggaccataggcatatgtcaccacgcctggctaattttaaaatttttctgagagactaggtttcgccatgttgcccaggctggtctcaaactcctgggctcaagtgctaggattacaggcatgagccaccataactgtcctgatttttgaatgttgatcttgtatcctgcaaccttggttaacttgcttgttagaactagtagttttttttgtgtggattccttagaattttctatttacaagattatgtcatctgcaaatagggatagttttattttttctttccaatctggatactttttaaaaatttcttttctaggcctaattgccctggctagaatagccagtgcaatgttgaatagaagtggtaagagtagacattctagtcttattcctgacattaggataaaaaccttcagccttgctctgtatgttgttacaggatgtattgatgctagctgtggattttttttagatactttttatcaggttgaggaaattcctttctattactagtttgttaagtgattttttatcatgaaaggatgttggtattttcaaatgctttttttgtgtctgttgagatgatcatgtggattttgtcttttattctattggtgtggtgtagtgcattgattgacttttgtatgttaatccaatcttgcatccctgggataaatttcatttggtcatggtatgtaattgttttttatagccactggatttggtttgttagtattttgttgagggtttttgtgtctatatttatttattttttatttttatttatttatttttttgagacggagtctcagctgcccaggctggagtgcagtggtgcgatcttggctcactgcaatgaccttcttccgggttcaagcgattctcctggctcagcctcccgagtagctgggattacaggcacttgacaccacgcccggctaactttgtatttttagtagagacggggtttcaccatgttggccagggtagtctagaactcctgacctcaggtgatccgcccacctcagcccctcaaagtgctgggattacaggcgtgagccatcgcacctggcctcaagtgctttttaaagatcttaatatttttcttatgtttttgaatcagaatgccctagtatcagttatctattgctacacaatcacctcaaaacttaatgatctaaaataatagctattttattttctgtgattctgtgaatcaggattttggacagggctctgtgaaaatggcttatttctgatccatgtgatagaaactagggcagcttatcaatttcatgtggcgtaagttaacagtgggtgggctggagctggaggatccagtatggccttgctttgatgtctggtgcctcaacttggatgcttcagtcatctgggggctggcttgagaaggctggtcctcattcatgactgtaacacttgataggaggagttgttggtagccagctttgtagccaaactaccagagctcttaaacaaatcgtacatcagggagaaagcttaaatcttgattttaaatgactgttttgggcattactttcagaataattattagaagtgccttgattaaacttagataactaacgttaaaatatacgaaatcagatagtaaagtgtttcttgggaaatggttgaagtaaccagttttgatattatgtttgataggtgcaaaaattagtatttcgccaggggcggtggctcacggctgtaatcccagcactttgggaggccgaggtgggcggatcacctgaggacgggagtttgagaccagcctggtcagcatggtgaaaccccatctctactaaaaatacaaaaattagccgggcgtggtggcgggcgcctgtaatcctagctactctggaagctgaggcaggaaaatcacttgaacccgggaggcggaggttgcagtgagtcgagatcgcgccattgcactccagcctgggcgacagagcgagactctgtgtcaaaaagaaaaaaaaattaatatttcttggaaatcaagtctgttggggaaactgttctagactggttgcaattatatttaattttgaggtgagttatcctagtcctaagtagggaaacaaaaacatccagagtttggatgtatgttgtgtgaccaaaagaaaatgtttacaatcgtctgacatgttatatgccaggaaatatgcattaggatatccattgtgttgcttgataagaaaacgaaagcactgacatttacttttcttactgggaacttttcatgtctgaaagtcttgatcacctatttattaccttgaggtatagggtatggaaagcacattaaaaaaatcagtagatggtgaatttggttttcagaacatatttcacagtattaaacagaatatcacattatcatcacatttaatgtgaagttaaataatgaagaagggccaggctcagtggcttatgcctgtaatcccagcactttgggaggctgaagtgggtagatcacttgagctcaggagttcgagattagcctcctgagacctgtctctaccaaaaaaaaaaaacaaaacaaacaaaaaaactaggtatggtagtgcttgcctgtagtcccagctactcgggagactaagatgggaagatcgcctgagactggtaggtcaagactacaatgagctgtgattgcaccactgctctccagcctgggtggcagagtgagaccttgtctcaaaaaataaaaaaccaataatggggaaaaatgaggtataagtccaacgaggtatagttctaggcaggttttgtaagatgagtatccttcggaagaagaaacgtttacagtgaatttttactgagtcataagaaatatttgtcaaatgttacctaagctgtagtactgatttattaacagatagtttttctgtaaagaaaatccacataaataagtgatttaaaatgctttctcaggccgggcacagtggcccacgccagtaatcccagcactttgggaggccgaggcgggcggatcacctgaggtcgggagttccagaccagcctgaccaacatggagaaaccccgtctctactaaaaatacaaaattagcagggggtggtggtgcgtgcctgtaatcccagctactcggaagctgaggtgggagaatcgcttgaacacaggaggcggaggttgcagtgagctgagatggtgccattgcactccagcctgggcaacaagagtgaagctctgtctcaaaaaaaaaaaaaaaaaaaaagcaaaaacctttctccctgactttacaaattttagaaaatttgtagagttgtagaaaatttgaacgataaagtataaagaccaaaactaaaaattacccgtaatcctattaatgctaatactataaatattttgatgttccttctttcttttcataaattttttatttggaaaagtacagagataacaaaaaccaaaatgtttttcctattttcacatagtcatcacagcacttttgacaccagatgtgtggcgtggtttttcccacacactaaccaagcaattctccaaaggatagcagctgggtgtcctatataattcacttcaattctgacactatctacctggagatagcatcagatcccacaggttgagggctcagtcccacaagactgtctctcatatcagatgctattcacaagacccaggttgtgacctgtgcttctgaccaactggctccaaattggggttcccacaaccccctctttgggttcaatcagtttgctagaggggctcacagaactcagggaaacactttaattatgtttacccatttgttagaaagaatattacagagaatacagatgaaaagcaaagttgaagaaatgcatagggcaaggtatgggggaaaggacatggagctaccttgccctctctgggcacaccaacctccacgatcttacatgtgttcagcaatccagaaactttctgaaccagtccttttgatttttcatggaggcttcattatgtcctgattgattacatcatgggacatgggtgatcagctcaacctaaagctcctttaccctccctggagattgtgtggtggtggtggcactgaaagttctaaccctctaatcacatggttggttcccctggcaaccagcccccatcctaaggctatcctggaaccccagccatcactcaattcattagtattcacagagacccttagcactttggagattccaagggttttaggaagtatgtgccaggaccagagaccaaatatatatttcttactgtatcacaatatcatgtgaggtaatatggagctttgtggatttcattcctccagctccaccctccccccaacattttgattccattgggaaatcttactgtcattttaaattataataggaatattaactcagtttattggaataaaagatataagaaaaagttcttctcctacttatataccaggagtgtgggtttcaactctggccagtgaaacaagcaaaatatgttaatttggtaaaaaatttccataataacagttcctttgattctaaggaaggaaataaagatttcaaaactaatcgagtcaaaaaatttgtgaaagattcgaataaacatttctcaaaagaagatatacagatgacaaacaggcatatgaaaaggtgctcaacatcactgatcatcagagaaatgcaaatcaaaactacaatgaggccgggcgctgtggctcatgcctgtaatcctagcactttgggaggctgaggtgggtggatcaccttaagtcaggagttcgagaccagcctagccaacatggtgaaaccctgtctctactaaaaaattaaaaaattagccgggtgtggtggcacgcacctgtagtcccagctacctgggagactaggagaaatacttgaacctgggaggcggaggctgcagtgagctgatatcgtgccactgcactccagcctggatgatagagtgagactccgtttcaggaaaaaaaaaaacaaaacaaacacactacaacgagaagcttacatccaagacaaaggcaataacaaatgctggcaaggatgtggacaaaagggaacccttgtacactgttggtgggaatgcaaattagtataaccattttggagaagtttggaggttcctcaaaagactaaatattgagctgccatatgatctagtgatcccactgctggatatatacccaatagaaaggaaattaatataacaaagaggtatctgcactccaatgtttgttgcagcactgtttacaatagctaagatttggaagcagcctaagtgtccatcaacagataaatggataaagaaaatctacatatacacattggagtactattcaaccataaaaagaatgagaccctgttatttgcaacaatatggatggaactaactggagttcattaagtgaaataagccagacacaggaaaacaaactcctcatgtttttacttatttgtgggatctaaaaatcaaaacaattgaactcacggacagagagagaaggatggctaccagaggctgggaaagagtagtgtggaggcgggggctgggaggagaggaagatgaggatgttaattggttaaaaaaaataggaagaatgaataagacctactatctgatagcacaatagggtgactatagtcaattatagttgtacatttaaaaataacagaatgtaattggattgtttgtaactcaaaagataaaaatgcttgagaggatggataccgcattctccatgatgtgcttctttcattttgcatgccatatcaaatcatctcacataccccataaatatatatgcttactgtgtactcacaataattaaacataaaactctcagatctggtttttttttttttttttttttttgagatgtcttgctctgtcacccaggctggaatgcagtggtgccatcttggctcacttcaacctccgcctcctgggttcaagtgattctcctgcctcagcctcccgagtagctgggattacaggcatgtgccaccacgcccggctaatttttgtatttagtagagaaggggtttcaccatgttggctgggctagtctcagactccctacctgaagtgatccacctgcctcagcctcccaaagtgctgggattacaggtgtgtaatgtaatgcctgtaatcctagcactttgggaggccgaggtgggaggactgcttgagctcaggagtttgagaccagcctgggcaatgtagcaaaacccaatctctaccaaaaatacaaaaaaattagccgagcatggtggtgtgcgcctgtagttccacctacttgggggtctgaggtgggaggatcacttgaatctgggatgcggaggttgcagtgagatcgtgccatggtactccagcctgggtgacagagtgagatcgtgtctcaaaaaaagaaaaaaaaaaaaaaagaaccagaatataatcctgtttataaatctttaaatttggaggtaatactttaccatctaaaattgttcttactaataatgatataaactgaattatgctataattgcccttattccagtgaagtctctgttgttacttgtttaattatctggtggtgaaaattacatacagataatatgtgttcctgaagagaaatgcacctctgacataattctcctccttttatttggaggggtgggtgttatatcgataaagacggtgtatattctctttattgatgtccttgtcacataaaggagttcagttaatgtttgttaataataactacttggtatctgtagttgagaggttttaaatagataatttttaaaatgagctatatcaccaaccccaaatagtgttaaatgtaacttttatactgcaaccatagcatcaccctaagggaaaaaaaggagtttcataactctaaaggaaggaaggtattgtggagcagtgaatatattaagtataagtgtttaatattctgttttaaaattttctttaaattaggaaatgggccaaagttaatggattgatgtggattgtgaggctaacgtcagaatactgtatattagccactgaatatttatttctcttgtgtattttggtgggattccttacataggtttggcaacaaaactagaaaataaatttcctttcagtgatacaaaattctgttgggctagctgaattagattgacattagtcaagatttgccagaaacattgtagtagtgctggttaatatagcctggttttgcaaggtggcctcagactgctgttatacttgtgaactagccagagtatcccaactgtgataggaaagtagacattgtatgatgtatgggaaattcatctttgaaaaaagtgagtttatgcctttcagatccatactgtgaatgaatgaatataagagtgaaaacgctgctgacaaagatttggatatttgataacgtatacaattttattcttttactaaatgtttattcctttttactaaaaaaaaaatacttttgtgattgagaagaaccttaacattgtctacttcaacttcttttttttttttgagatgaattctcgctctttcgcccagcctggagtgcaatggcgcaatttcggctcactgcaaccttcaccttgcagtgctaaaggggtttcaccgtgttggccaggatggtcttgatctcctgacctcgtgatccacctgccttggcctcccaaagtgctgggattacaggcgtgagccactgcacctggccaactctttttcaaaaaaagaatctcctgctataacacctatcatcagttggattggaactgtgcaaaatgtggatgtaaacaatttaggattaactagacataatgtgacaattttggatattttatattttagattccactttttattttggtctactgatttccagtagaaaaaattttaggatttctgtaacacgtaaataattgcaacttcaataacatatgattacttgaaatagcgactctatttttcatttcattgaagtagtaactgcattttgtttcatacctatactcctccctgcttcaatatttagcatgtcactttgaccaataaagataaaattatgaagaagatagctgactggtttaaatatcaaagggctgccctagggttcactggtctggttcatgctgtttgatgtattaaagacattcataagggcaaacaaggtattagcaaatatgtcagatgttttatgtttttaatgtgggatgaaataaactcatacacaaggagagagggagagaaacctacattatgactgaaagaaaatatcctgtgcatagagctaaatatgcagagcatggtggaaccacaaaaagggagataaggcagggtacctaattattcagaaacgagaatggaatagcaccagatatgcaagggaaggccaaattaatggatcagtgtaactttaaacttgttgcttaattttgaatctcttggccgggctgggtggctcacgcctgtaatcccagcactttaggaagccaaggcgggtggatcacaaggtcaagaccatcctggccaacatggtgagacctcaaatccactaaaaatacaaaaattagctgggtgtggtggcgcgcgcctgtagtcccagctactcggaaggctgaggcaggagaatcgcttgatctcgggaggcggatgttgcagtgggcggagatcgcaccactgcactcccgtctggcgacggagcgagactccgtctcagacaaacaaacaaacaaacaaacaaacaaacaaacaaacggccttttaatctcttgagggcaaatggctttctttttattagatgcaaccagggaagtctagtgtttggatgccgttaaaaatacagttattcagcggggtgtggtggcttactcttataacccgagcactttaggaggccgaggtgggcggatcacttgaggccagcagtttgagatcagtgtggccaacatgatgaaacctgtctctatcaaaaatacaaaaattagctgggtgtggcggcacatcctgtaatctcaactactcgggaggctgaggcatgagaatcacttgaacccaggagtcggaggttgcagtgagctaagattgcactccagtctgggcaacagagtgagactgtctcaacaaacaaacagcagttattctagatataccgcagaatagtttagccactttaatgtttattataggaattttatattagttcttgctaaccagcgaaattctttcagttatgttagtctactgactagaatgcattttggtttgctacaaattgaaatgggtgttttttttttcatgttctttttaaacattcccctcattctgtataaaacatacttgtggacattgtctacttaagcctttatactatttatactgtagaagttatatctaatatatctcaaatcatttggggattttgttttttcaagaaaagtttgaaacatactcaaacaacagttcttagaaagctgcttaggatggtactgaatttacttgtgctaagtggcgagaatggattattgaaagtgaagcaggctgggcgtggtgactcacgcctgtaatcgcagcactttgggaggccgaggcgggcggatcacgaggtaaggagatcgagaccacggtgaaaccccgtctctactaaaaatacaaaaaacaaaaaaattagccaggcgcggtggcgggcccttgtagtcccagctactcgggaggctgaggcaggagaatggcatgaacccgagaggcagagcttgcagtgagccgagatcgcgccagtgcactccagcctgggcgacaggagactccgtatcaaaaaaaaaaaaaaaaaaagaaagaaagaaagtgaagcagcaactattggaggatagcaagaatggagtgtcctttttaagtgatgtaaatctgtgcttagtatccttttacgctatttttatatgcttgtgtgatatttgattcattaaaaagaatttatgagccggacgctgtgacttaacgcctgtaatcctagcactttgggaggccaaggcgggcagatcacaaggtcaggagttcaagaccagcctggccaatatggtgaaaccctgtctctactaaaaatacaaaaattagctgggcatggtggtgcgtgcctgtagtcccagctactcgggaggctaaggcagaagaatcgcttgaacccagaaggctgaggttgcagtgagccaagatcacgccaactgcactccagcctgggtgacggagcgagactccatctcaaaaaaagaatctatgaaacataaaatgtagtttaggaagtgtaatattaaagtagcacctataaacctaccatccaacttaagaactagaactatactagtactgttgaatctaccagtgctctcttcccccattcattctcctgccttcccttcagagataactgctgctgagcattttgtatttcacatttatttaaaaaataattttaggccagccttggtggctcatacctgtaatcccagcactttgggaggccaaggtgggaaaactgcttgagctcaggagtttgggaccagcttgggcaatatagtgagatcacatctccacaaaaaattttaaaaattagctaggcatgtggtgtgcacctgtagttccagctacttgggaggttaaggtgggagattgttggagcctggatcaaggttgctgtgagccatgatggcatcactgcactccagtatgagtgacagagtgagaccctgtctcaaaaaaaacttaccatctctgtattactatatatagatatatattacaacagatagatctttaaaaatatattgtttagttttgcttggttttgagctttataaaaatggtatattttgaattctgctatttccttttttccactctgttatttatttatttatttatttttattttttttttagatggagtctcgctctgtcacccaggctagagtgcagtggtgcaatctcggatcaccacaatctccacctcctgggttcaagcgattctcctgcctcagcctcccgagtagctgggattacaggtgcatgccaccacacccagataatttttgtatttttagtagagacgaggttctaccatattggccagggtggtctcgatctcctgaccttgtgatgtgcccgcctcggcctcccaaagtgctgggattacaggcgtgaatcactgtgcctggccccactctgttatttttaagacatttatttatggtactgcatatagcttcagttaatttacttttactgtggtataatattccattgtatgactatttcataattaatttatccattttcctgataatagacattgcagtggtacagtgaacattcatgtacctgtcttcttgtctatgcctgtgatgtctccttgtacatgtgtgtgttagtgtgttggatgtgtaggtgtgtgtaagcatctcaaagtttctctaaggtagatacttaggagtagaattgctgagtcatagagtacatgttcagccttacaagatatgatagcatttaatttaataatcagaacaacctgtaactatcaacagtttaataaactgtggcttagagatgttatgtatccaagaagccacatagatagcaagtggctgaacaagttcaaacccatgtttgtttaactttaggaccagactctagcagtaagtcgttttgtctttctatagtaagtgtccacaatcaggctttatatatagtataattgggatttattttagtgtgaatgtttaaggcatacatctattttgaagagtaaaatgtatgtatatgttaataaaaaactgtcttggtcccagtctcctaaatttatgctctgccaaccttaacatatggctactgttctgaagggagcaggagaaaggcagaaggccaaagggcctcccctctcccttcttgcttagaacacagatggctggctgggtaacagaagagccatcttgtgaccttcagcctcttgagtagcttgttcttattaacaaaaatccccatataattaagagcagattgtttccaactaaaaggccacatttcctacctctctttacagatagaggcagcctcccaagagggaagagacatcttgaacaggcacctagcagtttctgtactttttttttttgagacggagttttgctcttgttgcccaggctggagtgcagtggtgcagtcttgggtcactgcaacctctgcctcccaggtgcaagcaatttttctgcctcagcctcccaagtagctgggattacaggcctgtgccactacgcctggctaattttgtatttttagtagagatggggttttgtcatgttggccaaggctggtcttgaattcttgactcaggtgatccgcctgcctcagcctcccaaagtgctgggattacaggcatgagccaccgtgcccagccctctgtgctattatatcaaggccaggtgaagatatataaccctcttcaatttaccaaggatggtattatggcttttggtttttaattattgagaaaatatatctataaaagctgacttctgctgggttcagtggcatgggcctgtagtcacagttaagaggctgagcaacataagaccccattaaaaaaaaaacaaccccaactcttacacatttaccctgtgtcttacacacacacacacacacacacacacacacacacaaatgtgatgtgtgttggaggaattggagcaggagactgaagggactacagtaatggagtagaagcaaatcagaaaagacttgaagtgagaggatatctactaagggaatttggcctaggcagacagaagttgtccaggaaaaaggtactatgcacattgtttgaaatcgagatcaggctgggcgtggtggctcatgcctgtaatccccccactttgggaggtagaggcaggaggattacttgagctcacaagtttgagaccagcctgggcaacatggcaaaaccctgtctctacaaaaaatacaaaaactagccaggtatggtagtacacacctgtggtcctagctacttgggaggctgagatgggaggatcacttgagcctgggaggttgaggctgcagtgagctgtgattgtgccattgtactgcagcctgattgtgccatcgtactgcagcctgggaatgacggagcaagaccctgtctcaaaataaataaataaataaaaatcaggagatcactatacttaagaaaactaagaattggcttgaaaattagtgttactgtttgatcttgatttcaatctatggagagtcaggggtgaccttgcctcctcacttgttaggggaactgagaaaaatatgtctaattcatattggggatataagcaagggtagggttagaggaaaaacagaattatatagcctgtattaaactgggtcaaattgaattgtgtaatgagactttatgcttataatttactacctgatatagtaaaataaaattttatcccttcctggagtgaggagatacttttttttttttttctgtcagttatcaaagtggttcgtgcggccgggcacggtggctcacgcctgtaatcccagcactgtgggaggccaaggcaggcggatcactaggtcaggagttcaagaccagcctgaccaacatggtgaaaccctgtctctactaaaaatacaaaaattagccatgcatggtggcgcctgcctttaatcccagctactcaggaggctgaggtgggagaatcacttgaacccgggaggcggaggttacagtgagccaatatggcaccactgcactccagcctgggcgacagagcaaaactccattgcaaaaaaattaataataattaaaaaaaagtggtttatgctcattttagtcaatctggaaaatacagaaaaggggaaagggaaacattcctccataggaagataaccactcttggtatgtttcttcaataatgtattttttaaacatactgtaaccacaatgatggtgttaggttatcaattatgtgtataatatatattatggaagataagtatttccagacaagggctattatctaggagtttttctccatttttgcccattgcttctttttgtaaatttcttgcgtaaatttagatgaagctagagatttaacttgtcttttcctggaaacaacgtgagagattaagcgctcaccaccacgcccagctaatttttgtattttagtagagatggggtttcaccatgttggccaagctggtctcgaactcctgacctcaagtgatgcgcctgcctcggcctcccaaagtgccgggattacaggcatgagccactgcgcccggcccaaatatctatttagtgttcaaatttctagttgtctcaaatggaattttttttttttggtaatttcatttgaattagaattgaaacaaggtctacatattgcaagtgattgatatgtctcttaagtttctttcagtccataggtatactcttatctctctctctctttttcttataatgtgtttgttgaagaaactggatcatttatcctgtagaatttctactcagtctggattttgttgatttcagttccatggtagagtttaataggtttcttggttttttttttgtatttcctgtaaattatttgaatttacacataattgaatcttaaaattgagaaggaaaaccatgcgggccttttgctgtctcaagggttgcagttaatcagctgacttgagaaatccctgctgcccagggaccagatgaaacatagacaagatggcatgttaactttggatttcttgcctaatctggacacatttgtgtttaaaaaggaagcctggattatgccactgcactccagtctggctgacagggcaagacccggtctctgaatgaatgtatgaatgcatacatgcatgcatgcctgatccaagaacctgatgaattgaaccgttttccaatgaaggtgacattagactaatttaatgataagacaaaactaaactttttttagtgagaaaaacatgctttcaatttatttgtattagttagatctcattttcatcttacgtagttaataaagaatggatggacaccagggtccgaagccaaggttctcaaagttaagcatttatcaaaatcacttggaaggcttgcagacagattgctggacatcatccccagagattctgattccatatgtcaaggtcgagtctgagatttgcatttctagcaagttcccaggtgatatcagtgctcctggttaggggaccacactttgagaactattaggctgaagttcaaggatctgcattagaattacctttggagctttaaaaaactcttgaagatgccagtcagaggcctctgcatctatattttaacatgttccataacaattctaatgcgcaccccaggtgagaactgctgctgtaattatttatagtttattcctccatatttcccaagaaatgctcattcattattcatttcaaaatgttaaaagacttctaatattgtttaggcacatggttaggaaggattcattgttttatactgtgctatttatcattgttgtagagggcaaagtaaaagaaaagtgctaaataacaaagagctattggcacctgtcctggaaaatcagtattaatgctcttgcttgctgcaaagataactgctattttaagattattaatttttcccaaaggaaaattgaaaatagtttggtttgaggttgctgttccttaaatcagggaacccctttgtttagcattagatcctgaactttccattagccaatgtatgtgtgagccaataatgaatgatgacatttcagtcgtttttggagacatgccaattagtgtataagaaatttttagttcttaagtaacttttttttaaggaaaggctcaaacttcacacaatatactaatacttctactttacacttcacaagtctcccaattttagggtttaaaaatctttcactgacttgaaaaacatgccgatggttgatttcatgccaccatgtttaaggcatgtttggtttagttcaaaagcacattccctatatgtcactgggaacaaaaagatgacttaggcatagttccaattcaagcccagtctgatgaagtgatttccaaccttaattagtaaccattaattatgtagaccccgttcgtgtgatacgagttataattttaataattcttgattagcagaacacatgataaagctattataaatcagtacatcttttattaataaatgtgctttgattttattaatcacaacagcatctacatatatttgaaaaatagtagctggagccattattcagtctacaagcagtattggtgcatgtgacttttgaacccctgtgataaacttgaaagcctccaagagtccatggcctctactttcagggaagtaggttgactattattgttactagcgttaccacttgctaataatgcaagtacacaggccagttacaatgggtatttgtacaagaactaaggaattttccttcgtattgccctagtggggaagggacaagtcttatcttcctatttgaattatacttgtaaatgaaatgtttaacaagtaagttcttggtttttccttgacaatctgatgatctgtttttctttattctttttttttttgagacggaatcttactttgtcgccaggctggagggcagtggcgtgatctccactcgctgcaacctctgtctcccgggtccaagtgattcttctgcctcagcctcccgagtagctgggactacaggtgcacgccaacatgcccagctaatttttgtatattttttagtagagacggagtttcaccatgttggtcaggatggtcttgatctcttgacctcatgatccgctcaccttggcctcccaaagtgctgggattacagacgtgagcccaccacgcccagccctgatgatctatttttctacttgactgtcctccgtttactgagtgggtataggtgggaacttgacaaggttaatgacaggttgtggagaagattgagtgagagatgatgctgggtgggagtcagaggagactggacagtgaagggaatggagaataggatccacagcctgcatatatactgtatatgttgtctgttttaactaccgtaagaagtactaattaatctgtttgaaaacaatgacttttcagaaaaatcatagttaactgttatataataaacactataacttttgtgataatttgagaagaaattcccttgacaaatgcagtttactaacaaaggtttgctttaggaccatatgcataattctacttaatctcaaatgagttgtttccttttttgcaattagatgtgtgtgcagtaagagaaagggatgaatcaatctgcagtcagtgctgtgagtcagttgcagctgccatgtaaagtactctcatttagctattaaaagcctttgaagtcttgcatgtgtaaaatattcctaattcgctaggaacacacatggctgtgtgtgtatacatgtcattgtgcggtaggctgttctttattagaaaagtatatatctctgttgggtactaattacaactgtggctaggaaactgcagcaaggcaaataacaaaggcaacaaaggcaagagagagagagaactgggctttgctgttttacacctccagcataaataagacatgctgtgagtaaacacagctgtatggaaaattagttttgaagaattgaaagtaaataactgctggcttattcagcacatctatactgtaggtctccaagaacaagaacattttcttgaaactagagaacagttgtaggttgagttatttgtctcttggaaagttgtttgacaaattaatctttgttgggctgtactcagtattatattatagcctttatgcaacacaaaaccacaagtaaaccttaggaatttcattattagataattatgtgtaacactttaatatttatattactacagaataattcagagtaagaatcatctaaaatattatttattaagcacctactatacagttcttctgattaggtactgtgggagatacagatatttcaaatacagataaaccttaccttcaaagagcttgcagtctagcaatatacatgaaataatagaggacacagtagagtttaatgtaatgctggatgatataaagaagctgtctaaatttcaagaagaaatcactgagtgctagagtttaggaaaggcttcctacatgagctgcaacttgagcttagccttgaaatagtgaaaataattctataggcaagacatgaagaaaacattaaaaaagactagattgcatgtaatgtgaagagtgaataggattgtggttgaatctggagtaagtcagccctgttttgaagcttttgcattaaagcttaagttggcataggccatgtatcttgtaggtatggctaacatctgtcagatctggttttggcagaatagtaccacactacctagtaaaatcctttttcatgaggaatactctgcaggggaagtaagagaacattagaagtagtttttaggcatcttcatggggatgcccattgatttttgccaataatgattgcttctagataattcatttttcctccactatatgtagagactgtcaaaataataaaaaaggaaaggaaaaagaatgttcaatctgcctgacagaaacattgctaaaactttttttttgaaacggagtctcactctgtcacccaggctgaagtgcagtgacgtagtcttggctcattgcaacctccgcctcctgggttgaagcaattcacctgtctcagtctccctagtagctgggactacagttgcatgccaccacacccagccaatttttatatttttagtagagacgaggtttcactatattggtcaggcctgtcccaaactcctgacctcaggcgatccacccgccttggcctcccaaagtgccaggattacagatgtgagccaccatgcccctccagctaaaatatttttatactgggccattgtttttaagaattggtctttaaaaatggcctattttgctgtggggaaaaaatcaatttcagtgaagtttacagttttatgaacctgtgcttctcctccaattccttataccgtcttcatactcctctagtttgattctctttactttctacttagttgaaattactgttataattccagcaaatacctttccatactgtttgaattttctaaccatggccatgtgttactttttaatttaatttaatttattattatttttttttagaaatggagtcttgctatgttaaccaggcaggtctcgaactcctggcctcaagcaatcctcctgccttggccttccaaagtgttgggattataggtgttgagccactgcaccctacttttatttatttaaaagaagcttcaacagatattacctggttagtaggattacaggattattttaatgttctctatatttaaaaaattaatgagccaggcatggtggcttggtcccttgagcttaggagttggagaccagcctgggcaatatggtaaaaccctgtttgtatcaaaaatacaaagattagccgggtatggtggcatgcacctgtaacccagctactggggagactgaagtgggaggattgcttgagcctgggagattgaagtggcagtgagctgagattgcaccactgcactccagcctgggtgacaaagtgatatcctgtcttaaaaaaaaaattgtgtgttacctttgagtcaaacttgtggcatttagatagtggaataccgtgtaactgctgaaaataatggggctgggcacagtagctcacgtctgtaatcccagcactttgggaggccgaggcgggtggatcacttgaggtcaggagtttgaaaccaagcctgggcaacatggtgaaaccctgtctctacccaaaatacaaaaatttagctgagcacaggcatgtggcatgcacttgtggtttcagctactcgggaggctgaggtgggaggattgcttgagcctgggaggtgaaggctgcagtgagccataattgtgccactgcactccagcctgggtgacagagggataccctgtctccaaaaaaaaaaaaaaaaaaaaagaaagaaaaaagagaataatgaattggatatttaagcaaagatgtccaatatttaagtaaataaagatgtctaggtatagggattaattctgactgtaaggattacagaaataaaattcatggaaaacatggcgtgtgggcagggctttgaaggagggttagaatttcagcaggtggagatgcaggcttggggtattataaagaaggcagatgcagggaagtgcaggctgttttaggaagcagcaagtagttctaggtggggctggtgggagaagagactagtgagggcagatcacagccaagctggggtgctatgggaaaggagtttggattttataccatagctactacggagcctttaaaagtttgatcttttttttttttttttttttttttgagacggagtctcgctctgttgccaggctggagtgcaatggtgcaatattggctcactacaacctctgcctcctgcgttcaagcgattctcctgcctcagcctccaaagtagctgggattacgggcctgtgccactacgcctggctaatttttctatttttagtagagatgggttttcgccatgttggctaggctggtctcaaacttctgacctcaagtagtccacccgcctcggcctcctaaaatactgggattacaggcatgagtcaccgcacccagccaaaagtttgatctttcaataaatatttgttaactgatgaataaaagagtgataggattaaatctttgtttggaagagaaaacttttatagcaggagggactggaaataggttatttatagtcgagtgaattagagcagaaacagtaaaaatagaaacatatagttaaatgcagaggtagaggtagacttgacaggatttggcaagtgattgggtttaactaatttttaacaaaaaggggaatagaagaatttaaggttttgaatttgggaaaatgggagctatgttcttccttgctctcttttttctttagttttcttttcttttttttttgtatttttagtggagacatggttttcaccacgtttgccaagctggtttttgaactcttggcctcaagtgatctgcctgccttgacctccctcccaaagtgctgggattacaggcgtgagccccttcttgaggccctttctttttttttcttttcttttttttttttttttgagacaggatctcactctgtttcccaggctggagtgccgtgactcaatcactgcccactgtagcctcgacctcctggctcaagtagttagtcttcctgcctcagcctcccagaagcggagactacaggtgcatgccactacacctggctaattttttaaatttttatttttggtagaggtggggcgtctcatcatgttacccaggctggtcttgaactcctgggctcaagtgatccacccaccttggcctcccaaagtgttgggattacaggtgtgagtcactatatccagtccttccttgctttcttgaataaagcatttggaattgagtcatccttttattagggagactgcattattatgaataagaaccttgagctatataggatttattacccctacaataaatggtcaagtttgctataactggccaggcatagtggctcatgcctgtaatcccagcactttgggaggctgaggtgggaggatcacttgagcgcaggagtttgagaccagtcgggcaatgtagtgagacctcgtctctacaaaaaaaaaaaaaaaaaaacttaaaaaaaaaatcagcttagtgtggtgatttgctcctgtagaggctgtggtaggaggatcatttgagcctgagaggttgacgctgaagtgagctgagattgtgccaccgcactccagcctgggcgacagagatcctgtcgcaaaaaaatttaaaaaaagaaggccaggccaggcgcaatggctcacgcctgtaatcctaacactttgggaggccgaggcgggtggatcacctgaggtgaggagttcaagaccagcctggccaacatggtgaaactccatctctactaaaaatacaaaaaattagccaggcatggtggcagacacctgtactcccagctactcgggagcctgaggcaggaaaatcacttgaactctggaggcggaggttgcagtgagccgagatagtgccactgcactccagcctgggcaacaagagcaaaaccctgtctcaaaaaaaaaaaaaaaaaaaaagatggctatcactttggattttgatgtgtctctttctttcttttaggctgtttctttactcattgtatgtatctagaagaatcataaccccttctactttaaattcatctgttacatttgacaaacaaacttgttagaattaggcaaaaaacaaaggtaaagggactctgaatgagggccaaaaggggctttcctatataataaatatgtgttttatagtgctttttaattcctatggcatttgcagttttaagaaaaatcaccttacatgaataaggtgttaagtgctctccgagagtgtcctggtttattacgttgtactttaataagaattaataagtggttgagtgatagagttgttgaataaaggataaagtagcacactaaagcttaagatcattgatgtaatgaaagtaaaccaggctgggaatctgaacacccggtttatagtcccagtcctgccactgtaggacattgaataggtgatgttactcatctgaaattgtatctattttgataacatggggataatatctcttctctctacttgaacaatgaggtaacactgatgaccaagtcatgtccttccatgtgtgtgggaatatgtaatacatttctcaggaatacatatattaacactatgattctcataccttcacaaaaataaaaatgaaaaattcaactttatgccaatgcaaattactatcatcactcaagtttgattcttcctttccagatccaggagtggaataaatctttacagtacagtttaaatctttagaggaaactcccatcaattttctcttcttttgtgaggagagcaaactggttcctcctctatatagaaacccatcatgggtttatagcttttttggcaatagtaattttagtgtatttgccgttaaattttaagttggtttttgctcttattcctaaattgatttctctagttgatattggattttttttttaatggagatactagggtggtgcaaaagtaattgcttttactttttttttttgagatggagtctcgcccttgttgcccaggctggagtgcagtggcgctatcttggctcactacaacctccgcctcccaggttcaagcgattctcctgcctcaggcccctgagtagctgggattacaggggcccgccatcatgcccggctaatttttgtacttttagtagagacggggtttcaccacgttggccaggctgatcttgaactcttgacctcaggtgatccgcctgcctcagcctcccaaaatgctgggattattacagacgtgagccaccgctcccggccataattgctattacttttaatggcaaaaaccgcagttacttttgcatcaacctatataattcatataccataaattctacactgtacactaaaatgtgtaacttggggtttttagtatattcaaaagttgtgccactatcactactatcttattccagcacatttttgtcaccccagcaagaaactctgtacccattagcagtcattccccattctggttttccccagcccctgcaactctaatctactttctgtctctggatttgactaggttagaactttctgtctctggatttgactaggttagaactttctgtctctggatttgactaggttagaactttctgtctttggatttgactgggttagaactcaggtctgtcagaatccaaaccccattgcccctcagtttaggtccccataactttttgtttatgtagctgctggagcatttatggctcgcagtatgtgttgaactgtcagtagttgggtgtggggttctctctcaccacagatttttatggtttttttaataaggtaaaattaaatgagtgtttgtaataataataaaaataaagatattctctattcctttgtgtaacattttagacatttatattttttcttttaatggatgaccatgggatttttagatatctttgcattcttagtgccttgtgcttggtgagtgacagtagtcttaattgaactaaattgtaattacattcattactcttaacgaaaccagctcccattaggatgaacagtttttctaaaataaaacaagtttgtttttttatatatacatataaaaagcaataacaaaaacaaacaaatgaaaataatccaccatcaatgcttctatttattttgagtgccaattttgttagcatgaatgggaaacaactgacttttgagaaatgccattggatctggaaagcctgatgagggctacaagctacattcagtaaaatcagaatcggtgtgtgtgtgtgtgtgtgtgtgtgtgtgtgtgtgtgtgtctgtgtgtgattttagccttgtatgaccaactaaataaaatgtaaatctgaaagaatcatttcaagtttctggtaacaatggagaaataacatggaattgagagttaagaagcttaggtttgggttttggctctgcctctgatgagcagtaactcagcctaattttatctcatagtccctctggaggagaatgggtcaggagattcttaacctattgttgcaaaattttattttggaacatttctgaggaaagggtctgtggctttcattagattctcagatcgttcatggcaacaaaaagaaccacttgatcagatgatttatcagtctcattgaggtttaagattttgtgatgcttcattataaccctggtttgaccagcttatatacccagggttacaccgtgagtttacactcaacattgtctttgaagactcagaatgacttttagcacatttaaactattttggatatcccatagacgcgtcaacttttctaaaaacagaacagtcatccttcagttagtgcttttttctgactctgaagctggtgctataatccactctgtcatactgtctttcttcagtacttcttgaatccttctccttttcttccatctcaacaaaccttgattcaggctctcatgatctttcatcaaacttgttaggagagcttcctattagtctatttctatttcctgtatccgttctctctcacacacacattaacacatattttactatggtacttccatatttaacatcgtctaatggcaggcttggtggggtggcttatgcctgtaatcccagcactttgggaggttgaggcgggcgatcactttaggtcaggaatttgagaccactgtggcctgtccaacatggtgaaatcccgtctctactaaaaatacaaaaattagctggatgtggtggtgcgcctgtagtcccagctactcaggaggctgaggcaggagaattgcttgagcctgggaggcggaggttgcagtgagctgagatcatgccactgcactccagcctgtcaatagagtgagactctgtctaaaaaaaaaaaattagctgggtgtggtggtgcacgcttgtagttccagctacttgggaggctgaggcaggagaatcacttgaacccaggaggcggaggttgcagtgagccaagatcgtgccactgcactccagcctgggcaacagagtgagagtgagactctgtctcaaataaataaataaataaataaaataaataaataaataaaattttctaatggcttcctgttttacagagaataaggtataaattcttgaccattgcaaaagcaggctttccctaatctacccttgcctggtctcaacccagtctcaacctccattgttttctgtcatcctatattttatactccagctatagtgaactttgtgctgcttgccattcgggtgcacatgctttttctagatgcttatccagttgatcatgccctctcctcctttcgtcacctaacttagtcctacttatcctttaaagcttagctcagattgtatatcaaaggccttttctctgactctgctctgcttattctctgcatatattactatataattgcttgcttttgcctgatttttaaaatagactgtgtactctttgagggtagaagccacatcttatttttttgcaaccttggctcttatcttggtgcctaaaatattatatgttcagtgaacatttatgatgaattcagtaattatttaattattgcatggggttttttgaattagtgaataggtttttaaatattgcttgtagttttggtaaaactttaattatcatcttcctcaaaggagaaaaaagaaaaatatttagttgtttaattatggggaaaaaacctttttttgatcttgtaattctcataggcctccaatgagaattttattttattgctttaatgttttcatagaacctagtaacccaggaaagcattttataattttttttttagaacttttttgaaactgatttcctgttggggtttagtatagggtattattacttaagagaataaggtgtaagtctggagactgtatcaaagagaaagaagatgaatgaatcaggtatagacacagaatgaggtaacagggtttttgagtctcttgtttggctcatgatcttttcaacaccattgaaacacacacaacctcatttttttttcagagcacatataaatgaagaatgacctggaggttaggtgggaatgggtaggactgcctctctctggactcagattcctgggagctgacccagaactgaatgcccttagggatttcaaactcattaccatttgtagtgatgcacttcactctgatctcctttcagtgttacctttgttagagactacactagaaaggaaaatacttggaataaactttagcgttttcaaagttttgtactgccacatgggatgactattaattccttttggctggcacacaataatttagcaaattattattttgtaagccgggcgtggtggctcatgcctgtaaccccagcactgtgggaggctgagacgggtggatcacctgaggtcaggagttagaaaccagcctggccaacatgacgaaacctcatctctactaaaaatacaaaaattagccaggcatggtggcgggagcctgtaattccagctacttgggaggctgaggcaggagaatcacttgaacttgggagccggaggttgctgagatgagctgagatcgcgcctttgcattccagcctgggcaacaagagtgaaactccgtctcaaaaaaaaaaaaagaaaaaattattttgtaattaagttacagttagcatatctacatctgaagtatcttagtaccttggatatgtaagtaagcattttgtattccttcttgggtatatctagattctgttgatttctttacccttcaccagatgactcgttcacatcttttattatgaggaaagtagtttctggcctttggacttatcaaaatcagtctttcttttgttcatttatttgttcaactcatattttttggtgcaacattctgggcaacagggatgaaacaatgaacaaaacaagcacaatcctttgctccaatggagtttacattctagtgggggtagacaaacaataaaccaaatcaagtaaaaaccatatagtatgtcattaaagagtagttaagtgctacagagaaaaataaagcaggagaatgaagtgcagctgggcctccaattttaggtagggtgaccaaggaaagcctcactggaggtggtatttgagtaaaaacccaaaggaagcaggcctcgtggcatctgggaggtaggtagtcttccaggcagaagaaaccacaaatcctaaggtcctggcaaatagcatgcttaccatgtttaataaacaacgaggagacccaggtggctggaacaggacaggcaattgcaaggactttgccctttattctgaatggcaggaaatgtctttggagggtttctggtcagtggatgatctaactgtacttttagtaggatcatgctacctcctttactgataactaacttcagttttcagttcagaagcaggttataaagatagattcatatgagaacctttttttttttttttttttttttgagacggagtctcactctgtcgcccaggctggagtgcagtggcatgatctctactcactgcaagctctgcctccagggttcaagcgattctcctgcctcagcctcctgagtagctgggactacaggtgcccgccaccacacccggctaagtttttgtatttttagtagagacggggtttcaccatgttaaccaggatggtctcgatttcctgacctcgtgatccacccgccttggcctcccaaagtgctgggattacaggcgtgagccaccacgctcgggcccttttatgatttcagttcttcaggaaaatgtgtttggttccaggtacctcatttaaaagaaagttactgatactttggaatctgtttgggagaggatgtctagaatggtgaggaactggtaaactatttaatgtgaggaacagtttaaggatctggggatatttaacctttggtaattttgcttctgacccatgttaacactattctgtttttctctcaagctgtagtatgaattcgaccttcctttctttctcccccttcattttcagcagttttctattttttaatttttaattttcatttcttgagacaaggttttactctgtttccgaggctggagtgcagtggcatgatcacagctgactgcaacctccacctcctgggcttaaatgatcctcccacctcagccttctaagtagatgggattacaggtgtgagccactgaacccagccttttttttcttttaagctccattctttaatgggccttgtcttttttttttttttttttgagtcttcctctgtcgcccaggctggagtgcagtggtgtgatctcagctcactgcaacctctgccttccccggttcaagtgattttcattcctcaacctcctgaatagctgggattacaggcatgcaccgccacgcctggcaaatttttgtatttttagtagagacaggtttttaccatgttggccagactattggccattatttttgtagatattcctttgcaaggctgtttttaaaacttcgtttttggccaggcacggtggctcacgcctgtaatcccagcactttggnnnnnnnnnnnnnnnnnnnnnnnnnnnnnnnnnnnnnnnnnnnnnnnnnnnnnnnnnnnnnnnnnnnnnnnnnnnnnntagagcaagactccatctcaaaacaaacaaacaaacaaacaaacaaaactctgtttttgtacatatgtccttataatatccccactcttcatgactgtctttaatcatttcctcatgtttttctaaaaatttatgattgtatagagaaaattccactgccatatttcctcatgtttttctaaaaatttatgattgtatagagaatattccactgccatattcccagggcttagaaaagaacctgacacttaatataaaactgtgaaatgtattaggttgatgcaaaagtaattgcagtttttgccgttactttcaatggcaaaaactgcaattataaaactaaatgaggccgggcgcagtggctcacacctataatcccagcgctttgggaggccgagacgggtggatcacctgacgccagaagttcgagaccagcctggccaacatggtgagacccccgtctctactaaaaatacaaaatttagctgtgcatggtggtgcgcacctgtaatgccagctacttaggaggctgagacgtgacaatcacttgaacctgggaggcagaagttacagtgagctgagatcgcaccactggactccagcctgggggataaagtgatactctgcctccaaaaccccccaccccccaaaaaaaaaacacaaactaaatgaacttcgctttctagaattgccttatcctaacaagttctatattcttatagaatactttggacatgcaatcatgccgtactttttttttttttttttttaagaacagagtcttgccctgtcacccaagctgcggtgcagtggcacagtctcagctcactgcaacctccacctcctcggttcaagtgattcttgtgcctcagtctctccagtagctgggattacaggcacccaccaccatgcctggttaatttttgtatttttaatagagacagggtctcaccatgttgaccaggctagtctcgaactcctgacctcaagtgatccacctgccttggcctcccaaagcgttgggattacaggcatgagccaccacgcccagcccatgtcttacttttctttaaatgtttttagaatttatttgtagtaagcttacgtgtttgactgtgacctcttttctcagcataaaaactgtgtgaaattagccgggcgcagtggctcacgcctgtaatcccagcactttaggaggccgaggcgggtggatcacgaggtcaggagatcgtgaccatcctggctaacacggtgaaaccccgtctgtactaaaaatacaaaaaattggccggtcgcagtggctcaagcctgtaatcccagcactttggtaggctgaggcgggcggatcacgaggtcacaagattgagaccatcctggctaacacggtgaaactccgtctctactaaaaaaatacaaaaaattagccgggcgtggcggtgggcacctgtagtcccagctactcgggaggctgaggcaggagaatggcgtgaacctgggaggcagagcttgcagtgagccaagatcgtgccgctgtactccagcctgggcgacagagcgagactctgtctcaaaaaacaaacaaacaaacaaaaaacaaaactgtgtgaaattattattctctgctaaagtttctgatatgttcacatcaccaaaaaattattgtttactgctcagaattcagtcccatagtagaggcttttctgggagagaaaactgtcatcaagcttagtcaataattttattgaatactttcagcaaatagcggattatttgaaatattcaaactggtactaaatcttgtctctgtgccagtattatattttctggtggcctgtagtatatttttcatacttaacaatggtaagagacaactgctgcatctattccaatttccagagtatctgctaaaacaatccatgatccagttcatgtttgtgattcccacttgtattcttactagatgatatttgatagttaatttactgtagttttctggttaaagtgaaatttactaaaatagtcttatggtatttgagtttcaaaattttaaagtaaatattgttagattgagttggctctaagaaactaaaaataagagagtaagaaaagttccatactcttaactaaaacccctttgtagctagaaatcttcaggctttgtttatatttaccttgaaatttttaaggctagtaagcattttatgtgtggttctccttcctttcagttacattttcaggctaaattattccattgttttatgttttccgggagagtttatatggatacaacaccttatataaataatggcattaaagacttttaatctcaacttggaaagaaagagaatagtcatggtgtgattgatctgaaggtcacttaccttatagcctcaactagacacaatataatggaaactttaggcttatgtggtacttgaagagctagaagtgatttcataaaatccatgcattgaagttgtccagtaatgtgaagcattagtcttactcttccttagcatttactctctttttttggagatggagtcttgctctgtcgcccaggctgagtgcaaaggtgcgatctcggctcactgcagcctccacctcccaggttcagacgattctcctgtctcagcctcctgagtagctgggattacaggcgcgtgccactacgcccagctaatttttgtattttcagtagagagagggtttcaccatgttggccaggttggtcttgaactcttgacctcatgtgatctgcctgccttggcctcccaaagtgctggaattacaggcatgagccaccacacccggccgcatttaatcttttttttttctttctttctttctttttttttttttttttttttttgggacagtgtccctctgtcgcccaggctggagtgcagtggcgcgatcttggctcactgcaacctctgcctcccaggttcaagtgattcttctgcctcagcctcccaagtagctgggattacaagcgcctgccaccatgcctggctaatttttgtatttttagtagagactgggtttcaccatgttgaccaggctcatcttgaactcctgacctcaagtgatccacctggcttcggcttctcaaagtgctgggattacaggcatgagccaccgcgcccggttgcatttactctttaaacaaaattttaacacacttggctatctggtttctgaatcaatgtagattagccaataacagattagaagaagagacattggaagatgcttgttggcaggccactttgacatcagcaagaaatgtgagttaactcttcaaatgagcaaataggaaacctaataaaggcagatacaaaaaataaaaaagcacagtattcagatatctttctgaaagagctaatcatcactatagacttcagtagcctatgaggacattagcactgcgtagtaattcaggttcataatgatgactaaatcaataacgactcaattatggtctatagatttaaaaaatgaaacaaggaagcatataatccatttcataaagatttccatctagaatggctaaaataatacactttgacacttttttttcttttgagacagggtctcattctgtcacccagtctggagtgcagcgatcacagctcactacagtctcgacctccgcgctcagctgatcctcccacctcaggctcaccaccccatacccacccctaccctgcccccgtagctgggactacaggtgcacgctaccatgcccagctaattttttgtatcctttgtagagataaggtttcaccatgttgtctagaccagactgatcttgaactcctaggctcaagtgatctgcctgcttaggcttcccaaagtgtgctaggattacaggcttgagccaccaaacccagcccactttgacacttaaaagaaataaaactcaattcggtggagatgaattttttttgtttcacattgtcctcattgatgctcagtaatcattgatccagtagtgtattttctgggagggcctgggcccaggtggtacacttttagactatatccagacatcttttaagtatatgcctgaattctctagagaagtaaagaatgtgttttcatcttcttagaagaagatgagtaagagtttgtttatttaaaaatatctttgaatgagttgattcagcggtattagtcaccatagaaatgacttaaattaaaaaccaagtttttgaaaacagcatgatcatgctcagtgacattcctgattcactcagtatggcaagcagtttttttttttttagacagagtcttgctctgttgcccaggctggagtgcagtagtgtgatcatgattcaccgcagcctccaactcctgggctcaggcagttctcccacctcacgttcctgtggagctgggactacaggctcatgaaactatgcttggctaatttttttttttttcctttagtagagacatggtctcactatgctgcccaggctggtttcaaactcctgggctcaagcaatcctcccaccttggactcccaaagggctgagattacaggtgtgagccactgcaaggcttcataaagagtaatttaacattcaaataatttcaagaggatagaggaagaattctgaagaaactcttttgtaaattttaaattaccattttcatccaaagaccacattggtgattatcctattctagaggtgctaattagtgtacttaaattgagttagaaaggaaagatactttcctgtggttttgggggattgatttttatcaggaaagaagctgttttctagcatagttttgaaaccttcatacttgaacatattttctttctgtctgaaagaatgtcactagtttctgtcctctgactagggaagtaaaagggcctattatcctttacttttgcttttacccccttattctcctaatccaaatggtgactcttgagtttataatatagcccttctctggtgtccttggggatattgggggtgggggagaaataatatagcctttaaaaaataatccattgtataactattctaatgtcccttttgtttatttttatttttcagagacagggtcttgctctgtcaaccaggctggagtgcagtggtgcagtcatagctcactggagcctcaaattcctgggctcaagcaattcttctgcctcagcctcccagatagctatgactacaggcatgcaccaccatgcccggctactttttttatttttagttttttagaaacaggatcttgctgtgttgcccaggctggtttggaactcctagtctcaagtgatactcctgttttggtctcccagagtgttggaattatagctgtgagccactgtgcccaaccccatttgttttctttcttccttcctatttgtaaaatcttagcattggtaaggacctgagaattcagttaatgtaaggacccacgtactagaagaatcctctctctggcatctacaacagatgggcattcagcttgagtgaatatttttgatgataatctcactcttcccaagcagctcatttaattattagcaatttcttccttttactttatttagatgaaaactatgtctttgtaatttctgtgggctaatgaattctgcccttaggagtcacatgaaattcagcagctcttgaaatttgttagagcagcaatcattttcctgctttgaattctctttttctaggctaaaggtcccaatatcattcagttatttgttttatgacgtggtttcaaattgcatcattatcttctagctctgacagattttttctctctaaaatagattgctcagaaccgaatgtaagatttaagatgcaatataaatactgagaactgaggggctgttactgtccacagtcttctggatagagaatcaaatccaggaggtcagagactaagtttgtctttcttactagagtagccccactacttagcataggaatgctctggtcactataagtctagaaatgcagataaagattgtaagctgttttagaatttcatttctgttggggcatgttctgtcaaggacttaagatcctttttagtgtgtgaactattgtcaaattgggtaacctccaagggtagaggttagtgaggtaggcaaaattcaaatcattctagtatgtaatttaagtgagaagtgaagaagactcatacaaacataaaagcagtagagaagctgaaaaatagactggttctaaatatattttggcggtagagtgtatacgatgaacagatggatttgattaggaagggaaatggagaaggctaagagaaggacagcacttaggattctgctttgagatactggatggtatgattgagccacttatgggaacaggaaaaacagaattaagaatttaattttggacatgttttattgagatacttgcaagatattaatctctcttctctatttcagtttttcagttttgtttttgttttttttttttgagatggagtcttgctctgtcgcccaggctggagtgccgtggcgtgatcttggctcactgcaacctccgcctcccgggttcaagagattctcctgcctcagcctccaaagtagctgggattacaggcatgcgccaccacccctggctaattttgtatttttagtagagatggggtttctccatgttggtcaggctggtctcaaactcctgacctcaggtgatcacctgcctcagcctcccaaagtgctgggattacaggcatgagccaccgtgcctggccaatttttttttgtatttttagtagagatggggttttaccatgttggtcaggctggtctcaaactcctgacctcaggtaatccacccacctcaggctcccaaagtgctggaattacaggcgtgagttaccgtgcccggccttattttggttctattaccatttaccaaagtgggctaaaggaggtatattataaaaatgcctttaggatctgatatgcaactgcctggattaataagaagtgtgctagtgagaatatgctagagaaactaagggcagcaggagttcttaaaccttggttgcaaggcttttcaagtttctctgctcagtattgatttcagcttccctagggattcccattgtgaatattcactgataacctgaatttacccagtcatttgttgaatttccctctgtctctagcctcttctgcctccactttatctacttccttacttaaaagctttcagtggctctcaggaatcaagtcccaacaatttagcatgatattcaagtcatttcataatgtgtctttgcctgtctcttcctgtctcattctacacgtacactctggaaagagtaaaagaagaaatatgtggccaggcgcggtggctcacgcctgtaatcccagcactttgggaggccgagatgggtggatcacgaggtcaggagctcgagaacatcctggctaacacggtgaaaccccgtctctaataaaaatacaaaaaattagccgggcatggtggcgggctgaggcaggagaatggcgtgaacccgggaggcggagcttgcagtgagctgagatcccgccactgcactccagcctgggtgacagagtgagactccatctcaaaaaaaaaaaaaaaaaaaaaaagaaagaaagaaagaaatatgtacatgggcggggaacttgaaactggtagaaatagaggtggtcttagccagattgaatagtctgtgcataacttctcaacagataggggtttagttaacagagaagcatctctgaggtagaagcatctgaagtactgtgttttacagagacagatactagcctgataatttacaacagaattatcaccatgtttaatggtttcattaatgcatgactccatgatctgaagcaaattttttaaccacccagagtttattttctgggaaatgagaatgtctaccttgtagagtggtttaaggcatgtagaataatgtgtggcatttaggtattcaatacatgctagctgctattattattgttactgttggaatctaatttttttatttttgagagatagggtttcactttgtcacccatgctggagtgtaatggcaggatcatgactcactgtagccttgacctctgaggctcaagtgatcctcctacctcagactcccaagtagctgggattacaggggcatgtcaccatacttggctaattttttattttttgcagagacgaggcctttctatgttgcctaggatggactcaaactcctgggctcaagctatcctcctgccttggcctcccaaagtgctgggattacaggtgtaagccaccgtgcctggccatggaattttaaacggtagctcttttctaaccgtatctccccctgctgccctgttgtagccctattcagctagtctggaattcttactagtttctttggatttacaatgttcttaataatactggttctgcgtggaattccctttgcccattgcacttcaagtctctttctattgacatctatactcctccctcaaagcattatttatttattttttgagatggagtcttactcttttgcccaggttggagtgcagtggtgggatcttggctcagtgcaacctctgcctcctgggttcaagccattctcctgcctcagcctcccaagtagctaggattataagtgtgcaccaccatgtgcagctaattgttgtatttttagtacagacagagtttcaccatgttggccaagctggtcacaaattcctgacctcagttgatctgcctgccttggcctcccaaagtgctgggattacaggtgtgagccactgtgcccagcggttttttattttttttcttctcagtgagctaatttgaagagtaatacctagaattaaatcatcaaacttcatccctaaatggtgattataaaggaaattttattaatgctgccaaactgcaatgtttttgtgaagttttcaactcaagaagcattaatggagcactgactcaatgttacagagatgtaaaaaaaaatgaaagataaccattcagtcttttcagtctgttcagtatgtttttctttttttttttttttttaaaggtttgatttgtctgaaattaacagatgcacacttttaaaacaagtatatctttgataccagatggggtgtaattcatagggttttgaggattaggattgagatggaacggtaactcgtcactttttcttcagtgttgtgtagattctttgtttgtttgtttgtttaaatcaaaagacctctttctgacattaagtaaatggatacctccttttggattttatatccagaatgaaaatagtgtcatttacataggaagagcttgtttgtagagcatttatcctgtttttgctgcttgacttctttatatcttttcctctgtacccgtcctatcatttgtaacacgaggaacatgactgcatggcatttgtctggaagaacatgactgcgtggcatttgtctagagaagtatatttgagcttttagtaagtgatccatagggtttttttttctttttgctatttatttatttgtttaattcatattaacctcagagctaactgaaagtatcagcgagctttatcagtttcattttatattctctttttttttttaagaacatagatgcaaactctccttaatcattcatttttatgttttttcttgtatagactgagttgtagcatctttgctggatactgcattgtttgaattcctgattgttttctagcatttaatgtatggtattaactgaagttggtttcagtagaattcttttgcctttctacctctgtgcctgttccttaattatgttttcatttattcttatgttcggcttgttttttacatatgtcccattatgtggcaaaatgtctcaattctgtactcatagatgttatcctctaactcttcatatgtcttaattgggtttggatcataatcccaaaagacacaatcctaaacaccataatccgaaatgttaaaatcctgaaagatcaaaatccctgaatcctaaatccctgaagtctaaaatccctaatgtctacaatccccaaaatcacaatcacagggtagttgcttcatgttaggcagaactattactttgttgtgtttatttggaaattaaatatggtttaaggagatgcatatagatgccaagtggacaaggggtagacttatagacttaattttggagatgtcagtttgactggattaaggaatacctagaaacctggtaaaatattctttggggtatgtctgtgaggatgtttccagaggagattagtgtgtaagtcttgtggattaggtggggaagatctgccctcatttttggtgggtatcattaaattggctggggggcccggaaagaacaaatagagaagacacgtgtctctgacagctgggacagacttcttctgctgtgttgggcatcagaactataggcttctcagcctttggactcaaggacttataccagtagcccctccaggtcttgaggatgagagttataccatcaacttttctggttctgaggcctttagtcttggactgagctatgccactggcatcctagagtctccagcttgcacacagcctgttgtgggacttctcagccaccacaatcatgtgagccaattcccctagtaaatcctctgtcatgtatctatatacatatcctattggttctgtcactctggagaaccctgactaatacagatttgatattagagaagctgaatgtcattccttttacttgcaacacaatgaaatatctgtgaaattgtttcctcacagaaaggctgtgataagttaagtgtatgaggctacttagtggtgaaagataaaagtttaaaagctaattattattgctgctgtgaaagcagagtattgcttaactgcaatggccaagcaataccaaaactttccaatggaccacatatacttacaaaatttgtagaccacaaccactctccaaatacaagtgcggtgagtgttttgaagaccatacaagaattgaaaatgcatgcgaaaaatacaagagatctcccctgccaaattatattcaattgtgtacgactactgccccttcacacatgccccttcatacttgcctttaaaaaacacccttcattacagaataaaaagaatttgacaagctcggtgaccttctgaaccaaatacacttgtcgatattgaggttcctccactgttgcaaaacatgttaaatggtgaactattcttgattagggatttgactgtcaaagaggatagacttcttatatttaccactaaatctaatatagcaaaactagcacatgcttcactttggctaatggatggtacttttgaaactgtcctcacttttttttttttaatcacttgtatacaattcatgcccccattgaatctgaaaattctagaactaatctactagtttatgtattagtgactggaaaaagtgaaacaccttataaatgtttatttgaagatttggcagacttggcagaagaaaatggattttgattgaatccccgaaccataatgacagatttggaatgaggtgcaatcaaggcttctaaaagtgaatttcaaaatgttatgaataaactttgttccattcaaccccaatgcatttggcagaaaattcagatgaatggattggccacacaatacagcaaggatgaaagtttcagtttaaaagtgcattgtggcaggttcacattatcccagcactttggtaggccaagacgggaagatcacttgagcctaggagttcgagaccagcctggcaaaacatggtgaaaccccatctgtccccaaaatacaaaaacaaattagccagacttggtggtgcgtgcttgtagtttcagctacttaggaggctgaggtagaaggatggtttgagccggggagatggaggttgcagtgagctgagattatgccattgcactccagcctgggccacagagccagaacctgtctcaaaaaaataaaataataaaatacatttaaaaaatttaaaaagcacattatgatgtcactaggggagggttgagaaaaaaaataaagtgcattataggtatggtggctcacttctgtaatcccagcactttgggaggctgaggcaggaggatcatttgagcccaggagtttgaaaccagcctgggcaacatggtgaaactccatctttaaaaaaaaattttttttttttaattagctgggcatggttgtgtgtacctgtagttccagctacttgggaggctgaggtgggagaattgcctgagcccaggaagttgaggttgaagtgagccgagattgtgccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgcaatctcggctcactgcaacctcgactgcctggcctcccgagtagcggggattacagacgtccgccaccaggcccagctagtttttgtatttttagtagagacagggttttaccactttggccaggctggcctcgaactcctgacctcaggtgatctgcccatctcagcctcccaaagtgcttggattacaggcgtgagccaccgtgcctgtcctccaggagcttttaataaattaaaactgcatctgtctgaagaaaccagtgaagttaccgactggttcaaaaataattacgtgcacagtaggataagaagacacacaatggtgtttctgtttgatcaccagtattgtttccaccaaatttatggtctgcatatgagtacttgtgaaacaaatttctgcatgcctaaaacaacatatatgcataacacaaaagatgggaaaatttaacaggaaatgctcatgtccatgtatgtcgaatcatagaagaatttcaaaaagagcagcaccatgtataaaatgaatgtgaatgtattctctgaggagagccatgctctaaaaggaaaaaagcagctattcgtggtgatgtaagacttcaaaatataaatgattgtgaaagtctgcctgctcttatggaccgcctctgcacaattgcccagaatctattgctgtaatatactttttcatatgttgagttttctttttagtttttaaaagttttttccccacttgttcaaattgccagcattattttttacaatatgctgtgctctgtatttcatcttcacatcatttccattactggaggtataaattgtgtcaagacttttagagagttcgaatgtgttttatgcatttttcgcatatttgcaaatttgactccacaaggtccattttcacaacattgacttcgtgtgtaagcattgtgcatgtatgtaaaatgctctttgggcaactgtaatatgtggtggcagcccatcatggtttttttttctttttaatttttatttttattatttttattttttattttctttaaattttattattattatactttaagttttagggtacatgtgcacaatgtgcaggtttgttacatatgtatacgtgtgccatgttggtgtgctgcacccattaactcgtcatttagcattaggtatatctcctaatgctatccctccccccttccccaccccacgacagtccccggtgtgtgatgttccccttcctgtgtccatgtgttctcgttgttcaattcccacctatgagtgagaacatgcggtgtttggatttttgtccttgcgatagtttgctgagaatgatggtttccagcttcatccatgtccctacaaaggacatgaactcatcattttttatggctgcttctttttaatttttaatgaccaaaacaaagcatctaaaaccacagcttctggaagaactacttgttcttgcctgtcttttatctcttttcaaacttgaccttggcctctcgtcgggctttgggcattaggtgattgtagttacaaactttcgcaaaagacttgatctttgaccccttggtgatcttcttcttgcccatggcagctgtcactttgcaggggtagtggtcaattccagacaccagagcatggctgtaggggcaatctgaggtgctatcatcaatgttcttcacgatgacggctttgcatccagagtagcgtccagccaggacaagcaccaccttcccaggtttcatgaacttgcccatttcggcagcaaccactcgggcctacagcaaaaagcccatcatggtttttgattgatcttaagacttaggttgtttgtcgtggtatttcagatgactgcagttatataagctatttttttatgaatacaccttgtctgctcataacttatacctgtatgactgtcattagtatacccaagtgtttatgcttgcaaaatatgtatgttgtttttgcctattttatcatgtaaagtagcctatgaagtgttctgttatgtttttatgtttctcaaataaatcccccttaaaaatgtaaatacatatctttaaatttttttttaaattcctttttccagaattatatttttgggattttggtcttttgggatttcaacactcaggattatgccattgaggactatatctttcaggattatgattggctcctgtcctaatcattacttcctaaatgtggcacagagatattatcaatggagatacccagaacactgaatctgggcacttgtcacagctgggtaggaaacttggatttgccatactctatgtttaaagattacaaagtctgattaagtgccaaaaagagtttttaaaaatgttaatggttcacttttcacatttaatgtgttgcatcatttgtttcattcattaattaacaaggatttatttgttgagcacttattgtgtcaagtatttcccgctcttcatattccacttgctaaaagcagctttttatagtctttgtttctaggcattttgcagtacgttctcaaagtgattgtaatggtggttttctgtgcttcctactcaaaatgtgctcagtgggccagcagcattggcaacatcttattagaattgtagaatctcaggcccctttccagacctattgaatcagaccccttatagtgaagcaggatatttgcctgacctcttcatgggaattgtgacaggcgtaccttgtttactgagcctgccactctcaactccttgtgggaaggagcgtgcgagtgaacgaggtgggaactggagtgcacaagcgctggaacgagctgactgccttggtgcttgcagtactcaaggccacgcgggcctcacagcagtatccagggggcagtatctgcatccctccaagccccagagggcatgttacagtgctcttttagcttcgacatgccatccacgaacagcttaagtgttagcagctcagtgggccctttgcctttttgagtgaggtgctgccctctgccagtgagggcagagggccagtgtgacagccttttgtatctgcacacatggctcccgtgctcttgtccggtgtccaggaaaaatgaggtcacaggaatgaattgaagaatggtaaatacaggggattttattgctgatgaaagtggctctcagcgggaaggggagctgaaaaggggccgggggtgggtagattatcttcctctgaagtacagccatctccagccgaattcttctctgaagttacaccatcaagctatccctctgaagtcaagctgcttctctccaacatccagctgtttctcctccctcccagctgagtctggggtttttataggcacaggatggggtgaggtggggccatgggtggtttaggaaaaggcaacattccagtgggaaaacagggatataaagtctcactttgggctgcagtctcatgcttttctgtttgagggtagggtttcgtcagagacccgtccttttctgcctagaatttctctgcccctttgtctgtatcaatagtggttttaaacaaaatttattttgaatttttctttcattatactggttaaagttgaaacaagaatgtaaactccatgatgacatagaccttgactgttttgtttactgttgtatttctagcacgtagcatcagtcctgtgctaggtgcctgataagaatttgttgaatgaatcaattagtatcatgcatttgaagtaaatttacttgaataaatttagagaatgcctttgcagtttgtatttatcagatatattcagtgaaatcaattcatttttttaaaaaacttaggtttttttttttttttgagacaaggtgttgctctgtcacctaggctggcatgcagtggcatgatcatggctcactgtagcgtcagcctcctggattcaagtgattcttctgcctcagcttcccaagtagctggaactataggcacatgccacccatacctggctaatttttaaattttttataaatacgatgttttgctatgttgcccaagctggtcttgaactcctgagctcaagtgatcctcctgcctcgacctcccaaattgctgggattacaggcgtgagccaccatgcccagcccccaaaaactttttttttgtttttgagatggagtctcgctctgttgcccaggctggagtacaatggcatgatctcagctcaccacaacctccgcctcccagtttcaagtgattctcctgccttagcttcctgagtagctggattacaagcgcctgccaccatgcccggctaatttttgtatttttagtagagacggggcttcaccatgctgaccaggctggtctcaaactcctgacctcaggtgatctgcccgcctcggcctcccaaagtgctgggattacagccgtgagccactgtgcctggcctaaaacttttattaatacctattatgtgtcaggtactgttctaggcattgggtatacaatgataaaaaaaaaatatgtcaaggttcatgtccttatagaacttttagctggagagagggaagaaagacattttagctggagagagggaagaaagacaataaactggtaaacaaatatgttaacaaaataattacagataataagtgcagtagtcctgtaagggtatctgggggcatgaaggccaatacttcagctaggttatgtagggaggcctcctaaggcataagacagtaatgatatgaaggagaccagccttcaaataggcaggagaagagcagtgtaagtagagagagcagcaagtgtgaagggcctgaagagggaatgagctaaatatagtttgttcattcattcagattgttaacatccagataaagttacttcatttaggcttgtctggtgcagtggtgcttacagctaattgatcacaaccagttatagatgtctttgtttcttctcgactcccactgcttcacctcactagccttaaaaatttttttttttattttaaaatttttttttattatactctaagttttagggtacctgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatattttttaattactttatttaatacagagaagatgagaagacaatgtaaatgctgctttgtgagtgatgggaagaagtacttttagtgatagcagtgaatcaaagcataaggtcatcaatagtcgacttcattgcccagtgttttcaaagtccccacgtgtgttggttattctttagtaaagtagacgtgacaatgctcgttggctgttattgtgaagcttgactgataatactgggattttgagatcaagaggctagaagccaagatgtttgaaatatgtaaggtcagctgcctgctctttcctcctcccctacgagtgaatcaacacttgctttataagtttttcttctctatctcctttctctattgttagtttcacttcctactcttaaaaattctgagctttcaaaatcatgtttatcaggagaaaaaagagactgaaagagcttaaaatgggatacctctggccgggtgcggtagttcacgcctgtaatcccagctcttagggaggcagaggcgggaggatagcttgagcccaggagttcgagacctgcctgggcaatatagcaagaccccattctccacaaaaaggaaaaaaaaaagggatacctctgaaagaggttgtaatttggaattgtaacatgaaaacctaaggaaattttttgcagtatttcaactgtatatttgtcgttgctgttatccagtcttacaacaaactatcagaattttacttttgcaattttaatagagaagtctctgcatcctaagaaatgtaaagaaaaagaacaataaagactgggggaacttttaaatttcatcgtctcttggtgtgtggagaattttgcagggaataattcctgcaaatcctacaccttcagattgataccctcaaaggacactaaaccacagtccttttttaaggaaggataaaactgtatttactgtatacagttctaggcattggatttaatatgtgatgtatttcactaaggtggcctcagtgggtactattttaagctactctctctgtgtgcatatctttagtgactcaaggcattaatattttattcaggatgtgtagataagatatttttgtaatttaatggaaagtctcatgtttaatgggtttgaattctgtttgttggcaattaaatacctaagtatattaattttttagggtttagggttttgccaacagtaatgtgttttgcttataagagccccccttttctatcttctttttaatagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacaggtaaggatgtgtggatatgggaggtgggcaaaggaaggcaggttatacactttatttttcatttaagagtatttgggctgggcgcggtggctcatgcctgtaattccaccactttgggaggccgaggcaggcggatcaactgaggtcaggagttcgagaccagcctggccaacatggccaaaccctgtctctactaaaagtacaaaaattagccgggcctgatggcgggtgcctgtaatcccagctactcaggaggctgagacaggagaagttgaactcgggaggcggaggctgcagtgagctgagatcgtgccactgcattccagcctaggcaacaaggatgagattccgtctcaacaacggggggataaaaaaagtacttggttttatttcttactagctagttgacttaggcattgatagtgataagtagcatcataaagctttataggttctactctattttttttttgagactgagtcttgctctgtcacccaagctggagtgcagtggtgtgatctcagcccactgcaacctccccgtcctgggttcaagctattcttctgcctcagcctcccgagtagctgggattacaggcgctggccaccatgcccaggtaatttttgtatttttagtagagacagcgttttgctgtgttggccaggctggtcacaaactcttgacctcaggtaatctgtccacctcagcctcccaaagtgctgggactacagacgtgagccaccatgcccggcttatagtttctactctaaaaaaattaatgtagtcattggaaacttactttttaaacagttacttacactttatatgtattaaagggtcttgctattttgcccaggctaatctcaaactcctgggctcaagtgatcctcccacctcagcctcctgagcagctggcattacaggtgtgtaccaccatgcctgtccatttactgtttataaatcaaagaatagtagagaaaaaaaaagtatcaaatcaatgtgttcagcccatatatcattttattataataatggaacaaattgaagatttctcatgagagaggaaaagaaagatgagatggtttagagttcatttttgtggaattattaggaacaggacggttatcagcagatgtggttcttttacgtaaatcttcctaaaagctgtgtgatgaattcaagccctttgaaggtatgtgatagattcaagtcatgtctaccttattttgatcatcttctttaactagagcatattgccacagagtgtaagatacagatgaggaagtctagctctttctatcacctgtgtaatgtatattagtctggggccttaattgtgacatagtgttgttaaactaaacacgagttgtgagtttatttgtcccaaaaaatgggaaaacattagtactgtaactcagactattttctgagaatgtcatttattttcagcctcaccattacaattaagaattattttcagagtcttcttatttctgaagcatgtgaatattatctgcatcgttaaaagtgtaagtccttctagaactctgacagtgttggggggaaaaaagtaaaagtcctacatgtttctattataggtctgagatttggactccatagttttattagagtcttattagaatattacatgtatttctagaactattacttgtatattcaaagtgctgagggtaaaatttaggataaaattataattgcacacttgctgttagtgaaacaaggttgaaaacaagatttactatgttctgtaatagttaagatgcaagctatagaatccgactagagggttcaaatcgaagaaaactgacacttttcactttatcagtttcctcctctgtacaatggggataataatatccacctcatttgggattgaaaggattaaaagagtgaaaccggtaaaagctcttaaaacattgcctggcatttaataaatactcaatgaatgttagctagtaaataaacacaaacagtaaaggcaaagaaaccattcatatcttaataacattttattttaggaataccaaaagaattaaattacattatcggccgggcgcagtggctcacacctgtaatcctagcactctaggaggctgaggcaggcgaatcacaaggtcaggagtttgagaccatcctggccaacatggtgaaaccctgtctctacaaaaaatacaaaaaattagctgggcgtggtggcgggcacctgtagtcccagctactcggaaggcgaggcaggaaaatttgctgagagccgagatcacgccactgcactccagcctgggtgacagtgcgagattccatctcaaaaaaaaaaaaaaaaaattacattatctttcaggaagcctggtactttcaagagtttttcaaatttccttccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgatcatggctcactacagcctcaacctcccgggctcaagctatcctcccatctcagtctcctgagtagttgggactacaggtgcatgccacatgcccagctaatttttaaattttttggtagagacggtcttgctttgttgcctaggctggtcttgaactcctgaactcgagcaatccttctgcctcagccttccaagaatgctgggattacaggcatgaccactgtgcctggcctcaaaggggtttttaactgcttttttctccttcagctttatataggggaaaatccatatcttgttttagttaacatttgaatcagaacttgtctgcattgtctaaagttcatagattcgtactcaagttgacacagatgatggacagttaattttagatttaactaaaatctcattcattaagatttaattccgaattgaaataaattgtccgtaggttatttgtcttcatgtggagaaaaagaaacgatattgttagtaaaatttcaaggagatattatttaaaagaacaaactattttaggccttttggaaactaatatttatagtcaaaaccttgtggatcagagtcgtctggataaaggtttatttgcctaaccatgtttctgtatatgtaataggattttatttaaatggttcttttttatccagaattttttaaaaagcgtgtttgctttatattataaatatataaatatatatttatattacatttaagtgtataatatatataaatataggattgtaccagtcttcatccagagtagcttggattttttggaagcctatgtaaatttttaatgtttgtttattcattcaacaaatatttattgaaaacctaccatgtgtgccaggccctaggctggatataccttggtaaataaaaactgcaatatggtgaagaggtttaaaatcatggattttggggctgagtgtggtggctcatgcctgtaaatccagcactctgggagactgaggcaggaggatcactagagccccggagttcgagaccaacctgggcaacatggagaaacaccatctctacaaaaaagtaaaaaactagctaggcatggtggctctcctgtagtcccagctacttgggatgttgaggtgggaggatcacttgagtctgagaggtcgaggctgcattgagccatgattatgtcactgcactccagcctgggtgatagagtgagactcttgtctcaaaaaaaaaaaaaaaaagcaaaaaaaacaaatcgtggattctgaagccagactggtatgtgacttattaattgtatgatcctaggcaagttacttaatttctctggcctgttttacaaccctgcaggccaggtactattatcctccctctatcaagtggggatataataatactacgtgcctcgcagggtagttatgaggattgagttagttcacataagtaattttcttagaatagtgactggcccattgtaattgttgtataaatgtttggtattattattattataaaacagacatgatttctacccttgtggactttaatagagaagacaaaaaagtagcaaataaaaataattatttattgtaataagttataaagccaccagagtactgatatgaaagacagtagagcgggcatagatagataggatagccagtgaagagacttcctgaggttgcagtgagagggtcatgaaagatcggaaggagtcttttagattacttccagtatttaatgcaggagtcaaataattaatttctttttcctaattgtcaaccatgcattctttttttcttttaattgttttccagctgttacacaaggaagtaacatattcttttaaaagaaaataattagtcgggtttagataaaaatatgtcggtagttttgttgtgttgaaagtaaaagtaaaaatgtatgccggccaggcacggttgctcacgcctgtaatcccaacactttgggaggccgaggcgggcagatcatgaggtcaggagatcaaaaccatcctggctaacgtggtgaaaccccatctctactaaaagtacaaaaaaattagctgggcgtggtggcgggcgcctgtagtcccagctattcaggaggcccaggcaggagaatcgcttgaaccctggaggcggagcttggagtaagccgagatcgcgccactgcactccagcctgggctacagagtgagactccgtctcaaaaaaaaatgtataccaaaaatgttatcctacttatcggtattatttggggataatttaagattgcaccaggaaactcttccttcattgactcttctttgcatttaacatgattaatattgggtagaaaggtgttagctggtagttaaaatttttagcctactacatgtttgcttaatgatgtgaaattggtcccaagcatttctcttagaattaaaattaatttaaaatttagaatatgtaacaagtcacatcttattttgcagtttgtaaggctacattgctaaaattgaggagcatgggcagagacaataacgtttttgttaaactttaataataccgtgtaatggcttggtcaggaagaatatataatgctgagagcaatggattggtatcctccggtttacctgagaccttcatttattgatttgatgggattctacctgagaagttttaataacaaagtctttagggcatttgggggatcatactattttttatagaaaaatatttaatattaatgtcacctatatttgttttagttcatgcttttattggtaagattattataggtaaaagcatatacagcatgttttgtgaaatgtgtttattactgacttggcgatgtcatggatatgtagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggaggtgagtatgttttcatttccaacaatcagaactcttacaggtggtttcatctagagttgcgtaagtggtgattttgcccacgataagactcactgtagtgattatttcttttttctttttttttttttttttgagacagagttttgctctgtcacccaggctggagtgcagtggcatgatcttggctcactgtagcccccaactcccatgttcaagtgattctcctgtctcagcctcccgagtagctgggattacagccatgtgccaccatgccaggctaattttttgtatttttagtagagacagatttcaccatattggtcaggctggtcttgaagtccgggcctcaagtgatctgcccacctcggcctcccaaattgctgggattacaggcatgagccactgcgcccggcctttaatgattatttctgtagatggaagtattaatggtgattttctggaggtgggattatgggaagatgatgagtaagtctttaagtccagtaaatgccatttcttaaaattttctgttttctgaaagaataagtgattgaatcaggattgaagaaaaatatcagagttattcagttactctttttgctccttcaggacaagttgacaattttttttttgtttgtttgttttttgagacagagtctctctctgtcgtccaggctggagtgcagtggtacaatctcggctcactgcaagctctgcctcctgggttcacgccattctcctgcctcagcctccagagtagctgggactacaggcacccgccaccacgcctggctagttttttgtgttttaagtagagacggggtttcaccgtgttagccaggctggtctcgatcctcctgacctcgtgatctgcccgcctcggcctcccaaagtgctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcactttgggaggctgaggtggacagattacctgaggtcaagagtttgtgaccagcctggccaacacagcaaaacgctgtctctactaaaaatacaaaaattagctgggcatggtggccagcgcctgtaatcccagctactcgggaggctgaggcagaagaatagcttgaacccaggacggggaggttgcagtgagctgagatcacaccactgcactccagcctgggtgacagagtgagactccgtctcaaaacaaaaacaaaataaaaactagaattcagaatattttggagtttagcaagggaataagtacatattctgcatattttataataaacccagcagtgtctgtagcagcacccacatgatcagacatagtatttctatggtaaaagatatgaagattcattctgaggtggataaattaagattataaatagtctctttacagttcaagtcaaaatttgccatttggattttagaattatgaataagggattagggaaaatacatgaagcattttcaaatcatcttctgtcatttagaatgaaaacatgggagaaaaaaagaaaattatttgatatggatgagttaagactgacaatgaatgaacatttatgtgaattattaatagtcattaaaaataactcatctcattgagaggaggacatgtcatatatgtttgcccaaaaaatgattctaattttttgaagtattttcatatatatttctcagaagacattcacatatttgattattgttaaacaattccaataaagaggtaggatgagtgtaaatattcttatcatttcacagctgagcaaactaatgttcagaaaagttaattgaatctactcagcttgtttagctagtaaatggaggagccaggactttctgactaaatctcagtctttaagttagggtattttcttcctataaataggagtaaaagaacccaaatttgggaatggtttgactttctaggttaagaaacattaagaaaattattcctagcaccactgaaggagccacttcaacaggtagtgtctgttggctatctagaattttactttattcatttttctgaaagagattgtagggagttgaggcatacctcattttctttgggacatttggtctgaaaatgatagagtctaatgatttccacagccacaattaaatgtcactctggacagttgattcagtaatttaagtagtcacggtaactgacagttgctcatagcatgctacaggatatattgcaccaaaaatgaagaatgtgatgtgtaggatggagatggggaatatgagatggaaggaaggtagaattttgctttgaattgtaacacaatttctaaactagtatatgtgtattacatatgtaaactgacaaattgaagaacaggaattttataaatcatattttctgcttaaactatgtagccacctgaaagtttgttgatcaccaaagatgaaagaagaaatcggaaagtgacattttattttatttcatgatgggtgtagaaataagaagaaacctcaggccaggtgcagtggctcatacctgtaatcccagcacgttggaaggctgaggcgggggaatcacttgaggcgggggaatcacttgagcccgggagttcaaaaccagcccgggcaacataatgagactctctctacaaaaaattttaaaaattagtcaggcatggtggtgcacatctgtagtcctagctactctggaggctgaggtgggaagatcacttgagcccaggaggttgaggctgcagtgagctatgatcaggccactgtactccagcctgggcaacagagtgaatccccatctcttttggggaaaaaataaaagaagaagaaacctcaactcaactaagtcacgtatatctttgcagaaacatgctaagggacaagatttgcttaaacgagtatgtgagcatctcaatcttttggaagaagactattttggtctagccatttgggataacgcaacctctaaggtgaggagactgcttgcaatttaagaagctgacaaaaaatttattttaattcttttgttgttaagaatgtatctatacctgcttctctaagccagtgttcttagagttattcctgtctactcttatttcttagattttcctgctatttttcttctagaattaacattttaaaggaaagaccattgctggtgtattctttcatcattgaaataaagtatatattgtatgtttttacaaggcaaggaaaataaagaggtatgatgcactgattagcaagtactgtagatgtcaataacttaatatattatgcaattggtattgtatctaatgcataggtttataacaaatatttgttgaatggatgatctgttattaatattataatgacatatcataattaaatataattatgatatataattataatttgaaagcaacattatgaaacagaataaaatcccaatattattgaaacggtcataacgatgaatctgacatttcctccaacctaaaaggaaaccattgttaacttttgaaggaggtaaaagaatggacttggaggagggaagaaaggttaaaagtcaggtatttacctcagaacactttaattatttcctgggccaattaattgaaaattgcaaatatttaacataaatataatgatgaaagctttagtccagtttaacaagtatttgcaggtgctgtactagatgatatggatgcagctgtgaataaggtagacatggtccctgccctctggaacttccagtttattatgaagataacattaattactggtttgatgagcgctatacaaaaggaaatacaggttgtcagggaagagtatggcccgggaagtctcctctggggaggtgatgccttagctgagagagacctgaaggataaaatgagcaagtgaggtggagagagaatggcttgtgtaagacctggagttgagagactgacagttcaggaactgaaagccatctagcctggctgaacataggatatgaggaatagagtaacagatgaatctggacaggtatacgtccaggttgcggggtgggtgtaaagtggggaatcgtggagagagtcttgtagacactgaatttaagccatttaagttcatcctttctccaagatgatttcagtttattaagaaaagttgaagggcagcagccttcaacatctgcaaattgtagattaggttgtgtgagttagataatgcaaactagaagacatggaattatccttttcctaaacaaaatctatttctagactatacctagtagtttacaaaaatttgttccttctatgaatgactactaactcaaacagaactatgtttgagcactaggttaatattattctttaaagacttaacctttactttgtctcccttagggctcaaactagcttgtactagtaaatatagctaatatttgagtactgtacatttcaatatcacgaagagagtaaatctcaaatgttctcatcacaaggtcaaatatttgaggtgatggatagtttgattcatttgatttgatcatttcacattgtattaaaaaatcataacatcactttctgccccataaatatatacaactataatttttcaatgaataatttgaaaaagtctagccttaattgaaactactatttcccattagtaagggaacattgaagttaatttaaaaacaaaacaatgccctcaaaactacagtgaaaaactttctacaactgtgagctagaaaattctcccatgaattggcggggtgtggtggctcacgcctgtaatcccagcactttgggaggctgaggcgggcggatcaccaggtcaggagatcaagagcatcctggctaacacggtgaaactctgtctctactaaaaaacaaaaattagccaggcatggtggcgggcgcctgtagtaccagctacttgggaggctgaggcaggagaatggcgtgagcccaggagggggcgcttgcagtgagccgagattgtgctactgcgctccagcctgggcaacagagtgagactccatctcaaaaaaaagaaaaaagaaaattctcccatgaatcaagggaaatactctgaaaagtgttttatgtaagctcagtgagataattttgattcccagaaattgaatagttacattgtggggaaaaaaaaacccagattgatttgagaataattaagaatcctttaatttggcatgtaaagtcaccaagtacctacgtgtttaatatggctggaaatatttttttctgtgatctaagcatacttatacatttctagaagctggctcatctaaagccattcagcagaagaaataatttctgcttacagttgagcttctagggcccacgttgggacaaaaattttcagttacactgaaaacttttcaccattgttgggatttatattctgtcctgtcaccaagtttattttctttatagtggttttcacttttttttttgagacagagtctcactctgttgcctatgctagagtgcagtggtgcgatcttggctcactgcagtctctgctttccgggctcaatcgatcctcccacctcagtcttctaagtagctgggaccacaggcacgcaccaccatgcttggccaatttttaaacttttatattttgtagagacagggcctcactatgttgctcaagctggtcttgaactcctgggctcaagcaatcctcctgcctcagcctcccaaagtgctaaattacaggcatgacccactatgccttgccactattgtaattagtttttgtttgtttgagatggagcttcactcttgtcacccagtatggagtgcaatggtgtgatctctgctcactgcaatctccacctcctgggctcaagcaattctcctgcctcagcctcccaagtagctgggattacaggcatgcatcaccatgcctgtctaattttttgtatttttagtagagatggggtttcaccatattggccaggctggtctcgaactcctgacctcaggcgattcacccgccttggcctcccaaagtgctgggattacaggcgtgagtcactgcacccaaccgtaattagtttttaatgagcaaatgttaaattgctttatttatgttcacctatatatttatgtgtaaagtgttgttaaaagtgcttaatataaaagcttaataacaaagtacaaacctggctgtgtaagaaaagggcattatttccctgtaagtatttttggaaaagaaaaattggtacctctgaatcataatctggcttcaacttccctgatagtttataagagcccctactggggaagtcagtgggcaagtgaatcctgggaaaaattggccttatcatagtcagggcatcgacaggtctgtatggaccaggttcttataggacatccagcgggaacattgtcaaagggaatgggctactctatattttatgcttctaagtttatcatggtaaacctccagctcagaagtaagtcaaaacagagtgttgttttttttttttaatttttatttttaattaaaacgagagtccttagctgatctaagaagcagagcatggaagggaaagtaggaacttcattagcacatggcccaggtaaatcttgtacaaaaatgaatctggggaagattcatcttaggattgtcaagttaaagggtcagtacagtagcaaaaacaccttagtgatggcaggccttccttaatatgctgtctcttggctgggtgtggtggctcatgcctgtaatcccagcactttgggaggctgaactgggtggatcacctgagttcgtaaccagcctggccaacattgtgaaaccacatctctactgaaaatacaaaaattagccaggcatggtggcacatgcctgtaatcccagctatgcgggaggctgaggcatgagaatcgcttgaacccaggaggcagaggtcgcagggagccgaggtcacgccattgcactccagcttgggaaacagagcgagatcccgtctcaaaaaaaaatcatgctgtctcttaagtcacagttgtctagtctggatgggtatcacagtctgttttatatacagctgtccctggtatctcccatcactatcatcctggggatgtgctttgcctctttcctgtgatgtttctcctgtttcctttttccttggttttctttgtgttttgatagagtgctactcctcagaaatggtacatgggatgtaatcgtttttgagacattacatgtctgaaaagatggctttattctgccttctcatttgattttgaattttgttgggtataggattttaggcttgaaattatttgccttcagaattttgaaggcattgcttcattgtcttctagtttccagtgttgctcttgaaaaggccagagccattttgatttttgatcttttgtatgacttttgttcgtctccctcctcctttacacaatcaagcgagtatgatcttttcttttttcttgtccttacgaagttgagagtttacaattatatatcttggtgtgggttgattttcatctattgttctgggcccacgtctattttttaccagactgatttcctaaagaatgttaatttagcatattgcctgggctgaatgtggtaggcattcaacaaatgtttattgaaagagtgagacatattgttacacttgagagactagctttgccacatactagttgcaagttagataagttacttgtccttctgttttctcattggtaaaatgggaatgataatgagataatctgtatgaaagcatgtagaatcatgcttgacatgtagtaagcattcaataaaaataaggtgttatcattattattatgatagtattattggctgggcatggtagctcatacctgtaattccagcactttgggatgtagaagcaagtggatcacttgagcccaggagttttgagactagtgaaaccctgtctctaccaaaaatgaaaaaatagtaactgagtgtggtggcacatacctctagtcccagctactcggtaggttgaggtgggaggataacctgagcctgggaaggtgaggctgcagtgagccatgagtacaccactgcacttgcctgggtgacagggataagaccctacctcaaaaaaaaaaaaaagatagtattattgttttaaaatgaaattaccaattaatcaaggccttggctttaaaagaaaagatttatgtgtcataatctagagatgcattctggagcatccttcgggttgaatattctacctgttcttaggtaggatgtacaaaagaacagtgtatcttttacttaaaattgattgtatttggcaagactatatggctttattttagctattggaaaaagataaaatcacaacaaatttagttaaagatctaattggcttttatttgtgattcatgtattaggcagccttcattctacaaaatagaatgagggctcccaataagcaatggcagaacagtgggttttgtaaggtaggaataaggaaaccaagtaataggaaaaagctgattagtttacatcaagttacttttcttctaaatgctaaagcagagaggactttcttgttaaactgactcaggtagactggaatctcctgttttcaggaaaaactggtctgtttagcatctacccacttcctttaggtttcagtttgattatgtggtatttagtatgagtgactccatttttgtttggcctgatctgttggagccagtgaagaagcttagaccaaaacaatggccttccataatttttgtttaacactatcagtccatgtatatgtactgtcaataagccaaatttctagataagaccttctctagaagtacacagatatttgtgaaatgattgaatcagtaaagttcatagtaaatcatggtcatctaagttttccgccattctgaaaatacagaaggtaatagagctatacaggctctgggggctcatccccccattttatagatgaggaaactgaagcacagcgtgacagagtgagtaaaggcagagtgacatcctctagttgcacagtcagtttactcctgtagctccttgcctgctgccccttcctaagttattttcttctttagctttttactcctttccttgatttttacatttcatctgtagtttttttgtttcctctacagaattagtttatgttgtagaaaaaaaatgtgagccataatacaatgagagacaactgttttctgttctttccattctctggtgtcttctttttgtatatgtaaagatttgtcctttgtatatgtaacttctgtcattaagagctttgtgctttgtttgtagacaattgagtacatttagcagggaggaaagttttccctcatatggagtggcttgcttgttcccttttcctactgactgcgtgataatgggcctattgctagggtctggcaagacaagtggaaaagcggtaagaagcaaacttctttttctttcaggctggagtgcagtggtgccatcttagttcactgcaacctccacctcccaggttccagcgattctcacgcctcagcctcctaagtagctgggattacaggcgcccaccaccacagccagctaatttttgtatttttagtatagacagagtttcaccatgttggtcaggctggtcttgaactcctggcctcaggtgatccaactgccttgcctcgcaaagtgctggaattacaggcatgagccactgcgcccagcccagaagcaaacttctatagttctgtgagagatttgttgccactatgaatcaaaattgtcagttaaatagttgcttcctatattttattcctgcttataattatttattaatggatcaaggattttttccttgggagagaagtcacttacattaattccatctccctccaaatttcatctctaagcagaaaacttgtgctcttctggtaaataatgagaattttaaattaggactacatgcaattcaatggtatatagtcattgtctttttccatccattttctgtgtggatgaattttcttacctttagagtcagataatcagtctgaaaagatcatcagtcaaacagaagtcttttgctcaccttcacaggcaaagagcaaacaccaatggagtgactattaaataaagagtatgagtaatttagtttatagtcatctgaaaggattgattctcattgattcatgactggccttgaaggcaagtggcagtcatggttgtatctttattgtctggcaaattagaaagacgaaggggaattttgtaaatatacttgcagagtagggaggctgcatttgttatcttgtcttttgctacagagatttgggtcaacacctctaatgaatttaaatgtggttttttggggttttgtttcttattttttgtgttttaacttagtacttaaagaatgagacctagaattacctgtgctctagagtttctataacataacttggagcagtgatttgaagtcaacatcctaacagcagcataaataaggttattccttgagttaagacagatagacttctggagctgtacaaaagtcttttacctcaaaagacaaggatttgtataaatctcttatgtgtatgcgtgggggttttaggacctccatataagggtagctgatgactaactcggggaatggagttcttttttttaaaacattatgacctaaggttgtaaatgctgccgaagatatgaaaggtgttagtctgttcttgcactgctataaagaaatatctataaagaaaggaggtttaattggctcatggttctgcaggctgtataagaagcatggtggcatcagcttctggggaggcctcaggaaacttagaatcatggcagaagactatggggaagctggcacatcttacatggccagagcaggaggaagagggggtgggatgctatgtactttgaaacaaccagatcttgtgagaactcttatcatgagaacaacaccaaagggggaaatctacccccatgatccagtcatctcccaccaagccccacctccaacactagggattacaatttgacatgagatttgggtggggatacacatccaaacaatgtctgctcctattcattttacctctttaaatgccatttctgtagttgaaactttattaatctatcctggtttacttcagtagcgtcattcatctattctttgttcattcattcataaacatttattattcaaatagtatctgccttgtgctgggcagagctataaaagacagtctctttcctcatggagctcccagactgactaggcaatagcagtaagatggacacccacatggatggggagtcagaaggggttttctggagaagataataacagatatgaattataagagacagtcaggaatcttccagatgaagaaggagggagagagtattccaagtagaagaaaccacttgtaagaaggtgttttgaaagaagaacccataggagacgggtaatactttagccaaatgaatgaagatctatatcaggatattgctgctcttcatctctatattatttggaaagttgttttttaagccagagaaggaatataattctttttaatgcacaagcttaaattctgcttaaagtgttaatatatttaattctcaggatatgattgataaaatggactcttcaaaaagaatccataccactgaaaatattcaaatagaactagattattcagaattactattttaggggacatctgaagatcctgcttttttcctctagctctaaccctttcttctatgctgtaaccatactctttgagaaattggtttgcatatattattctctattgccttactgcatattagcttaacataacacaagaaaggtgtaaatcgtacatatacatcccaaagaattttttttttttttttttttgagacggagtctcgctctgtcgcctaggctggagtgcagtggcttgatcttggctcactgcaagctccgcctcccgggttcacgccattctcctgcctcagcctcctgagtagctggtactacaggcgcccgccacccagcccgtctaatttttttgagtttttagtagagacagggtttcactgtgttagccaggatggtctcgatctcctgacctcatgatccacccgcctgggcctgccagagtgctgggattacaggtgtgagccactgcgcccggccaaagaattttttaaaagtgaacacatctgtataaacgcccccaagataagaaaaatgaacattatcagaactctaaaatcccctattgtgtcccttccagtcactacctccaaccccttatcagttgttactcctccccactccccatcaaaagtaacttcttcctccagcctgggcgacatagtgaaaccctgtccctacaaatacaaaaaaattagccaggtgtggtggtgagcacctgtagtcccagctactcaggagtcagaggtggggaggattgcttgagccggagaggtggaggttgcagtcagccgagattgtgccactgcactcctgcctgggtaacagagtgagaccctatcccaaaattaaaaaaaaaaaaaagttacttcatcctgatgtctatcaccatcaatcactttagcctgtttttaaactttacataaataaaatcatacagtgtcttctcttaggtagggtttctttggtttcattcattatgatgtttttgagattcattcatgctgtttcaaatagcaatagttcattctcattactgtataatttttttttttgagacagggtctcaccctgttgtcaggctggagtgcagtggtacgatcttgatttactgcatcctccacctccctggctcaagcgatcctcctgcttcagcctcccggcctcgttactgtataatataatatttcattgcttgactacaccacactttatgtactctactactgatagacatttggcttgtttacagtttggggcttttacgaatgcttctgctaggaacattcttgtaggtgccttttggtatacatctcaccgtaaacatttctgttggacatgttcctaggtgtgagactgacggattttagagaaggcatatgttcagctttagtgatactatcaaacagttttctgtagtggttttaccagtttacattctcacaagtaataagcgaaagtttcagctgtgccatgtcctcatctgcacttgatataactcattgcattttgatttctgcccttattgctctgctgaaactgttcttaccaagataaatctgacatgttttatcctcatgttacttgtctgttttgcggtattgatgatcttaattactccctccttgaaacttcctattcctttacatactgtgataccagcctttcctgtctttctctcaccactatagtctcttctcctcaatttacttctcagctctttgttctctctccataccttaaatgcaagtgttccccaagtttccccctttattttcactctaatacatactccttgggtgatttttaaatcttctttaatgggttcattctaccacctacatgaggaaggtgcccaaatgtatatctggtccaaatttcttttctgagtgccagacctgcttatacagctttctatgaaatattccacttggatttccaaagatactttaaacatatacctatttaaatatattacaatttattcattcaattgttgatgtacatgtaggttgtttcttgttgctatttttttctcctttataacatgtgttcctttccctgtatttcctgttttagtgaatagtgccacatccacccagttgcccaagccagcaacttgagaattattctttaccactataccttaccaaccctcatcatgagcccatccttcccctacatcccatttacttagtcacaaatcgtaatagctttaactcttaattttttttcctctgtcccatagactttatcccatcagacccttttgatcaatatcagtaccatttattgaatactggctgtgtgcttttagtatacatcaaataatttaacctgcaataactctgtgaggatggtagttttatcccaattatacatatgagaaaattgaggctcagaaacactgtcttatgtaaggttacacagctgctaaatggtagagaggatgaggcaggattggaattcaagactgtctgacttcaaagcctgtacccttaaccattatattctgctggaccacagttatcattctcaacaacagtgtcttttctggtccccctggctacagtcatgctttctctaattgatgtcactcctttattttaaatccttcaatggctcccgcttgctaagaacttgataaagtctaagttcttagcatggaatactctccctccatgtctggtccttactgttcttttcagttttacatctctcctctttgcctctgtgctccagctatgctgaaccacatgcagcaactcaggtgtattgcagtcacttttatacttttgtgcctttctaattatttcgttttcttctttgcctggctaactcatttgtccttcaagactccatttagatcccccagacattctattaagaaacatttcctaactgacttctaaaccattttggtgcatgtcctctgtgctctcagaataccctatgctctatcatagcactagcacatattttttatcattgtaattgtcacacctcctcgaacaaactgattgttctctttttgcctcctgattagaatgacagctccctaaggaccagtgctagtttttaatccttcttttttttttttttttgtaaccacagtgcctagcacatggaagcattcctcaaatatttgttggctaactaaaatgctggaaattaaacaatttaaattgagcataaaagtacctgttcttgtacacattgatttttattatctccagaagattttgtttttgattttgatttggaggtgtaggtaattgaagcaacaacaatttattctacatggtagcttataccctggagtctttatatgattgacacaaaagtgggtttgccttccctatgtcaagttagtagaaattctcgcacagactcagaatggttcatagaatccctggaaggaacttggcagcttcagcttacctagggagattctcttaaaataatggaaaacatgagtcttctatggtaagaaatacctactccaaagtggtaaaaagtggtagtagttctggattgcatggtataaaccaaggttctcagaggtttcatgaaactcagttggtgcttttaaagtcttcctttgcctttgaaaatacggcaactttttaaaaattttctttagtctaaatgaaagactaaggagaaaacacccaggtcacgcctttctgacaggcttaaacaagtatgtgcttatttttataccttagaacaatttaataatatgtggcatttattatatatattaattttctggtttaattgtggtgggagtataaaagaaaactagtccccactcttaggtttattgtctgttgtaatgattatataatagtcaaagtagtatataatcaatttttaaaatgtggtgttcaagcccattccttcaatagggcaaatgggatagtcaccatatgctctgcccttgttggtagagggtgaggaagggacaccttactccttttttctaaataccactgtctctgggtacggtggctgacacctgtaatctcagcactttgggaggccgaggtgggcagatcacttgaggccaggagttccagaccagcctggccaacatggtgaaaccccatctctactaaaaatacaaaaaaattagccaggcatggtggtggttgcctgtaatcccagctactcgggaggctgaggcaggagaattgcttgaacccgggaggcggaggttgcagagaaccaagattgcatcactaaactccagcctgggccacagagcgagaccctgtctaaataaataaataaaatgccactgaaattcaattttaaatcttttggacaagggaaggggagggattaggaagaggcaagagaggggctcctgaggtgctagtaatgttataattcttatatgttcactttgatattttattgatctttatacttatgttttatgtacttttcgacatgtatcttgtattccattaaaatgttttaaacaattctagaaatttagaaatttctgtctttaaacatttctcaaagggacctatgaaagatgttaatggtgaggttcttttccagtgcccttattttgcatggtctaccatgggttgaggagccctagcctagtggtgtgcagattctaagtggagtgggagaacagtgaaggacaagattggcgtgggcaagagtagtttgggaaaacaaaatatttattcattcagtaaacgttaactgggcacaagccatgtactgaatactgtgctgatatagaaaactttggccaggcatagtggctcatgcctataatcccagcactttgggaggccgagccgggcagatcacctgaggtcaggagttggagaccagcctgaccaacatggtgaaaccccatttctactaaaaatacaaaaattagctgggcatggcatggtggcatgcacctgtaatcccagctactcaggaggcggaggcaggagaatcacttgaacccgggaggcggaggttgcagtgggctgacatcgagattgcgccattgctctccagcctgggcgacaagagtgaaactctgtcaaaaaaaaaaaaaaaagaaaaaaaagaaaagagtttgagaccagcctagccaacatgtttggcaaaaccccatctctactaaaaatacaaaaattagccgggtgtggtcgtgggcacctgtaatcccagctacttgggaggctgagtcaggagaattgcttgaacccacgaggcggaggttgcagtgagctgagattgtgccagtgcactctagccagggcaatagagcgagactccttctcaaaaagaaaaaaaaaaaaagaaaaaacttgaaggagactaaaggtcagggttggaggggaaaataaaatgtggatgctgtcaattaattctggttgtagctatctactagtctttatagaataatataaataaccaatgcttacttagcatttgctgtttactaatatatttacatgtattaactcattttatcttcacagtaacactatgaagtaggcactactaccaatatctcattgtatagatgaggaaactgaggtacagatttcctaaagtcactcagccaggaagtagtggagctaatattcaacccaaatgtcagggtccctttttgtctgctcaaaatcactatgctttgtgaaattaatgcaaagactatcaaaggaaatgcaggttgatctggaggcactatttgaagatagtcagtgatcttgcttccagtactctgttgtttatgtgttttggagctctgtgtgaatgccttttctcctttttacagacatggctggattccgccaaagaaataaaaaagcaggttcgtggtaagtggatatagctctttttatagttctttctttcttttagtaggtcagaggatttccaaccatttctggctgtgagtcagtcactttagaatcctgactactgcagattgctttgaaatcgagataaagccttctcctggaaggaggagattccataatagaaaaatatagcagaggtggatactattgagatgtaggtcagattttgttgatttttttttttttacaactgggcaaagttggggaagataggaagagttgagagtaacagaaggtggaaaagaacaaagatgagaaaagaaaaaggatatgggagtcagttctcaaaatggtagtgacttgaaaccgcagttgcctactaggagtttgctgccgtatcctattcctttgaaattgttctgaactattgcattataaattttatgttttcctctttatggttgttttcatcccttttaacagtcctcttccaaactgcagtataaaggactgtggaagaaaaaaagaatggaaagacaagaattgcttgccactgacccttctgacattgtggctttgctcctagctctaactctaatgtatagtcccgctttacaccctgatcagactggtgtcctgggataaatatttctgggctgaaaaaagtacagattagtattttgcagttccaggcccaatggctaattaagactacctgtccttttagtttagttttgaagaaacttccaggaaatgcaatagttgttatttatcatgattagtaagttttaacactcacctgaaaacaaactttacttttcatttgtttcttagaagaaaacacttttgttatggtgaaatgtttttctttagaccctatttgtaattgtttagttttcttaacggaagaaacaaaatactcttttggactgataactctctgtatttgctttctacctataaaagctcgttttaaaatgcaagtcagagcaaacaaatattcagaatatttgagacaccacaagaaaaatataactccttgctcctttcaatgaaaatacttttaatatgaaatattaggaacatatgattatccaagaagattctttaagagaaaaagttaacagagtttatgatgagtaaaaaagaatatctagtagattatcttcctgggtatttaaaaaaaaatcttgctaagaaaaggaaccttaatatttttcagttaaaaaaaattacaccatcctggccaacatggtgaaaccccgtctctactaaaaatacaaaaattagctgggtgtggtggcgcatgcctgtaatcccagctacgcaggaggctgaggcaggagaattgcttgaatcagggagtcggaggtggcagtgagccgagatcgcgccactgcactccagcctggcgacagagcaagactccatctcaaaaaaaaaaaaaattacagaatgataaaaacgctttcttcaacatgggggaaaaaaacaaaacaaaacaagaaaaacaccatgtccctcacaaaaactttaatagagaatcaaactgtaaacatttttttaagccaaagagaagaatgacatttattgcaaaggtggggggttttttaaatttttgttttttgtgtttttgtttgtttatttgtttgttttgagatggagtttcgctcttgttgtccaggctggagtacaatggtgtgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtaccaatgttgggtttatcagctgagccaggcgcccagcgtggggggttttttttttttttttttaatcacgacagtaatatatacccattgtaagaaatttaaacattgtaggaaattatcatgaagaatgtaagagtcctctaaatcctgtcctctggatataatcactgttaaactgatataatctgcaatatttttttctaggcatatatacattttgcattttaaaaatccaagtatatggccagttgcagtggctcacgcctgtaatcccagcactttgggaggccgaggcaggtggatcacctgaggtcaggagttagagagcagcctggccaacatggtgaaaccccgtctatacttaaaatacaaaaattagctgggcatggtggcaggcacctgtaatcccagctactggggaggctgaggcaggagaattgtttgaacctgggaggtggaggttgcagtgagctgagatcatgccattgcactccaacctgggggacaagagcaagacttcgtctgaaaaaaataaaataaaataaataaataaaaattacaagtatgttatatgtagtttttaaatttaatttttaaaatagatgttataaatatgtggtataaaataaaaagatacatatgagtatagtacgaggtaaatctcccttctctccttgtcctagtcatgcagttttcgttcctggaagcaaccatggtaacgtgctctttccagagatggtctgagtgtaataatatatgatatatattttaaatatgtatatatatttttagagatggggtttcactctgccacccaggctggagtggagtggcacaatcctagctcattgcagccttgaactcctggactcgggagagcctcccttctcagtcttcaaagtactgggattacaggtgtaacccaccacacctggctggtctgaatgtatatagacacacacacgtgaacgtgtgttttaatataaatatgcaaccaatcttttttgtttaacataatttggagtgctatccatatcaatatatatacatttatttcatctcttaattttaggccaggcacgatggcttatgcctgtaatcccagcactttgggacactgaggtgggagtatcgcatgagcccaggagtttgagaccagcctgggcaacatagggagaccccgtctctacaaaacatctgaaaattagctgagtgttgtgtacatgcctgtagacccagcatttctcagagtatctctgtcattaagtgaggcatggcaggcatgagccactgtgcccagccttgtttatgtagttctaatcctttataaatcaaacgattatattaagtcaggcaaaaaaatgagatcctctagcacaaatccttaagtgatatctaagcaactttcttctttttaaaaaattgctttatccaccaagcatgaaaatatttaaagatgtattaatataaaaagagaaatgtaggctgggcgtggtggctcatgcctgtaatcccagcactttgggaggccgaggcgggtggatcgcctgaggttgggagtttgagaccagcctgaacaacatggagaaatcctgtctctactaaaaatacaaaattagccgggcgtggtggtgcatgtctattatcccagctcctcagtaggctgagacagaagaatcgcttgaacctgggaggtggaggttgtggtgagcagagatcacgctagatcacgcttcacgctacggcactccagcctgggcaacaagagtgagactccgtctcaaagaaaaaaaaaaaagaaagaaaaagaaaaagagaaatgtttgaatattttgaggtacttccaacaattagaaacttaggtataaacgtaaaattcttttgtgtttatttttataggtgtcccttggaattttacatttaatgtaaagttttatccacctgacccagcacagttaacagaagacataacaaggtaaataagtaatagttaaatatgtaatttatcatataataatgtgtatgatgagacagtaattcttaccaccataagctctgctaattccgtattcagaactgaagaaaaataatgatattaagtagcctaggattgaaagtttctggtcacttcaaggcaggcatacaaataagtgaatctaaaagccttgagtatctgtgacctgtatcataagtatcaggaaattggcaggggaactggccttgcttatcatggatattatgccaagctgtgggcagggcttctaccagcaccctccaaagggcaagacacaaatatagtggtaaaatgactctactgttttttttgtttgttttttggggtctcttttcatactcctttcccaccatgttccttctttttgttgttgttttttgttttttgagacggagtctcgctcttgtcgcccagtctggagtgcaatggcacgatcctggctcactgcaacctcagcctcctgggttcgagcgattcttttgcctcagcctcccgagtagctgggattacagatgtgcaccaccacgccctgctaattttttttttttttttttgtatttttagtagaggcgggttttcgccatgttggccaggctggtcttgaactcctaacctcaggtgatctgcttgcctcggcctcccaaagtgctggtattacaggcttgagccactgcacccggccccaccatcttccttcttataggtatcaaaaaagctgaaagcctaagtgttattatttcttcctatctcccttttaaaatgtttgatgaagtacttaatcccctgaactgaatcttccttggagcccacctaatttattaaatcctgcgctctttaaaaacagcctactgatgtcttttaagaaaatggcttttattggattctataaaaatattaactaaaaaagaaaatggaaaatcaatatattataaagtactactgtgcatatttatattcatgacatcttgcatagggtcttatccacaggagatgcttgtcaaatgtttcttaaattaaactgttggttgttgagtaactgctttctatttctgattttgctgccaactatctgattccaggcagatttacagtctttaggcctagatagtttccatatctctcaaataagagaatagactaacctctttaaaaatctgattattaagttctatacaaagtcaatgccattttttcttattatttgtcatctagtcatcctcagtacattcttgaagttgagatgccggatttctgccttaaaagattcctttggttatttctttttcacagtaatatttgtcttttggagttgctacttaatcatctttttccgtctaggcttatgtataaaacaaaacacatttctaaaaatctttgctaattatttacattttagaggagtttaaaatttttgtgccttgtttggcattgttctgacatttaaaaaaatgtacgttatgactaattatagcaaaatgttatttaatatcttataatagaagcaaagatatgattctaattaatttaggaattgtcaatttaataatactttcctgtttggtaaaactgtctgaattggtgaactcagtcagttagaacacgtggtaaggaagtcagggccataggtgtgaacgttacactgatggagagaaaagtgtcagcgtggtaaggcactcatttggtttgttggactgaactgttttaactgcaaactgtgcagttcccaacagtttagcacacagatgggattagtcttacaaggtggctaatagtatgtagaaagctgcatgcgacttaactcatcttggagagaaaatacaccagaatatttatatcctagtgaaaatgtcagtaatgtcatctttgtatatgaaggactatatctgcacacttggcatagcaatgtgatagaaaagaaagggcctggttttggagccagtcttcattactacctgacaccgagcacgctaagcttctgagctgcttcctcatctataatctggcaatgatacctacctcacaagttttttttatgtgtgtgtgtgaagattaggtgagataatttatatatctgtggtacttagtatacttaaaaaaatagtagtttcattacttcctttagacttttccaacctttcctctttctaaatgtgtccaatatagttacagtattttttttaagttttaatatgtaaaaatttcaaacacacagagagaaataatagcgcaatgaactaccatataccaactacctagattgaagttattattatctcatatttacttaattgctttcttttcttctgtgtccttattttttctctctctccctttctgtttctccccttttctcctttttctctctttatattttgttgttgttgttgctgacataacatttttctcttttggctgtagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtgaatatgtctccagggtttgttcggtgtttgttttggcgattagtttaaacacttaacatggtattggttcagtgtttgcctaagagggatcatggtgccatagaaagagtcagtttcctccactgtttgactttgggcaggttacttaacctctcttaatctaagctttctcatcagagtaataggcattgcattgtagggtgaaaactaaatgaggtaatatatgtaaagcacttagcacagtggctggctcagtgctcagcaaatggcagctattattatttttgtttccttaccttttattttttatcagatttaaagctcattatgctgcattaggtaccttgagatccttagagcaggggtttttaatttgagatctttatacatggatagatttcagagggcccgtgaaactcttggaagtatttttaaaagtctttattaaatttactgactatactgcttttatacatgaaaatgattggtaatgctgggagttatcaagtgatcaagaacaagagtttacagtcagtctgagctgggttgaaatcttgacgttggttccaaccttgtgaccttaggtctttcaattataatgtctctgagcctcaggtttcttatatttctgatggagattatcacctcagagaaactagggggactgctaggtttagaaaaggtattgtgggctgaccacaatggctcgcacctgaaatcctagcactttgggaggccgaggcaggaggataacttgaacccgagtgtttgggaccagcctgggcaacatagcaagacctcatctctacaaataatttaaaaattagccaggcatgatggagcactcctgtggcaagtagctgaggtagaaggatagtctgggaggtcaaggctgccatgagctgagatcacaccattgaaaggtgatgtgtgtaaaatactgaatacaatgtcacaatgtctttcatgtggtaaaaaattcagtaaatattagctaatattaaagtgccagaataatttgtgtttcttcctcctcatacattcattgttacttgagtgacttgctatagcttagttctgtaaactgccttagcatattaatgtgaaaatctgaccttggccttgaattagtaccctaagttacgttagcatgagttaggttgcaaagttccaaaggatcacactgctcaaagagaaatccaaagagtggtgtcggtaggcttgccatgatagtaaaaattattctttccagccattgagccatcttgttctccttggggtagttggaataggattgcatggattgggatgcttcaaatgagagagctgtaacttaagatgtctgaattctaggtgcgttattgcccctgtaggttcaggtacctcagtcatgaggaccatactaaggactttaaagtctacaacctacatagcagtagtcttataagagttacccatctctcttggggtcacactatttccaaagagaactgcacgtttgctttttaagttttgacttattccagtaccaatgtctggagtcactaaatacaccactttcaacttgttgatgactataacttaagcatgttacattgtctttgaatacatttttattgtttttattttttatttttatttttgagatggaatcttggtctgttggcaaggctggagtgcagtggtgcaatcttggctcactgcagcctccacctcccgggttcaagcaattctctgcctcagcctcctgagtagctgggattacaggcgcccaccaacacacctggctaattttttgtatttttagtagagacggggtttcaccatcttggccaggctggtcttgaacttctgacctcatgatccacctgcctcggcctcccaaagtgctgggattacagcacttttatttatattctggttatgattctcaacatttacatatataaaaaatagggacatataaaaatatatgcatatatacatagaaaagcaagtactggaaagaaacaaaataatttgattaattagaatgtcaatactgtagggaaatgttatttttattacctaataatttaaaaatattttttattagttataatataacccttgggcaatcagtaaaatagtaaaagaaaatattttactgctgccatagagctgaaccgcagaaaatgatgatgtcagattgtgattgatacttgaaatctgtctctgatttttttttttaaagagagatggaatgtcactgttgcccagagtgtagtgtagtggtgtgatcatagctcgctgcagcttcaatctcctaggttcaagtgatcgtctcatctcagccttctgagtagctaggactataggtgtgtgctaccatgcccagctaatttttaaatttttttgtagagatggtagtctcaccatgttgtccaggctgatctcaaacttccagcctcaagactcccaaggtgctaggactacaggcatgaacctctgcgcccggcctaatgagtcttttaatggttatctgatcataatagaatctcaggtttgagaggacttatagtctctcatccaatgcttgattctcctttatagaattgttacataataatcataataagtagccagttattgtgcatctattattatgtgcaagatactatgataagcactttatgtaaaacatcacgtttaatctttataaccaccctttgagttaggacaacggttctcaaaggtggtctacagaccctggagatcttcaagattctttcaaggggtccatgaagtcaaaattatttttgtaataatgctaagatgttatttgcttttttcactctgttgaaatgggtggggcacaaatcaaggcagttggagcaaactgtactaagagtcactatattgttctccagcatgcacttgcagctggaagtgcaagaaagccagcttaccttagaattttcctaacgaagcagcaaaaagtattaattttattaagtcttgaatacatttctatttaatattctgtgtgattagatgggaagtacacacaaagcatttttgctgcatactgaagcacaacagttgtctcaaggaaaagcacttgtgcaattgagttgtgagctgaattggccatctttttttttctttttttttttttgagacggaggcttgttctgtcgcccaggctggagtgcagtggggtgatctccgctcactgcaagctccgtctcccgggttcacatcattctcctgcctcggcctcctgagtatctgggactacaagcgccagccaccacgcctagctaattttttgtatatttagtagagacaaggtttcaccgtgttagccaggatggtctcaatctcctgacctcgtgatccgcccgcctgggcctcccaaagtgctgggattacaggcatgagccatcgcgcccggtggccatcttttctataaaacaccatgttttcttgaaaaaatgacaaactatgattattcggactcggttatttgacacacattttctcaaaaatgaaatgagctagtacttttaggaaagcaactgacagtatttgttgctaatgacaaaattcaagctttctggtaaaaattggaattttggaaaacttttatatatccccatgatcttgacagcttttaaagacttttctgctaaggtcagtggttattttaatgaatgtgtttttttatacacatattatatcaaggtttggaagattttcataacttggtgaacaagtatttttcagattagaaatgcacaatgttaaaaaaatcatgcacaggtaaaagatccattcaaaatgcaagatagaccaatggattttaatgtaacagtacaaaaagttcattgataagtttctacatttcacattgaaaattatctttaagaaactgccattgatataataaaaaaaaaaaaaaaaaaagaaactgccattgataagttttagtgtaataccagaaaagaatattttaggccaggcgcagtggctcatgcctgtaatcccagcactttgggaggccgaggcaggcggatcacaaggtcaggagtttgagaccagcctggccaatatggtgaaaccctgtctctactaaaaatacaaaaattagccaggcatggtggtgggcacctgtaatcccagctacttgggaggctgaggcaggagaatcactttaacctgggaggcggtggttgcagtgagccaagatcgtgccattgcactacagcctgggcgacaagagcaagactccatctcaaaaaaaaagaaaaaagagtgttttaaattcatagtcaccccttttcaaactacatgtctgtgtgagatcagatttcttcacatactgccaaatcaatatattgcaacagattgaatgcagaagcagttgggagaattcagctgtcttctatgccagacattgaagagatttgtaaatatgtaaagcaaagttaccttttcatcactgtttcagaaaatattggtatttttcagaaattatgttatttatgttaaaaagtaatgggattaccattattttattttattttgaaatggagtttcactcttgtcgcccaggctggagtgcaatagtgtgatctcggctcactgcaatctccgcctgcttggttcaagtgattctcgtgcctcagcctcccgagtagctaggattacaagtgcctgccaccacacttggctaacttttgtatttttagcagagacagggtttcaccatgttggccaggctggtcctgaactcctgacctcaggtgatctgcctgccttggcctgctaaggtgctgggattacagacgtaagccaccgtgcttggctggattactgttactttttagaaatttaataaacattttaaattttccttagttaaaacaattttaatatagtgaatacaaatagctataagccacataaagaaaagctcttgaccgggcacagtggctcatgcctgtaatcccagcactttggggggccaaggcagccagatcacctgaggtcgggagttcaagaccagcctgaccaacatggagaaaccccatctctactaaaaatacaaaatcagccgggcatggtagcacatgcctgtaatcccagctcctcaggaggctgaggcaggagaatcgcttgaactcgggaggcagaggttgcagtgaaccgagatcatgccattgtactccagcctgggcaacaaaagcaaaactccgtctcaaaaaaaagaaaaaagaaagaaaagctctttagggtcctcaataatttttacaataattgttaagagaataaagaggtcctgagatcaaaaaagtttgagaaccactgagttggggcaatagggcaccatagttaaaatcttgggctctggagttagcctttctttaaattcagactccattccttgttaactgtgtgcctcttggtaagttacttaagctctctaagcttcagttttttcatctgaaaaataagggcaataatgtgaattttctaattgttaaatcagaaaatttatataaagtgattagtacaatgacagtatatagtgagagttcaaatatctgctatgataataataattcttggctgggcacggtggctcacacctgtaatcccagcattttgggaggccaaggcaggtggatcacgaggtcaagagattgagaccatcctagccaacatggtgaaaccccatctctactgaaaatacaaaaattagctgggcatggtggcgcgcacctgtagtcccaactactctggaggctgaggcaggagaattgcttgaacccaggaggcggaggttgcagtgagccgagatcatgccactgcactctagcctgggtgacaaagtaagacttcatctaaaaataaataaattaaaggccgagcgtggtggctcacacctgtaatcccagcactttgggaggctgaggcaggtggatcacgaggtcaggagttcaagaccagcctggtcaagatggtgaaaccctgtctctactaaaaatacaaaaaattagccgggcttggtggcacgcgcctgtaatcccagctactccggaggctgaggcagagaattgcttaaacctggaggggcggaggttgcagtgagccgagatcgcaccactgcaccccagctgggcgacagagcgagactccgtctcaaaaaataaataaataaaaaatataaataaatataaataaaaaaaaattcttatcctcacttcacaagtgatgaatgtatgtgtcttggtttggagaactagttttaacctttatcagaatgtaaacccaattaggtgaaacaatctcaagggacaaatggatatagttcagctgatattctgttagagatgtggtagaaattgagcaataatggatcgccgtgaccagaacatttaggagtctgtcatcttggaatttacttgctcctttttggaaagatttgcaaccctcacaaacccaaaggaacaatttaattatgtccaacaacatggcattttaactaatccaaagaaacttccactgaggcatatgcattttactatgcattggaaagtgcagtacaagcacttctcagatagaagacagcctgcataaatggaatccttagtagtggccctttgcccagactgggattttaaagctataattaacactttaaatttacactagcaaatcaagctttaaaattaattgccctccatttattggtattaggaaggtatgtaaacttgtctattgtcccccacttaattctttgaaatcacaatccttaattaggagatataacaaacattattaaaagggggtcacataacactggaacacaccgaatagctctatcctgattgcacttgcttgaaataaatgcagggaaactttattgtaacttctctttttaatgagctttaaccagtgccggagcttcctggtcaggtacttttgtaagctgcagtacttacaagtagtaaattattaggtggtactgaaaaaattcaagacagtacttttaatggtttagaggtatctaatctcttcccagctggtttgttatgacgctcaaaggtcttggaaattttagggaaaaccttgatcattaaaatttaaggcaaaaaataatttattttgtgatattaatctttcaaatatatgtgttgtgttaacatgcacagatgtctgtgggtggtgagattatatattttctatgcttttaatgatattttccaaattttatacagtgaatgtgtatgatttttataatcagataaagctttctggcaacattaggtggggcagagcaaggtagtcatccatgcagaggggcagtctggcttgggatattgaggcctaagcagagtgaggagtgggtccgtgggttggagggcagcctggcatgaagagtcagagctcaagtggatgaggatggtagtcatgtgtgggcacctggtggtgggtttcagaagccaagcagagcaagaagggcatccatgtgggggaaaagcctacacaggatgtggagggcatccatacagggtggtgcttgatgcacagtgtcaaagcctaagcagggtgaagagatggtcccacaccagcagtcagaaccctggtgaggtaaggaggacatccacgtgtgctgagtagcccagaatggggaattcagggttcaagtagagtgaggaggacatccacatacagtaggggtttgtggctgcaatgagagattatatgattatacagagggattgatcaaattagtcaatgtattcagggtaatgggagccaggtttctcactgtcagtaaagtgagacacaaattatggaaagggagaaactaaaatgaaccctgttaggatattgcgttaaaactggaggcttcaatgtgaacttgtggtttccaatatatagataggtagatatagaaatatagatgtaaaaaggtagatacatacacagatacatactctaactctacattgtgtcagaaggaagtactggaagaatgatgggaaatggtcagaaggacacagaatccagcttggagaggttcccactaccaaatctggggcaatttaagcatcaaaatagataaggaaaataattgatatactgcattgaataaaatgaaaattcgtgagtccatactgacataaataaataaattgaaattttaaggctgggcatggtggctcatgcctgtaattccagcactttcagaggctgaggtgggctgactgcttgagcccaagagttcacttgaacctgggaggtcaaggctgcagtgaaccatgatggtgccactgcactccagtctgggtgacagagcaagaccttgtctcttaaaaaaaattttttttggctcacacctttaatcccagcactttgggaggctgagttgggcagatcacgaggtgaggagtttgagatcagcctggccaatatggtgaaaccccatctctactaaaaatacaaaaattagccaggcatggtggcgggtgcctgtagttccagctacttgggaggctgaggcagaaaaatcacttgaacccaggaggcagaggttgcagttagccgagatcataccactgcactccagcctgggcaacggagtgggactccatctcaaaaaaaaaaaaaaaattcttaagttagaattacatttttttaagaattgtaaagggaccttgttatgttgtgcaacctgaacaacctgaagtgcagtgctatttacaggtgtgattgtaactcacttacagccttaaactcaagcaatctacctgcctcagcctcccaagtagctgtgactacaggtcactgcacccagctaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaacctcaggtgatccgcccacctcggcctcccaaagtgctgggattataggcatgagccaccgcgcctggctgagacaaggtctctctatgtcgcctaggctcatagactcaagcaatcctcctgtctcagcctccagagtagctaggactataggtgcatgccactgagcctggctaaaaattaggtaaaaaattttaaatgcaaacatcagccaaacttcaaatataaatattattttcaactaacaagttttaaagatctccccttatttatttatttgtgagacggagtttcgctcttgttgcccaggctggggtgcaatgacgcaatctcggctcaccacaacctctgcctcccaggttcaagtgattctcctgcctcagcctcctaagtagctgagattacaggcatgcgccaccacgcccagctaattttgtatttttagtagagacggggtttctccgtgttggtcagactggtcttgaactccctacctcaggtgatccgcctgcctcggcctcccaaagtgctgggattatagacgtgagccaccgcgccaggcctgatctctccttattttttaaagcatgcttatttatagaagcatgtaactacatactgtgaaatttaaatctgtattcaaattgattgaccctattaatgtcccttagggtagggtaggaggagtgagtatagggaagattttatcataattgctttacttaatgttttaaaatttgtcttcaaattcaagtgatccaaattgtgtctcttaattttatgatttgtgtgtagatgaaccactggactatcagaaagctaaggctgcaataataactattcatgtctataaagcagttttacaaccatcatctcatttcgatcccaatagtaacattcattcattcagcaaaaacaaagtcattgcctatcctagtatctagaaatacgcattattatgattctcgttttatagaggagatggagggagacactggctggccacttacaagtactgaagcctggattccagcccaagtattgtgacttgagttttgacttaagtctgctgtctcaactaagggtcctaacttgcctgtggtaatgtgatccctgagaacctgtttcttcaacagcaaaatgaaattattgtactctttaaacttcaagctcctttccagcttcaaaatcctaaaattcagcgggagtggtggctcacgcttgtaatcctaccactttggaaggctgaggctggaggatggcttgagcctaggagttcaagatcagcctgggcaacatactgagaccccctctgtacgaaaaataagaaaactagctggacatggtggcatgcacctgtagacccagctactcaggagtctgaggtgggaagatcacttgagcctgggaagtggaggttgcagtgagctgtgtttgcaccattgcactgcaccctgggtgacagagtgagaccctgtctcaaaaaaaaaaaaaaaattctaaaattcatctcgtcaataacagtaacaacaacagaaacataaaataggagtaatgttaactagaaaaaaatgtaacttagatggaaaaaaattaaaaactacaaaactttcctgaaatgtttttaatgacttgaatatacagacttgcataaggggctaattttcccattctcctttttttaatcttcaatttcaggttcattaataaatagaattaggtgtgatgcttcagtgcttgtgaaaataagtttgttcatgaaggctaaatcagtagcaaatctgcaccctgtctcctgttgtatacatattttggtggttgttgttccaaggaatcctttgtccttttaattagggtaaagacagatggatttggaagagacttttccttgtgaaatgaagagacccctgcagctttctgtagcttgaggcagtcttatgggaaactggcgtttactgttttttccttggggatgtgcctgcattattgttactgttaagttatacttgattggtctgaattgtgcagcattaggagtgatatttttgtctttgaaagctctatataacagctcatgaacacttttcaaaagacgggaaatttatagaggagaagaaaagactgtcacagcgagtgtttagacagtgagactgactgttttcaaacaaatctaattcattatatgcctggtaatgaagacatattaataacagagaaaacagccccattatctatgtgcttccgtgaaccagtttattttgtttatatcagtgggcaggacaccatctgttaccagaaattttcttttcatcaagcctgccccgattaagagtcctcagttaagtaacatcagctgccctcttgtttaatttccataactcaattcaggggtatggagagaaaaaggcagctataagaggatattgtaaattacaccatgccctctgaggatttaatttggtcatctccttggcaagaaaaattagcgggaggagcttatgtatgtcggagaaaaagagtgaagagaagggggcagaactaatgatagatgaaatagctttaaggaaattgtttagtaggattaaaaaaattttttttgcagctttttggtgactttttgtttgctcacattgtctttttctaaggtatattttaattatttagatacaggcagtgatgggttctgttccataataacctactttcaggactaggaaatatatcttaatatagtggtatgtatatgttcatgtgtttaaaatacagtgaatatataaatgttactgtaaatgatgacactataacactgaaagaattttatgtttttattctatcaaaggtccatgactccagctcaggctgacttggagtttcttgagaatgccaaaaagttgtctatgtatggagttgatcttcataaagcaaaggtaatgataactttgccctttattaatatgcatgtggaagatattatatgatacatgtctgttatgtatgtatcacatctgtgtcatataatactttttaacaacatctggggtattttaaaacattcaaaagagatagtagactgggcacagcagctcatgcctgtagtcccagctactggggaggctgaggcgggaggatcacttgagtccaggagatcgagcgtacagtgagccctgattgtgccactgcactccagccctggcgacagagcaagaccccgtctcaaaaaaaaaaaagagagagaaatagtacttcttgttagcttttttttgttttgttttgtttttttgagatggagccttgctctgtctccccaggnnnnnnnnnnnnnnnnnnnnaccatgttggtcaggcttgtctcaaactcctgaccttgtgatatggccgcctcagcctcccaaatgctgggattacagccgtgagccactgtgcccagtcatgttcctgtagctttttaagtcttgtttttgtctttgcgcttaccttctcttttgattaagagcatttaacttaagaaacaacaaggctaattattctgtctatttagcacagtagccttgtaactgtaaaattcattatctgacattagtttggtgccagatagagatagctttttgttggcattttaatgagatatattctgccagtatacctgtaggtactgtctcccccatgtatattatctcatttaatgttctgtgtaggggcatacacagaactactgttgctacttggcctcaattcttttttttgagacggagtcttgctctgtcacccaggctggagtgcagtggcatgatctcggctcactgcaagctccgcctcccgggttcacgccattctcctgcctcagcctcctgagtagctgggactacaggcgccagctaccacgcctggctaatttttgtatttttagtagagacggggtttcaccgtggtctcgatctcctgacctcgtgatccgcccgcctcggcctcccaaagtgctgggattacaggcgtgagccaccgtgcccggcctcttgttagcattttaagtgtatcagttaaatcagtcaactgtatcaattgaatttgccccatagcaattccaccctcagaataaagtttcatatccaagctactgttaagatcaaaagatagcccctagagaaaaagaaattgattttcctaacatgcagtaacatttgaaaatatagagcagtgggcagcaagtcctgtttcacagccagcatcacctacatcgaatcactgaggatgttcattaaatatgtagatccctgagcttctctcagatgtatggaattaatttggaggcgaggttctagaatgtcttggtttaatgagcacccaaatgattctaattcatgcctgaatctgagaaccactggcctagagtagtggttctcaaagtatggtgtctgagccagcaacatttaacatcacctaggaacttgttagaaatgcacatttcaggccccatcccaggcctgctgagttagactctctggaggtggagctcagcaatccattttaagttctccaggttgttctgatgcacactgaatgaaccacagtggctcattcaaaaaccacttgggtagggccctggaaacttgagctttaatcctagttctacctaatacagcctaacagaatgaatccttaaggaaagtctccttacttctctcttcttcagctactaaagttgctggggaggtccagtgccaggcgtggtggctcacacctgtaatcccaacaatttgggaggctgaggcggccgatcgctcaagctcaggaattcaagaccagactggggaacatggtgaaatcccgtctccatagaaaatacaaaaaattagtcaggcatggtggcacgtgcctttggtggtcccagctactcaggaggctgaggtgggaggattgcttgagcccaggaggtagaggctgcagtgagcctagattgcaccactgcactccagcctgggtgacagttgagactctgtcttaaaaaaaaaaaaaaaaaagaaaaaagttgttctggattattttgggctgggtactacaacttctatgaatctctaaagtatattgtaggaagatcagtacatcagattaggtatgtttctaaaactgaaatggttagattttgcttcacaattcctgctggaagctggtgtcaattcaggtattgatggagtcaggcagcatgttcccttcccaaatattgtaaagcaaattgtttctccaaagtgaaatgtagttatacccacaagctttaaaaatttaagagggcatcttctgggaaattctcagttacatagtcactgaattggaactgtatgtaattcctgcttctctgttataacacgtgtaggcactaatatatttctctatactcattttgggggaaagagtagtcaagaagcatttaactttgtgttttgattacttagctaaacaaactgttagctgtagggactaacttaggtgaaatttattttctttgaattatagacatagatgattaatattacatatttaattttttaaagttgtctttaataaagaggcatataaatatgatttcattgtgccttaatgtaacttcttgacttagggatcatatttttaatttaatatacttaacatcaattttaagaacctaagattgtcttatgctgagtttatataggaatagagtcaactcctacatttaacatcatttctggagctgttaacactttatcataaaaaaacaagaattaataattgtgcgtgtatatttggtagtatacatagctctaagccctgctctccaggaagtcatgactgctgatttaaacataataggtccataaattataactgttaggctgagctttatttttcattgtatgttttgtaactgtttttggttgttatcttcagattatctagtaatagtcaacagtgtattgagtactttgctccagactgaaatcctaacatttttctttttcaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagaggtacagaatttatatttccttcctcccaaaccagacacagtctgtatctgaaatatctacatttccattttccttattaagtcatctgagaagtctctctatagttaactattgaagggctgataattccgttttctaagttgatcagtcctgtgatgctacttcttttccttactactggtcttctggacatttcactttttgtaagtaaatataccattgcaaaaagttaaacttggactgatacatttgttccttgtttacgccaagcaaaaacttaatggaaaaatatttttaaattgagtagcatgagattttaaaattatttatagggataaattactcatgtttggcatcaccaatcctttatctcatataattaaaatttatttgtatgcatagcttctcgtggttactgagagtgagttctagggccaagttctagatttttaataagagttggatgttcaactttgtaccagttaattcatttattagttggtttggggatatactaatgctggccaaatttaacttttgtattgaagagccattatggaatagcataaaattgtttaagtaggaattaaagttttttaaaaagttctgacttcttttctgccacatactaagcaaaagacctggacaaatctaaggctcagcttccttgtcatttgggcaggataataccttctccatcatagttatttgaagatcaaatgagatgacagctgtgtaagttctatataggaaatgatactaacctaaggtggcttttgtgtgtatatatcaccatctgctggtgaataatggctaattatttgtgcctgcaaattctggatgtggagccttaaaaatcttggatagggattaccatagaagcatttattttgtaccataattattttacctatgcctagcacagagcagtcagtgtcttcccttaaaatttcaaattcaagagttattcaatcaacaaatatttattgagagctttcctgtgttggacactattctagggactaggaatataacagcaaattagaatctcatccctcacacacgttaatatgaaaatgggaaatccttagcttctaaaaatgtagaattcttatttagaaggcaatcaggaacaacaggattttgagaaaaagtattgtggcagcagtagatgatttagcagtggcatggtatggtgaagagggtaaaaatctggttctgtcatttcatagctgtcagtctgagcaaataacttctctgacctcagtttcttcatgtctaaaaatatagatgatattatctaatcatagtgttactggcaatagtaggcactcaaaataaatgtcagtttcctttccatcttataaaatatgcttaaagtagaaataaagaggcaagaggtcagcaggacagtgtttctagtaaccctgggagaatatgttttgcttcagtataagaggaatctagataaattaatgatcaatcaaaggaaaaaagaaatatttaatgattcaagaatctgaggaataagttcaagagatctattgtacaacatggtgactatcattaataacaatgtattgttctcttgaaaaattgctaagagactagattttaagttttctcaccacaaaaaaataataagtgtgtcaggtaatacatatgttaatcagctcaatttagccatttcacaatgtatacgtgtttcttgggtttgtttgtttgttgttttttttttttttttttttttttggaagaagaagtctcgctttgtcacccaggctggagtgcagtggcgccatctcagctcaccgcaacctctacctctcaggttcaagtgattctcctacctcagcctcctgagtagctggaattacaggcgcgtgccaccatgcccggctaattttttttgtatttttagtagaaatgaggtttcaccatgttggtcaggctggtcttgaactcctgaccttgtgatctgcccacctcggcctcccaaagtgctgggattacaggcgtaagccaccgtgcctggcaggtatacatatttcaaaacaacatgttgtagatgataagtatgtacaatttttatttgtcaatttaaaaaattgatttaaaaatctggcttgaactaaaatctttagctcctattactaatttctattgcataataatattgattgattggaggacttggtcaatatcccattccctgttcattgaacagtgtcccaaatgcagatagtgactaaggaaaagcagtgtctggacaatcaagaggtgacttaattgtgtctcagaaaaatgtataatgaatgtgtgtgtgttttctggaaaaaaaaaaaaaagcttaaattatatgagatgcattccctggctttcttgctttggaaaaagccaccctcagtgagtgaatttctttcagtaagtaggaaaaaattccaaatgacattttatgtccttaaattggtaacaatggcctcttctgtggcaccatatttctctggtactgtatcactgtaatctggtactgtatcacatgtaatacttcatgtcccatgtttatttgtgtttttgtagcaagagcagtatgaaagtaccatcggattcaaacttcccagttaccgagcagctaagaaattatggaaagtctgtgtagaacatcacacgtttttcaggtattattctcacttaagtatttttcaaggataaattatttataacgtttctattttaagcctgctattaaaattcctttcattgtatgactggcactcttttatttagctcaggtgagatcatcttaagcaagacaaaatgaatccatttctctccctttgggttgaaaagtatgcctcaacatttccaaagcacctgtctgtgtatggtagaaggaagagaggagtaaggaatgggaacctgtatttaccagggactctgggattgcattaattgtagctaaagtcagtccgattaaggggagttaccctcacttacctccacgtgtgatttttttttttttttttttttgagacggagtttcgctcttgttgcccaggctggagtgccgtggcgcgatctcggctcactgcaacctccgcctcccgggttcaagtgattctcctgcctcagcctcctaagtagctgggattacaggcacccgccatcatgcccagctaattttttgtatttttaatagagacacgctttcactatgttggtcagggtggtctcaaactcctgacctcaggtgatccacttgccttggcctcccaatgtgctgggattacaggcatgaaccactgtgcccggacggaatttttatttttttgtttttgctaatttttttttccacatggaatttctctaagcaatgcttgactactttttgtggagcttttatactataaggttaaagatgtgaagctgatttttttttttttttttcgagacagagtctcgctctgtcgcccaggctggagtgcagtggcggatctcggctcactgcaaactcctactcctgggttcaagcaattctcctgccccagtctcctgagcagctgggattacaggtgcacaccaccatacctagctagtttttgtttttgtatttttagtagagacgaggtttcactgtgttagccaggatgatctcgatctcctgacctcatgatctgcccacctcggcctcccaaagtgctgggattacaggtgtgagccaccgtgcctggccaaccttgaagctgattgttagcttcactctaatgaaacccagaaagggagcacacagaaccatatttgaagcccaatagtacccgataatcagaagacagaagaaagtatttcctctgctgtttgtttgtttgtgatggagtcttgctctgttgccaggctggagtgcagtctgtgatcctggctcactgctcctgggttccagtgattctcctgcctcagcctcccaagtagctgggattacagatgcccaacatcacgcctggctattttttgtatttttagtagagatggagtttcactacgttgaccaggctggtctcgaactcctgacctcaagtgatctgctcgcctcggcctcccagagtgctgggattacaggcgtgagccactgtgccaagaggccatattattaaccccttgagttcgtttaccaagcattttctatgtgcttacccttcttgtatgcaccatgttaggcattgggaatatactacaagatagttctagtctctctcctggtggaacacccagtctagtagagaagacagaccttagacaagtaattacttgtattgaaaggaaagttggctatttatcagtttgccttttttttttttttgagacagagtctcactctgttgcccaggctgtagtgcagtggcgcaatgcctcaacctcccaagtagctgggactatagatgcataccaccatgcccagctaatttttaaatttttagtagagaccgggtttcaccatattgaccaggctggtctcgaactcctgacaagtgatccactcgccttggcctctcaaagtgctgtgattacaggcgtgagccactgcactcggcccagtttgcctttttaagaacgtttctttattatggaaaatttcatatgtagcaacagtacaataaaatccccttgtacttatcacccagcttcaataattatcaccccaaagccaatcttgtttcttctatatccctatccactccttccccctacttccgagattattttgaagcaaatcccaggcctcacgtcatttcattcataaataaacttgattctttaagagaaagagagagagagataatcctgatatcttttccttctatttatattttcatataatagcactatagcacagtcaacgagaagaaaattcaaggaaattaatatttcaattatttcaaaataaaacatgagggtacattttacacccaattaaagaatcttaattattggcattaacacatttatttatgctttcatcatctctccttctttaaaatcaaaccacaaaagtagaattttttaaaaagagcaaggaggagtaaaaaagtgatttttgaatgtctaataactgtggtatagatttcagctgcagccagtatacttacttgtaggatggcatatttaaatccattgcatcaaaataagagaataccttaaaatctaatgctcccttacataaaagtatatgtttgctgaattgaaatcaattacctcaaagggaaaaatactctctttttggtagtatttgatgtagtaatttatgtccttattcaacaaatatttattggatatcatatttatgccaggcactatgccagaagcaaaaacacaaagatgaataagccatggtctttgttctttactcctagagaattcagtcttataggggagaccagcatagaaatagattgttttaattcagtatggtacaaagagtacatagagtaccatataggaaaaagatggggttcccaactgagtttaaaaatacaccaaataacctgttaaatagattaccaggcattaattgagtttggagtgcatttgacaaaactgtcattccaggagagtggaaaaagagctctgggcttcgactttgttactgcccaatgtcctaacagctgtgtgaccttaagtaacttcttttttgaggttcagtttcctatatctataaaatggggaaaacattataaggatgtagtaaaaatactgcagtgctgtaaaaacattttgaaaactgtaaggccctttctatagagctataaataaaattaatataggtcccaactggttgctttgagaaatgacaaagaactaaaataatgattacttgattgaaaatttcttagtaactatatggaaaccctgagaattgtgaaacttttttattcttgattttgtttttaattttacagttttagaataataagatgaatatataataatatgactattacgattttccccccagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggaggtttgtattgaatattaatgatttcttgtgatcataattcatttggaaagataaaggaagtgcaattatctataagagaaccgaattaaagaagctcagggttgggcctggtgcagtggcttacacctgtaatcctagcactttgggaggccagggcaggtggattgcctgagctcaggagtttgagaccagcctgggcaacacagtgaaaccccatctctactaaaaatacaaaaaattagctgggcgtggcggcatatgcctgtaatcccagctacttgggaggctgagacaggagaattgcttgaacccaggaggtagaggttgtagtgagccgagatcatgccgttgcactccagcctggctgacagagtgggactctgtctcaaaaaaaaaagaagctcagtggtaaaatgaaagggatcttactaattgtctaatcttaatagaatcatcttaagaaaaggaaaattgagattccgagagtagtgactagatcatggttccactgctaggtagtggtggatcaaacagtaccagaattagaattataaatctaaatctatcagaatctctaccagagagtaaaaatctaatgtagtatgctgaactgaaggcctcttagcatttaaaaatagctaatatttttctgcagtcctggtaacacaggaggctgaggcaggaggatagcttgagcccaggaggtggaggctgcagtgtgcacctctgtactccagcctaggccacaaagtgagactctgtctctaaaaaataaataaataaataatagctattttctatagtagaaaagaggaaaagggtctgccttactacaacaatctttttttttttcttaatttttttattttttgagatggagtcccactctgtggcccaggctggagtgcagtgactcaacctcggcccactgcaacctctgcctaccaaggttcaagtgattctcctgccttagtctcccgagtagctgtgattacaggcgtgtgccaccattcctggctaatttttgtatttttagtagagacagggtttcactatgttcgccaggctggtctcaaactcctgacctcaggttatctacccacctcggcctcccaaagtgctgagattatgggtgtgatccaccatgcccagccatacaagaataatttaaaaagaagtttgccacgtggcaattatggataggaaactccaatatcccattgttggagtctccgaatgtttaaataaaatagggaggaaatacacaaatttcgtgattgtatatactgacagaagatctgtctgaattgatatattgtgggaggatcttctaagttagcatttgagcccattactgaaacgaggtaataagctacattcagttccttatgtcactaaaaaaagagtggctaataaataaaaattcaggctgggtgcggtggctcacacctataatcgcagcactttgggaggccaaggtggatggatcacatgaggccagaagttcgagatcagcctggctgacatggtgaaaccctgtctctagtaaaaatacaaaaatcagctgggcatggtggcgcacgtctgtaatcccagctacacaggaggctgaggcatgagaatcgcttaaacccgggaggcggaggctgcagtgagccaagattgcgccattggactccagcctgggagacagagtgagagtgtctcataaataaataaattaaataaataaataaataaataaataaataaataaataaataaatgttcagaagggccgggcatggtggctcatgcctgtaatcccagcactttgggagcccgaggcaggaggatcacttgaggtcaggagttcaagaccagcctagcgaacagggcgcaaccctgcctctactaaaggtacaaaaattagctgggcttggtggcgcacgcctgtaatcccagctactcaggaggctgaggcacgagaattgcttaaacctgggaggcagaggttgcagtgagctgagatggcacctctgtactccagcctgggcaacagagtgagactctgtctcaaaataaaataaagtaaaagatataagttcagaaggcaataatccaaatagggtattattgattacctttattatttgttaccagtgtacaagcctatgctatctactgtaaaagcaagatacatgttgttatgtgcatatatagtgtgcagagtgggacgccgtctcaaaaaaaaaaaagaagctcagtggtaaaatgaaagggatcttactaattgtctaatcttaatagaaccatctattaatagaacaggttaaggatttgggttctggaatcagacagacctgattccaatatcaaccctagcatttatgagctatgttcctaggcaaattacttcatttctctgtgcctcagttttatcatttgtaaaatggagatgatgatagtatcatactacctcaaagagttttcatgaggaataaatgaggtggcatatgtatggtatttagcacaatggctgccacttaatgagttccccccacaaaatgttagctatcattaagatgctgtttttctggctgtaacatttgtatcatctggaaccatgctactatattctggtttgtagatgtatgcagaccctctcatgagatatgtagaccattgtacagcagccatagtcaccatttggaagttccctactaattgagcaagtatttctttccatgatgtgaggaaattttataatagaatgtgaaaagatcatttttacaatgttcctcttggtttcatagtttagtcatctcttgtgctaggtaatgagctaggtgcaagagatattatagtgagagtccctgccctcattcaattcttaacctaatggaggatattataatattcatcatagtggaagaaacaaggcattatgagagcatatgtccttaatttagaggaatcaggaaggggtcagccacatttggaaaaaagatcacctaagcagtaggacttttgtgcttccatactgtgagtcatgcttttttgttttttttgttttgttttgttttgttttttttgagacagagcctcactctgtcacccaagctggagtgcagtggcacagtctcagctcactgcaacctccgcctccaagattcaagtgattctcgtacctcagcctcccaagtagctgggattacaggcatgtgccaccatacctggctaatttttgtatttttagtggagatggggtttcaccatgttggctaggctagtcttgaactcctggcctcaagtaatctgcctgcctcagcctcccaaagtgctgagattatagacatgacaccccccaacttttttttttttggtgtttttctactctcctgaggggctgttttaatagtaacaatacaaggcatgttgcatgctttgtcttaatcttcatgaaaacactatgaactaggcttggagattaaaatgacttttcataagacgtgacatctggtaaatggaagtgctaagagtgaaattcaggttggtttaactccaaaactcatgttctttcagatacatatttattactttgttcaacaatttttcctatgggccagatggtattccagtcactagagatacagccgtgagcacacaaacatagtctctgccttcatggagcttaccttctgtcattggaaacaaagaagaataaaacaaaataatttcagatggtgatgaatgctgtggagaaaataaaacaggatgagggatatagactatctggggatgggggaaattaaggagtatttcagattggatggtccaatctaatttagaaggcttctttgaggagcttcatttgagctgagacctgaattatgtgaaggagccggccatctcaaaatctggggaaagagccttgcagaagagggagtagcaagtacaaagtcctgaaggtaggaatgagcttgccatgtgtctagagcagtgctgtcccatggacctttctgtgctgatggaaatctttcattttgtgatatccagttcagcagccaatagctgctaagctaagaacttgaaatgtggctatgtgcctgaggaacggaattttaattccaatttaaatagccacatgtggtgtgtagctcacatatcagacagcataggtctagattccagaaaatgaaggggcgaggagtacaaaataagtgaggtcggagaagtaggtgggagccagattgtatagggccttgtgggtcacagtaaagagtttagattgtatttcatttgcactgggaagctattagagggagtgatgcaatctgaatcccatttttaaaagatcgctgacagctgaatagtccattgaagtgtcagtgaaaagcagggcgaaggctgttgcagagtctgggacagcctggacttgagtgttggcaacaaagacagggaaaagtagtcagggatacatttggagatagggctgactgaattgctgacaaattaagtattggagatgataaggaaaagaaactcaagttttattgcttggcttaatcatttagtagaatgagaaaatctgggagagtagcagagttggggatatggaaaataaaaactcctactgtggataagttaagtttgaggcataatcatttaatcttcatgtctttgccatattcagataacaatatcaggcatctccctccttgtccagtaaatcaccttacttctagtttaccttatgtgtggggaattatctttttatccccatttttcaggtgagaaaactgaggttggaaagtttaagtgacttgttcagcatctcacagacagtaagttgcaaactatgacaaaaatccaggtctgtctgatagcatgttccatggctttccttgctaaatggagtttcatggttatatagatactatgcctgatgtattgtcttttcctgatagcaaagataaccaaagagtcaagtgttaatgagctttggtaccttgaacaagttagaaagctttacagaaatcacatcttgactgccttattacatttatattctgaatttttttttaagatgtatggtcttaacttttcatggtaattaccacagttcttgctacagtgtatttaataaataaatattggctggatgtggtggctcacacctgtaatcccagcactttgggaggctgaggcgggcggatcatttgaggtcaggagttcgagaccaaccaggctgacatgttgaaaccctgtctctactaaaaatacaaaaatattagccagttagctgggcatggtggcacatgcctgaattcccagctactcaggacgctgaggcaggagaatcgcttgaccccaggaggcagaagttgcagtgagctgagatcgcgcctgcactccagcctggatgacagagtgagactccgtctcaaaaataacaataaaataaaataaaatatcattctttccctactgcattccagtgtcacctttgttataaatcaggtgaccataaatttgggagttcatttctggtctctctaatctcttgtattgatctttgtgtatccttgtgtcaataccacactatcttaattattctagcttttataagtgtttaaattctctaacaatattctctaagattatcttggctatttttagcccttagcgttatcttatatattgtagaatcagattttctatttccactaaaaaagtcttaatacttttattgggatttagttgattatatggatcagtttggagataattggtattataatattgagtcttctgattcacaaacatgctataaccctccttttgtttgggtttcctttaatttctctcagtaatgttttgtgatttttggtgtaggtaacttgtgcatctttcattagatttattcttacagatttgatgtcatttgctattttatattaatattattagatagggtctcactctgtcatccaggctggagtgcgatggagcgatcacaagtcactgcagcctcagtctcccaggcccaggtgatcctcccacctcagcctcacaagtagctaggactacaggtgcatgccaccatgcccagctaatttttttttttttttttagagacagggtccttgccatgttgcccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaggtgatgttaaatgttgctggctcagacaccatactttgagaaccactactctaggccagtggttctcagattcaggcatgaattagaatcatttgggtgctcattaaaccaagacattctagaacctcgcctccaaattaattccatacatctgagagaagctcagggatctacatatttaatgaacatcctcagtgattcgatgtaggtgatgctggctgtgaaacaggacttgctgcccactgctctatattttcaaatgttactgcatgttaggaaaatcaatttctttttctctaggggctatcttttgatcttaacagtagcttggatatgaaactttattctgagggtggaagacctcccaggcccaaatgatcctcccacctcagcgtcctgagtagctggtaccacaagttcacgctaccgcgcctggctaattttttttttttttttttgtagagacaaggtcttactgtgttgcccaggctgatcttgaacacctgggctcaagcagtcctcccaccttggcttctcaaagtgctgggattataggtgtgagtcatcgcacctggcctagttgtgtttttctaggaaatgtgcattttatctaaatttccaaatatatttacataaagctgggtatcttttcaatatctgtaagaactatagcagggtccacttttgcattcctgatattggtaagttgtacctttttgtttcgaatagccttggtagaggtatattgattttattaatcttttcttttttatattgtaaattgacaatttatgtatgtatgtatgtatgtatgtatttatttatttttgaggtggagtttcactcttgctgcccaggctggaatgcaatggcgtgatctcggctcactgcaacttctgcctcccaagttcaagcgattctcccgcctcagcctcccaagtagctgggattacaggcatgcgccaccatgcccggctaatttttgtatttttagtagagacgaggtttcaccatgttggtcaggctggtctctacctcctgacctcaagtaatctacctgcttcggcctcccaaagttctgggattacgggcgtgagtgagccaccgagcctggctgacaatttataattgtatatatttatggggtacaaagtaattgtcttaagtttttcaaagaaccaacttttggttttgttgtttttttcctattatatatagtttaactcatgccagctgatatctttattattttctttttttgagacggagttttgctctcgttgcctaggctggagtgcaatggcgtgatctcggctcaccgcaacctctgcctcccaggttcaaacaattctcctgcctcagcctcccgagtagctgggattacaggcatgcaccaccacgcccggctaattttgtatttttagtagagacggggtttctccatgttgaggctggtctcgaactcctgacctcaggtgatccacccacctcagcctcccaaagtgctgggattacaggcgtgagccaccgcgcccggcctattattttctttacgcttttattgagcttttttaaaaaaaattcttgaactagatactcattaatgttcattatttcttacaacttaaccttagaatgtaagtgacttgcctaaggttacatagctagttggaaagaattagaagggaatccgggacaattctcctaggcccatgctttttactcttcaccatgatgacttcttttttttagaaagagtagaataaaagttaatagtcaatattccttgagcacttagtatgttccaggcactgttctatcttttaagtatctgaagtgcatataaactgaataggacaatttttttttgtagttctgtttttaaatgtcttatttttctctttgtactatagtataaaaagtggaaatatgtctgtgtaactatttttccctcctttccttagatacttctctgtgctccttaaaagatactttttcccgttgagtcacccctcccttttcaaaagattaatataactctgtaagctagagatggtgtatcagggaaacttttacaagaattgctttataaggggtcttattttaatgataaaaatgagcattcccttcctcttctgttatgtgtggtgcttagagcatctgcttcaccagctggagtaccaaaactggttcagatcccagttttatgatagagtagtaagttgcaagcgtagctaataatgatgacaaagattatatttttcttgcactttttgcttttcaaaccatttccatgtattcctatttaatactagcaacttagtcaataagagaaaacatttaggaattacagttttactcatgaggaaactggagcacaaaagaaagggccacacaaccaggtagttcatccattcagtgagcagtggttacagtgattcttgccaggggtgtacatccttatcacctttggagctttaaaacaaaacacatgcccaagcctcactcttggatagctcatctcactagagtgggcctgagcatcatctgatttttttgttttttgtcttgaaaaacaaacattgtatcagaggacacaaatgatttatgtggtcctctgataaaagaaccaccctaccgcatactagcagaaattgtgctagtaaataacagctagaagtagaagttgtttgcctttactcagtctgatggtttgaattttattctttactgctgtagtatataactatctaagtttctgttgtcagccaagagcaatatagtattgaagttagtgggtcaccatcagcatttttctttatgtagaccctcagatatgggagatactggatttttaaagttatgtattgtctatatatgcaccaaaatcttgtaaatattaacagctgaattaataaaactgaagacccacacatcttaaaaagcaatccttacccccaacactgtgaatatactaaaaagcattgaattatatattttaaatgagtgaactgtgtggtatgtgaattgtatctcaaaaaaagctgttaaaaaaagccatgatcactaccatgatattatagagttaatatcttccatattttacagatgattaaactaaagtttgtaagattaagctccacgccttaggcacactactatatgtgactgagtgtgggcctaagactcgtgatttggcttttgcctctgttccacgcagcctttcacagccagagctttttattgtaatgttattatttttccaatctgtgaactctgtttctgtcagtttccacactaataccttcttttccacatacagtacagattgccaaggctaggaatgctgaagacataaatcatttggctctgcagtattagtactggattgaaaccaaagacaagtggcaaaataacacatggtgaaagcatgggctaagtttctatgatgccaggcatagttgaattaattctttgagaggaggtgtgaatacacatgtataatgatacttaaacacaactgtgagcaaaatattttgtcacattcccctgtgttgtcaggtttggtctgccatctgccactcttgcagtgactgcttaaagcacccattagtagtagctctgtgctaatccagagttattactactaacccagtagtagcaatctgtgcaagaggccgcagatttttcatggaaagataaaggagatcctttttttttttgagacagagtcttgctctgttgcccaggctagagtgcagtggtacgatctcggctcactgcaagctccacctcctgggttcaggccattcacctgcctcagcctcccaagtaactgggactacagacgcccgccaccacgcccagctaattttttgtattttttagtagagatgggtttcactgtgttagccaggatggcctcaatctcctgacctcgtgatccacccaccttggcctcccaaagtgctgggattataggcgtgagccaccacgcctggctgataaaggggattcttgaatttctgctgtttttcctatatatccgctaaggaattagttctttcattggaaattatgacagagtaatgagcatttctttctttttctttttctggttttttttttttttttttttttttttttggagacagtctggctctgttgcccaggctggagtgcagtggcacgatctcagctcactgcaacctctgcctctcgggttcaagtgattctcctgcctcagcctcccgagtagctatgactacaggcgcccaccaccacacttggctaatttttgtatttttagtagagacgacgtttcaccttgttgaccaggctggtctcgaactcccgacctcaggtgatctgcccacctcggcctcccaaagtgctgggattacaggtgtgagccaccgtgcctggccaagcatttctttcttaatattgttgtatgaagtagttgggaatttaaagtttttatctgttcagattcatggaattcctttatctgatccttacagtttacaaatctaaaaatttcaggatgaatcatgttcagttatagtcagtttaagaatgcaggaaagtctataataaaaattattgatttccatgcaaattgattaaaatataagagtcttggctgggagcggtggctcacgcctgtaatcccaggactttgggaggccaaggcaggcagatcacttgaggtcaggagttcaagaccagcctggccaacatggtgaaaccccatctctactaaagatacaaaaaattagccaggcatggtggcatgtgcctgtagtcccagctactggggaggctgaggcaggagaatcacttgaacctgagaggcggagattctagtgagccgagatcatgccattgcactctagcctaggcgacagggcaagactccatcttaaaaaaaaaaaaaagtctcagtacaaaagaggataacaatatgttatcagaaatactaaatcatgcacaaaaacactttcattcctagatactgtcagataagtgaagttttattacaaagtgtaaatgttttatatccctgaaagaatgaacataaaaaccataaaaagagtatgagtgattgttttgaagtaagctgtctaaaacttagataccaaatattccaaaacaacaattggctctttgaaaagatcaagattttatcataagtctgtatagtttattctctctaaaacagtctatacaacttttcccctaaattaaggtttctcaacctcagtaacttcagcctctatgcactggatgccagtacctcccgtctctcccctcctctgttacaacaaccaaaaatgtctccggacattgccagatattctctggggacaatttactccagttgagaaacactgccctaaacatattagagaataagagctgtaatacaaattggtaaggctgagagatagtaggacagaactcaaaagatatttttgtttaggtttgaggactgacagtcaaagattttgaatttgtgttattttaatcaaatgatttattattaaaagggagagcatctggttcaaatatttgtccttacaagcatcagaaagtagttcatgtcttaccagaagagccatttatcaagttattttgtaatcattccaaggaggcttacagaagaaatcagacttaattcttttttcttacaatatatttttaggttcctgaaataacctaaaaatgaacacatctttatttttaaaatgcctcatggaagaaatcacatttagttaaccctttttttcctgccatagacaacattgcaggtttttgaaactaaaattacgagataaatggattttctatttcttttctttgatcttgtctcccctgaattcagcattcatggaacatgatcattaacacattttagcctttctactgagggtacatttaacttccttgttgctatcagttccctggcagagcactaatgatttattttttaccctctgtgtgatagcccactacacactctaacattcgtgtgtatcctggattcacaattattttgcctggtgactttgaaataatacagtagctctggcctttacttatgcttcccttttccctttctcacatagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtatgtcatcagtccaaatacctagctaactcactttctgatttagaggccttaactttttgaccaggaacgttttcaaagcaattgcttattctcatagactcaacaaagttattcttcattctttctaaatgaagatgtctcccatgaacctataaaatattttcgtagagttatgtcagtaagactgtaagctatctcagaagttataaggtgacccactccttgacccaactattatttttatttatttatttatttttttgagatggagtctcgctctgtcacccaggctggagtgcagtggtgcgatcttggctcactgcaaactccgcctcgtgggttcatgccattctcctgcctcagcctcctgattagccgggactacaggcgcccgccaccacgcccggctaattttttgtatttttagtagagacggggtttcaccgtgttagccaggatggtcttgatctcctgaccttgtgatccgcccgcctcggcctcccaaagtgctgggattacaggcatgagccaccgcgcccggccccaactattatttttttaaatgatcttataaaacacaccagtatgattgatcctctgctttttaaaataattttactcatctagaaggaatctccacattgctttttaagactaagctctgctattgtgattaaaataaaattttattttctaagatggatgtatgcacatttccaaagaactggtattacataaagcgcatctgtgtggttgctcaaatcttaagtacctttacaaaaaggagaagattcattatgtaggagaggttgtactgctgagttgcctatggttctgagttaattgcacccacagtcactgcactgtgttgaaaaatcaccaatttaattagcagatttcctagacagtgactagactgaccttttatatgttaagctttgtaaacacatttaagccgtgatggaatcgaagtgctagctcagatttattgaaataaatatagctcttgctgttggcaacaggaattatgagaagcagtcttcataagaagaattacatttttatatgtctgttaagaaattaaaaaaaatttttttaaccataagatcttagtaagtgttctcgctttggcagatggattaaccttgttcttttggagccagatcaatatctagtttatctctagagcagtggacagtctaactatgttttgattatattaaaaaaaaaaaaaaaaaaaactgttaggccaggtgtggaggctctcacctgtaatcctagcactttgggagagcaaggcgggcggatcccttgagcccaggagttcaagaccagctttggcaaaatggtgaaaccccatgtctacaaaaaataaaaaaactagctgggtatggtgacgcacatctgtagtcccagctccttgggggactgagacagaaggatagcttgaacctgagaggttgaagaggcttcagtgcaccgagatcgcccactgcacttcagcctgggtgacaaagtgagacgctgtctcaaatagtgaagccccgtctttactaaaaatacaaaaattagctgggcatgatggcaggtgcctgtaatcccagctactggggaggttaaggcaggagaattgcttgaacctgggaggcagaggttgcagtgagcccagatcacaccactgcactccagcctgagtgacagagcaagactccgtctcaaaaaataataataataaataaactgttaaatatgacatacagtgttactgtccatttgggactaccttgagtccagagagaaaaacagattgagtgaatggtaggtgtttacatttttgtacctagccaaatgtttatgacattggtcatcaggttcactgtcaacaatgcctgtttaatgttagactacctcttcagttcttaatgttagaatatctcaccaggcacttttgactatccctctatttgttatactaactaaaaagtgttggattactggaattgtcaggggaatcttcctagtggctaagattcctctggctttctgctgactcactttttctcctttttgcctataacacagacataaataccttcaacaataggctccctttgctcttgggaacttggcagagtgaagagatcactacctggtatatgctttccattttaagtgccaatagggggtctttgttgccaattaattctacataaatatatgattcgagatacttgtgttgaaatgagactgaaggccacctctgataacttattattgtaatagtggtggcagaattaagggtgactctgagctgattttatacatagcagttagaaaataactatggcggcaggcacggtggctcacgcccgtaatcccagcaatttgggaggccaggacgggtggatcacagcctggccaacatggcaaaaccccgtctttactaaaaatacaaaaattagctgggcctgctggcagacacctgtaatcccagctatttgggaggctgaggcaggagaatcacttgaacctgggaggcagaggttgcagtgagctgagattgcgccactgcacgccacgccagcctgggcaacagagcaagactgtctcaaaaaaaaaaaaaaaaaaaaaagggccgggcgcggtggctcacgcctgtaatcccagcactttgggaggccgaggcaggcggatcacaaggtcaggagattgagaccatccctggccaacatggtgaaaccccgtctactaaaaatacaaaaaattagccaggcgtggtggcaggcgcgtgtagtcccagctacttgggaggctgaggcaggagaatggcgtgaacccgggaggtggagcttgcagtgagccgagatcgcacctgcactccagcctgggcgacagagtgagactctgtctcaaaaaaaaaaaaaaaaaaaaaaagaaaaagaaataaccccaaaccgttaattacccctggtagttaaagtgctgtaatggggtgtgcttaacttaacacttgacagtgtcactaattttggtgctctcttaggttttttagactcagtctagggaaaatagcacaatgacattatactccaaagtaatgctgcttagtgtgattaaaaagaatatcaacaccacagattgatgaggttctgtaaagaacttaatgatacaaagtgatttagcccttagtaaaaataatcaattttttaatttaaaatatccaatgcttgggcattgctccctctattatgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatccgcccacctcggcctcccaaatgctgagtattacaggcgtgagccaccgtacccggctggcctcaattcttaaactgaagtagaggctctcagttttctgctattggattgataaagatccaaagcaaaaagaagtcattattcacttgaacaaggaatttaagctttgtaaaataatttaacactattgtttgctaaatgtacaattctgggaagacatcatctccattttgtccataagaagtttaagctctgaggggtaaaaaaaacttgttaatgaccacacagcaagtatgctgggactcaaagtagaaatgacccaaaaccagccaggcgcagtggcttacgcctgtaatcccagcactttggacggctgaggcgggcggatcacaaggtcaggagatcgagaccatcctggctaacacggtgaaaccccgtctctactaaaaatacaaaaaattagccaggcatggtggcgggtgcctgtagtcccagctacttgggaggctgaggcaggagaatggcgtgaacccgggaggtggagcttgcagtgagccgagatcgcacctgcactccagcctgggcgacagagtgagactctgtctcaaaaaaaaaaaaaaaaaaaaaaaagaaaaagaaataaccccaaaccgttaattacccctggtagttaaagtgctgtaatggggtgtgcttaacttaacacttgacagtgtcactaattttggtgctctcttaggttttttagactcagtctagggaaaatagcacaatgacattatactccaaagtaatgctgcttagtgtgattaaaaagaatatcaacaccacagattgatgaggttctgtaaagaacttaatgatacaaagtgatttagcccttagtaaaaataatcaattttttaatttaaaatatccaatgctttgggcattgctccctctattatgctccctcttaatagtctgttttttttaaataattgctccattttctatgtataaaatgatgttactaaaggtatttcaaagctaggcaggagaccttagctattccctttctgctattaatatcaaggatgaatcttgcccttctaccaaacacataggctccacctccctagaggagattgcagtgtgttgaatgttgcagctgaatcctgcatgtgcttgtttataagccagccctgggagtaatttcatgtgtcagttacaatttaaattgggtttattgtaatgttttgttgtgtaataaactgaagaatgaagtgcctctttaagtatattgttcaactaacaaaatcctttgtgtttactagtttggtgtcatatgtggtttattacatgtgtgttttaactaaagattttctttttcttcctgtcatatatgtcatacgttgataacttcatatgtaaatttgtttttaaatgttatttaaagtatttccagatcagtttttaaaggcaaaacaaaaacatgggctattgcattaaataagcctaaattattcttttagtgggtacttttttataaataagtataaaaatatattttcttcatcaatagaatacttaccttaattttcttttttgataatttggatatccatattaccttttcagccttgaaaatgtgatggtaaacacagatgacttttgggagtaatatccttccctgtaacaccctccataagactgcatcatgatgattacgtatcagcgtatttcacaaccagcttaaagatgcagcttatttggaaacaacactattcatagaaacctactaacctaaaatgtttttactacttttatttcttaaatgtaggtggaaaaaacccacatcgaggtgacagtacccacctcaaatggtgaccaaacacaggtttgtgccaataggccacttgttcctctttccctccaccccctcagtttttttcttctcccttactcccttttccttaaaaaaattataaaatgaaggttcaaacaaacttcaatgagcaacattttatcatttttctttcttttttaaattatggcaaaacagaagcttgcagaaaaaactgaagatctgataagaatgaggaaggttagccatttttcactttcacaaaactacattgccatttcacccatgctgacttacagtgcattaaaaagacagtgatccattcttttcattgatttcttttaatcaggagttgttaatagtttcaaataatggatatgggccaggagcattggctcacacctataatcccagcactttgggaggccgaggcaggaggatcacttggggtcaggagtttgagaccagcctggccaacatggtgaaaccacgtctctactaaaaatacaaaaattagccaggcatgttggtgcacgcctttaatcccagctacttgggaggctgaggcatgagaatcacttgaacctgggaggtgtaggttgcagtgagctgagatcgtgccaccgtgctccagcctgggtgacagatatacacatatatttacataaactgaagaaaccataatcctgtactatatgttgaaaagtttcattaaacttttcagtagcaaaatatgtttttaagcaaaatgaaataatcagtgagagtcaaacctatcttttgtatttaaaaatttataagaactatttcacaatgacatcatattcttggaataattgataatattttatatacatttatcataaaatgaaaaccatcatagctggctgtgatggctcacacctgtaatcccagcacttcgggaggtcaaggcaagaggatcccttgagcccaggagttcaagaccagcctgggcaacatagggagaccccatctcttcaaaaaataaaaataaattagccaggcatggtgatacactcctgtggtcccagctgcttgggaggctgaggcaggaggatcacttgcgtccaggaggttaaggctgctgtgagccacagctgcaccactacattccagcctaggtgacagagtaagaccctgtctccaaaaaaacacccactgtagcagcaactcccagtactgtgtacagccgacttctctgtgcctcattcttttcatctatagagtgggatgaatcagtctgaatcagttaactgagtatatttattggctgatcatgtataaaatgataatctttcttagatcttttttataaaagagatctaatcttttattagattttataattagagatctagatactgcagtgtcactaagtataaaatacatcccaaaagctaaataatgtttttaaagcatttcttcactccatgatacatggagtttcagcgttttttagtcatatattttaaggtaaccctcaaacagttcaatttcaaaaatgaagataaaacagcttgttacataagaagccaatgaagccaggagcactgtctatttaaataacatcatcacattctttcatcattcatgaaaaaggtcatcattttcttgtggtaatcatgttctgtgtccgtgtgactctctgaccatttcatgttggcatatgctgcgctgtggacatttatttttaaatattttttggtttgccaattttcagttttttcccgcaagaacaacattttaattttttatgcttttctgttttcccccctttcattttcacagaaaaagagagaaagactagatggtgaaaacatttatatcagacatagcaatttaatgttggaggtttgtatgaacttgaagcttatttcagttggttgcctggaaccttctgcattctttgctgatccccttttcttcattctgtgctgcatttggttttgcatgcaattgcatgaagggactttaggtttaaaatgcttttgcatgttggtgaacatgaagatatgcaaacatctcgccttctgattctttttagtttctatctgtcatacttacctggaaaaatatatgattgggactacctctacctctcatggttccattgttttacccacctttagaaaattctacaccattgctaaaagttcctttaattttccaagagtataaacttccatatgtcccaagatgcaaatttgcactattctttcattttctgaattaagagagtgtgaaaaagaagggaattcagaatggacttaaaatattggagataatagaaaaatgacagaagaactgtcggggaggggcgggaagtaagatataagaaggaaagaggggagcctagcatttaataagtagttactataagatggtttaatcataaaaacaggcctgtgggtatgggattgttattttaaagatgacaaaattgaacctcaaagagattaagtaatttccctgtagtcccagaactggaaagccaagatgtgagttaggatctgtccaactctattaaactacactgttttgcactctgaaatagcaacatgctgtctgctataggagttgtaagattattttcccattatattcaacattggtcatatatatataaaatttttattttattttattttatttttgagacagagtctcgctctgtcggccaggctagagtgtagtggcgtgatctcagcttactgcaagctccgcttcccgggttcacgccattctgctgcctcagcttcccaagtagctgggactacaggcgcccgccacctgtctggctaatttttttgtatttttagtagagacggggtttcactgtgttagccaggatggtctggatctcctgacctcgtgattcgcccaccttggcctcccaaagtgctggggttacaggcgtgagccactgcgcctggcctttggtttttttttttttttttttttttttttgaggcgggtctcacagtgttacccaggctggagtgcagtggctcaatcactgcttactgcactctcagcctcctgggctcaagcaatcctcccatctcaatctcctgaatagctggggctatgggtgcatgccacaatgcccagctaatttttaaatttttggtagagacaggatctcagtatgttgcccaggctggtcttaaactcctggactcaagtgatccttctgccttagcctcccaaagtaccggggttacaggcatgagccactggacccaacctaaactttaaaaactagatagacctctggcttaatatatagcctctaataattatttaaacctcatcttattccttgtcaatacctgtattttgagtacttgttatgtataaagtctctgagaaaaaaatatgcccagccttcattaaacatgtattgcgtggtgggtgaaataccaagtgctttacatatctttgtctcatttaacatgaagtttttcgaggctggaccctcagatatttcaaacttggcaactggatctctttgttttagcccatatctgaaaccagacctgagtagttccatcttcagagactaggaagaatagtgaaggtcagttgatttcctttatttggcagtgtaacatcttgaaattctaaacatgcatatttcctgactagttcgtcttcagtgcttcctcttaactggaacctgcagtaccaatcatatatttgtcatttgttccatgaggtgtgttatggcttctgagactcacaaagtccctgtgtgtgatgtgtttttccctcagcatttcattgacagccctgagaggggatttctaaataagtgtgtttggaaattaaaaccactaactgccttttgagaacattttatatttaatgaagtgtttggtttgattgctgctaaaattatgaagtgataggcatcaaaaagtgtctaacctgaacacagccaaagtaatttggccatcattctttagaagttttttcccctgtaaggaagttctctcaagttatctgtcactccagcaggtttttttttttttaagcatccctcctcccccttctcctaccccgcccccactaatgctttgttctggcacaaataaggtcgagttcatttttagatctaccgcctcctcctccatctcccagagagaacctgtagcaagttgtctatgacaaattctatttggaacaggtccctttgagatcttaattttactctgtgcccccacaggttttcaacaaagccagctaagaaggatggagaaagctccctcagaagctactggttttaccaaaacatttattttcccaggttccaagccaatccgaagctaggcaagaagagtagcaaattacaagtctcttacattaagaggttaactaagagagttatcattttacatagcatctcttgcttatttttgttttgctctattcacacctttaaccctcccaaatgtattaggttgttcttggcccaaacagattttaatttccagtgaggagctgggtcacaggaccttacatgcctggtgggtctggttgctcagtccaatactgggtctttgaatgggcttgttcatgcttttctttagctactagacatgcttttcttgctttcagccagaagaaaagtgcaaactgttgtttcccccatagtgaagtccatattcataaaatatattcacatttcatcccagcaagcaaaacatgctcttctgggatagctataggattgcccttttggagttagctttctgtttgatctcaaagcaggtatacatggttcagtcttgcaaaaataaaaagaatagactaatgaattttctgaatgaatatctacagaatcaaaatcgtctcactgattattcttcttatgctgttttccctttgacattgcttttgaaaaagttttatttagttaaaacctgtattaccctcagaaaaaacttttaagcaaaattttatttaaatgaattataattttttaccccaatacagctgtttcctacagagccaaaaaagaaagactaaatccaaaattcaccaagcatattaggagatgtatttagcattatgcttttcttggatacaaagctgccttgatatataataaacacagaattttttacagtcatcaagtgatgggctcccacatgttttgatctcaagcatagatcttttaaggttttttgaagtattgttggacaaagaacatttgagtttttgtcttcaagttatatttaccatactatttttggccaagtcccctttttgaaagttgttatatacctccttttacataaacctgaatattatttctaactcatgctttattaacctaagcttcattcatttctccctggaatatccctttaatagcttgcctgtacctcaggttgcccagtattcaaatttgctaggatatatacctactatatacccacaaaaattaaaaaaaaaatttaatctgctggaacagttgaattattttaaattgtcaaggagatatataaggtatttggtgaactcttgttaactcactctcaatcctttgaaggttattgcaagaagtccctgttttgagctgtactaagtgatgaagtgaagctgttagaagctagaaagcctaaggcgtttagtttatgtgcatattgttgacaaagaaaaaaagtcattttattatgtacctctgagtgatttttcagaggtagtaacagtctgctctggagcctttaactaggaatttcagtaataaattcttacatcaaaaaagggctattcttgttttttaaaaagcagaaacagccacctagtaatagagaagtaaaaccatctccaggtagaaatagaaggatactgtatgtttgcaactcaacaagacaagacagccaatggtggaagttgtatgtttcaccatgccttcattaaacagtttgtttatctgttgctatctccatcctcctaagctgagcctaaaataatttcttatcaagctgaggctaattgagttgtggaactaccttcttgggatgagaagttagagatctgctgctgtgtcataatgggaagaagaatcataaattaaggcgtgagttctttatgggttatataactgctaacagctatggagttgtgatacttcacagcttctaagaaaagcactttatttaaagaaaaaaaaggcaagcaaatataccatgttgtatatttataatctgaatgcagattagtaacatctgtcctggatgtggtatgttttctaccagtgcccagtctctgacgggttgcccttgattatgttctttgtcctgattgtgtattgttttgcatctttgtcctttcaactgtaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggagtgagtactttgtccacatgaccaattgtgaaaatggagggaataaatgtttttatgtattaatattctgtatctgagagaaagcttagagctgaaatttggatttggtgcctcactatattcattgctgctttaaggcatttgtaatcaaatatttatttttttttaagtcaggtaggctacccagtgcaattataggagctatttggagccaccagtagatgattagcctctgagaactgtctctgcagctacatgcttctggctaatgtatgtttataaactgaccataagccagtagaggtttatttgtattcaaactgtgccttcagggactagaaagtttactaaatttaggaaggtcaaaataggaaagacattagtctttttaaaaagctttatttgaacatttgcacaacttagaaatatctggactggttccccacaattatatagtaaaccaaggaggcccctaagccagagaattcagaattccaaatattaatgattgtatttcaattttagaaaaactatgggctgggcaccatggctcatgcctgtaatcccagcactttgggaggccaagacaggcagatcacttgagtccagtagtttaagaccagcctgggcaacatggcaaaaccccatctctacaaaaattagtcaggtatagtggtgtacacctgtgtagtccagctactcagggggctgaaacaggaggattgcttgagccaggagaccaaggctgcagtgagccatgattgcaccactgcactacagcctgggtgacagagtgagaccctgtctcaaaaaaaaaaaaaaaaaaggaaaagaaaaatgatttattttatctttatgagtaatattaaacttttaatacactgttttgtaagatagtcacaattagaggtcagagatacctttcaggggctcttctttttctgttattgtcattacctattttagaaatcctacatctgggccgggcgcggtggctcacgcctgtaatcccagcactttgggaggctgaggtgggcggatcacgaggtcaggagttcgagaccagcctggccagcatggtgaaaccccatctctactaaatatacaaaaattagccgggcatggtggcacatgcctgtaatcccagctactcaggaggctgaggtaggagaatcacttgaacctgggaggcggagattgcagtgagccgagatcacaccactgcactccagactgggcaacagagtgagactccgtctcaaaaaaaaagaaaaaaaagaaatcctacatctgaataaatgaatctattaaacatttaatgaaaatatcttgaaagttaccatgaacatataccccaaaagtttttatctttagtcagtacaagtgaaatatttatatagtcacaatgactcaataagtgattatgatttaaaaattatgtgcttgtttttcccccaaaacaatagcaattctagtttaaaaaagtaaagtgatgtcttaataattttaaaactttttttttccctttctttgagatggagtttcactcttgttgccaaggctggaatgcaatggcacgatcttggctccctgcaacctccacctcctggcttcaagcgattctcctgcctcagcctccctagtagctgagattacaggcgcctgccgccacgcccagctaattttttatatttttattaaagatggggtttcactacgttggtcagggtggtctcaaactcctgacctcaggtgatccacccgcctcattctcccaaagtgctgagattacaggcatgagccaccgtgcccagctaaaactttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgaggtcaggagatcgagaccatcctagctaacacggtgaaaccccgtctctactaaaaaacaaaaaattagccaggtgtggtggcaggcacctgtagtcccagctacttgggaggctgaggcaggagaatggcgtaaacctgggaggcggagcttgcagtgagccgagatcgcgccactgcccttcagcctgggcgacagagcgagactctgtctcaaaaaaaaaaaaaatacaaaaattagccaggcatggtggcatgcgcctgtaatctcagctacttgggaggctgaggcaggagaatcgcttgaacccaggaggcagagattgcagtgagccgagatcgcgccactgcactccagcctgggcaacggcaagactccgtcttaaaaaaaaaaaaaaaaaaaattggttcacaaagggtactttttgtatttttcaaagtgtgactaaaattggctaacagttctccaaacagagctgaacagtttcacaaataaggctggagaatacctgagtaatgggcagctaaatagagttaccagggatgacaggacgctattgtttcctactcactgtcctctcagcctccattttctgatataaatggactttagttttgtgttctaaatctagagcatgtatcctgaactgagacaataactctgctttctaggcaagaccactgttttcagtgtcagtaggatacttaattttgatgtatctgtagtaacaagagtcataaagggtctagtatttctggttgtggcttgatttgatttagagggtctggctagtcaaagcctaaatgaacaattctgaacaagtaatttatcatattgggccttagtttatggagtagatgatctttaaggtccctgttaactctaaaattctgtaagtctgtgactccataagaaaatgccttgtcgctatttcacccagttaaccctatctgcaaactataactgcgtattttctagaagttttctttttgactctgtgcaagtaataaaagatactcgactactttgaaaaagtaacttggtcctctcttggatgaggctgggtaaatttgaattagtctccatttccaggaaatatcttacatcttttaatagaaacctttcagaaatcttctcagggttggttttgggaatggtgatgtcattctgtgtactttaaagaaataactttttataaactaaacaatatccatgggagtacttgaacaattttagctctatgctattacccctgtaaatgaatagtggaataaataagcactgtattatggtgacctttaatattgggtaattctactttctggcatatcttactttttctttaacaattgggatactatttccattctctggggatacctcttccacctttgacggtattgttgttgcattgcaaggcaactgaattttatataatttgtgtatgaccaggtgaagaaaacttctgtcctaccctcggaaagaaaggttggtgggccagaggtaaagctgctgttatgacttgtgcttctcaatcagaatttgctcttgtcatggcactaagcagataatccccccagaactgaacaacagctgctgaatacctttttttcttttggctatactagtaaattcacacccacagcctttcggcctaacacataacacttccactgctgcagcttttgcagctttcgatttgcttatttcggcgcatggctggttgaaaagctgcatgaagatataaatatgttttcagagagaaaatgaatttaattataccctattctttttatgttgtctttcttctcccactttattttctttcaaaaatcatcataattttgcatcctttcttttcctttttttcttttttgctgaccagtcccctagctactttctccctgatacatatcacttaggggtgtgcaaagaaccagtgttgaacttccaaactgatcagagaaggctagctcaactgagagaacttagagccaagtttttcctttcatagataacatctgtcttgactatggatagcagagtacagaaattgcagggggaataaaaacttctcaattggacaattggggagaaaaaactttctttaaaagtgtctaaagcatttgcttaaagtaatgtataaaccttcatgatggtcattattatttatttgttttggtgaaccttggagggacattataaacttttatactttttgtttttcttttgcaatctttaaaatgtataagattaagattttttatttctggagcaaaaactaattgctatactgaatgaactgttgcttttaaaactgttgtttttaaagtctatatgaagagatataaggattactttttatattctgccattatatttgtaataaaagtaactttttttttttgtctgagacagactgttgctctgtcccccaggctggagtgcagtggcgcgatctcagctcactgcaacctctgcctcccgggttcaagcaattctccggcctcagcctcctgagtagctaggataacaggcatgtgccaccacgcccagctaatttttgtatttttagtagagacggggtttcaccatgttggccaggctggtctcaaactcctgacctcgtgatccgcccacctcggcctcccaaagtgctggaattacaggcgtgagccactgcgctcagccaaaaataacttttatgatggcaaggagaatgcttcattattggcattgcccaattagtgattggcagcaccaaagtaatagaaaatgacctaaaattcatatgtgaatatcctcaaaggaagaataaataacatagcaaggggaaagccagtgattccttgaactttccgttctaatgttcactcactcaaaaaggtatctattgagcaccctattgtgttacagaaactttgccaggataaattgccaaaataaagtaaagctaaaatgaagagtgtctaaaagatacttccaaatcctttgcacatccccaagtatcatttttgagcattttccatctgtcattttgttcatcttattctgtctttcttgatcttctactgtgaaagcagacacaggaacgtgctctgttagtacaggatgaagagaaaattaaaaggcaagaaagatctactgaaagagccttgccccagcaagaaaatgaagaaattcttcccaaggtttctattccaatccctgaggatcacaagtctctcaaaaagtgccacctctactttagtacttttccatctcctcgtattcctttcatgatgtcttttctcgtgatccttgtgttggctgtttggtggttggtctttctgtgatcagaaaacagggtgctcatctgaaatgtcaagaccattgaacttctgtccttggcttcaactgtgttattgctgtatgatgccctctgatcttgatagttcactatcctaggggagctcttgtgatcatttttctgtcaaatgttactctttgtagagtatgtattgtggggtacaaaggagtagcaatggactgcccaaagccagcttttctgcattgaagtttaacaaatttaaacaaatcagaattaagcatatggcaggttggtaatcttcccaaaagctttaactcttttatcctgcatgtttactgtttactattgttatgtcttcctatccaatatctcacacaaaccaggatactctctagatacatttgatggaatattttcctaatcctctatagtcatttgtttggcatgggcttcatagtttaagaaaaaatttcaactcgctaacctttcagaagccttaaaatgataacgttttaatctacaaatccataaccactccttttcttaggatatcaaaccagtataaacaaaagtcttttctggaaaagggcttttgacttctgtggcctttttatgagtatttctgagctgtacagggacagacaactttttcctgcctggtgtatagaagagatcttcaaagattaaatgccatcttttcacaagtagagtgttgatatggtttaaggaaaatggtgctggtgccccttagcctccagccaggactgaaattctcagactactctacctatccttaaaagtctggaacacagatttactcaagatctgtacataaacccttctctgaattaagatactgtgttacttctttatggctttactaattatattgctagcagcaatagttagccattgctaagcttaaaatatatattgatatactttgttttcctgatatacttcagacctgtttgttcgtgtacttgtgttgaaatcaattgtttttaatcaatggctttgtgacctcaagttcacttgtgacaagtatgtgtcctctgtttgcatgttgacttctaagacttacctgaagtaaatgtgggcactctctctctcttcaggacacaactcacatgcctaacctgttattttttacctcaatattgaagaaaccttgcatgtagcttgctttttatggcacttgaatgtaccaatatggatgatttggttaatgtctcaaatatttgttttgaaatctgagtttatagggttatcaaactaagattattatactttgttttacttctcaatgcttttcagttgatgaaacttctaaacaagactttttgtttttgagaagatggcctcttagagcaaaaaaagagaacagtaaagacaagaatcttttgtccttcaacatctaccaatattgttctcttgtctctggagacatgtagaaataattatctgttatttcctgaaaactgctacgctgtcattataggctttcccaagaaatggaaaaagaagcaaggaccaggttaaaatttaaaatttggtgtgcgtatatatcttttatgtcacaggctatgtctatttataatatatattttgtaaataagtatatttattgattcactcataataagagggacctgaaatattacaaagctgttctctaccacagaaagtaataatcatgagtactctcttttatctgggaaataaagatacaagagtttcccttaatgaaataacaaattggactatagaattggttagattattttaaatctttttttaaggaattaaaaggaaataatcagaactttatttatacttttataactgtttcagattataattcctgaatttccagttttcatccttatacacagctttttattaattactattgtaaacttcaccctgaattttatttctctttgtattggagttattccaagtccattaaaagtctaagccaatgatacttttcagttttctgaaatgcagcaagagtcctcggagatctttattgagagtcaaaggagaggccatttcttctatcaatagggtaagaatgattaagaggagaatggccaagcccttgtattggatgaagctgaccaatgcagactcaaaagataccatcacaattatcagaggaaaaatattgggcattccagctttgtattacctaaaggtaacactgccaatatttgcaacataaagcgtaaatgggctgggcgtggtggctaacacctgtaatcccagcactttgggaggctgaggcgggcagatcacctgaggtcaggaatttgagaccagcctgtgcaacatggtgaaaccccacctatactaaaaatacaaaaattagctgggcatggtggcacacacctgtaatccgagctacttgggaggctgaggcaggagaatcgcttgaacccgggaggcagaggttgcggtgagccaagatcacaccactgcactccagcctgggtgacagagtgagactctgtctcaaaaaaaaaaaaaaaaaaaaaaagtgtaaatagtcttggtttccttccttcattttcagtaccagaggcaaattctaatacatattggtgttaccctgattcagcttcttaatggcaagctgataaataaaaaataatttggagtaaaggtatcaatacagaccagtataatattttgggtttttgctttggttttgtcattattcatttctagggtgactctgagaggttcacttaactacttggtgcccagatttccacctagtaatgtggagacaaacctacttcatgagaatgaatacgtaataaattccaggaaccagagaccctggttgtcgttcaattcttggtcttttgggagctgggaagatgaaaatttaaaaacacaaaaacatacattaacttctttttattttgaaagtaagtcgttaaatagctgtttatttccatctactccttattgatatttgaccactttactaattttccaaatttatccttctcttaataaattcatcttatccaaatggtatgattagagtggatcatacttgaaaataaaccaagcatctatattttgggcctctctttcagccagtttctttcatgctaacacttgcaatatgaagggaattgtttgcatgggtcaagttttctacttatttacatcttcagtaagagttttgaagggaaaagatgctgactctgttgattaagattagactggatattatacatggaatagatttccagttggcatcctaggacctggtacatttctttctattaaatattataaattttactctgaaacttctttggatataataacccaattcactttctcctagtttcctaagtcacttctgtaatacttcttatagataagcctgtagtacttcctatagataagcctataggacacatgaggcattagagatctaattaattttaagaaggtattatggagcagaaattacacttgtgctttacccagtgatcatgtatttacaaaaggaaaacagggcaaaattaatatgagacatggtctcattgttgcttttattttttcggcaagggttttgaatacagtaaagacatacaaaatttgttgacagagttgccttcccttatattcctcttcacaggaattataaaatcccaaactatagcattctctgcagctttgaaaaagactattatattgtttttattatacatagaaacttcacttttttttcatatactcaaattacaccgtttgtaatattggtactagaaactacaacaacttcttattaatctgttttgtgtggcatgtagcattaccatatctgcttcctctacactttagtggatagtattaataggccactctcatttctgaagctgttactcctcatgccttagtatctccttttactgtagcagaatatgacacaaaaagaaacacattggtgcagatctatgaaagcatacctgaaatggttaagaaggtatgggattagagttaggaagccatacaaagttaggctagaggaagagcagtggctatgatcaacaattataaattcatggaggattccttttggtaaacaaaactcctatcatcctagaacttgaaagacaaaaggaagataaagtagtttgttcccacatatcagaaatgcaggctaaaagccaaataacttgaataatagcctaactaaatgtatagataacattgtggagaaaacacactttaggaattttaaaaatcttttgtgtgtccaggcgcggtggctcacgcctataatcccagcactttgggaggctgaggcgggcggatcacaaggtcaggagatcgagaccatcctggctaacatggtgaaactccgtctctactaaaaatacaaaaattagctgggcgtggtgatgggcatctgtagtcccagctactcaggaggctgaggcaggagaatgacatgaacctgggaggcggagcttgcagtgagccgagatcacgccactgcactccagcctgggcgacagagtgagactccgtctcaaaaaaaaaaaaaaaaaaaaatcttttgtgattgaaatcctaggccaggtgtggtggctcatgcctgtaatcccagcactcggaaggccgaggtgggcagatctcctgaggtcaggagttcaagaccagcctggctaacatggtgaaaccctatctctactaaaaatacaaaaattagttgagtgtggtatcaggcatctgtaatcccagctcctcaggaggctgaggcaggagaatcgcttgaacccaggaggtggaggttgcagtgagctgagatcgcgccactgtactccagcctgggcaacagagcaagactctgtctcaaaaaaaaagaaaaatcctagaaggcagcagtgtcttaccctttaacatagaatcctgttttgggtaaatgatagaataactctgacatttgaaagattgaaaggtaggggaaggcatagagtctcaactatcttttcttgtctcaaaatcaacaaaggcaggtgagcctctcattttcttatctactacctcttcaaagaaaagtcttcatatttataagatcctatctcaataaaacacatagaaaaatatttaaggggataacatggccaccattcattttatttatttatttaatttgtcacccaccagcaaagtactctattatatattacaaggatgcaaagagtcagcattatcagaattttagggattggataggatcctaattcaattcctctctcttccagtgcttgactcttctctgcaatatcatttagagatttggaggccagtgttgcagtctttgtttcaatatctcctgagataacatattacatctttggacagctctgagtttgtatataaatcattcatatattaagtgaaaatctgtttccctgtagctttcactcactgatcctgaacagaggcattttaaagaattttctatctttttccacattacttcttcacatacttaaaggtaactctcatgttgaaactagtcactattcttaccctcagacaagttaccatctgctattcagatctattccagtcttcctcctagcatgtcatcctcctttcttcttttctaacttcccttgttttaacagctttttctttctggctgtgttgcccactgtggattattccgctttatgtccctataaattgacattctctctccaaaaaattttgaaatttctggctgtcccagcttcttcatagataacttaggctttggaatttttttagataaaagagtagaggtgggatagttttctagctttgagagtttcatgtagcccagaatctgttgataagatagtatcagtgttatattttgaggaagcacactaccaaagcctgcattctaagtttgctttccttctgtgacagtctgagtaacctttacatactggagttgtccccaagtgattcagtttataccagtgtgatgataaaattatggaaatgtactttctgcttaacattctgattatgatttataccccaccagaaaaagtgataataaatatttgaagtgttgttaatacatctcttttgtgcctttctcctcaaaactatgagattctcagaggtaagaggctctttaggccaagcacggtggctcatgcctgtagtcccacttactgaagaggttgaggcaggggattgcttgagcccgggagctcaaggctgcagtgagccatgatcacacaacttctctccagcctgggcgacacagcatgacactgtctctaaaaaaattttaaataaaaataggccttgattttgccaatctataacctttgtatcccatttaccacattgccttgaatataacaaataatatttgtttcactgaattaaatgattaatcacaggtggcgatggataaataacttttcacatagaatctcttgtactggcacataaatttgtgccaaattaatcaccttatgcccaatcattatatgcaggtaatccagaaagcctgtatccagcccagaagccactgtctctcttgttaatcctgtagtatggtcccttgtttattcaaggaatctagtatacccttatggtaggtgtcagtttctattgttaatgtcttgtaacttggttcaattaaaagctcttatccagctggccttggtggcacaagcctgtactcccagctactcgggaggctgaggcaggaggatcacttgagcctgggaattccagtccagcctgggcaacatagcaagaccccatctcaaaaaaaaaagctcttatgtatttaccacaggtaataatgagctattctcactctagaacatattactaagaatagggtacacatctgtataaataaagtcatctcggataagtgtgatatcataaagggaacatttatgtttatctaaaatacattgcagagagcaatttgacactttttcttgtgttttacgtgatatagaaacatcaactatatcaaactcttatgggttttgatatatttggagtatcaggagtaggcaaactttttctgtaaagtgccaaataataaatattttaggctttgcaggctatatggtctgtcacaaccactcagctttgccattgtagagtgaaagtagtatagataacacataaaatgaatgtgattatgctccaatcaaactttatttatggacactgaaatttaaattttgtataattttacatattactaaatattattctattagtttcctaaccattttaaaatgtaaataccattcttagctcatagcaatagaaaaataaggagagggtggctgggtgcagtggttcacgcctgtaatcccagcactttgggaggccaagatgggcagatcatttaaggtcaggagtttgagaccagtttagccaacatggtgaaaccctgtctctactaaaatacaaaaattagccaggtatggtggcgcacgcctataatctcagctattcgggagactgagaaccgcctgaacctgggaggcagacattgcagtgagccaaaattgcaccactgcactccagcctgggtgaaagagcaagattccgtctcaaaaaaaagaaaaagagggggtgagatttggcctgctgcttatagtttgaggacccctggtacagaccagaaaagtggtttattatgtttgctgcctttgtactgttttggagaattgtagttgggatcttagcatcttcactcaatgtcaaagtattttttgtctttatttatgattagaaatggaaaacaaaagatgagacattcatttctattaagcagtcagggtacacctgaactgtaatcaaaaatacatactgctgggcgtgatggttcatgcctgtaatcccagcgctttgggaggctgaggcaggaggatcacttgaggccagaaggatcacttgggtccaggagctcaagacccatctctaccaaaaaaaaattagctgggcatgatggcatgcctgtagtcccagctacacgggagcctgaggtaagaggatcatttgaacccaggagtttgaggttgcactgagctataatcatgccactgtactccatcctaagcaagagcaagaccccgtctctacaaaaaataaataataaaatatgtactgtaaccaccacagcaccccgtttctgccagttttccaaattgcattgtgttaactgtggtcttatattcagtgatgatcctagatatccccttcatttggtttgttttaaggatctgcctccatttccccctaaagaataaagaaaccacaattcccaaattcaccttttctttagccaagttttagagatatataatgaacatggtaaagaaagtaaaatgattttttttttttttggacacaaaatttcgctcttgttgcccaggctggagtgcaatggtgcgatctcggctcacggcaacctccgcctcccgggttaaagtgattctcctgcctcagcctccagagtagctggtattacaggcgcctgccaccacgctcagctaattttttgtatttttagtagagatggggttttattgtgttggccaggctggtcttgaactcctgatctcaggtgatctgcccgcctcagtctcccaaagtgctgggattacaggcatgagccccctcgccccgccagaaaaatgatttttactttgagcttttggtatactttagtgttttaagcgctggtataaatttaagattgggtatctacagaaaacgtcttagaagtgtccctctttctaattattacctttttttttttttctttttttgaggtggagtcttcctgtcacccaggctggagtgcagtgacacgatctcggcaacctccacttcccaggtttaagtgattctcctgcctcagcttcccaagtagctgggattgcaggcacgtaccaccatgcctggctaatttttgtatttttggtggagatggagtttcaccatgttggccaggctggtctcaaacttctgaccttagttgatccaccttcctcagcctctcaccgcacccagcgagaaatctgttttgaaagtaataattagtggctgggtgcagtggctcacacctgtaatcccaacactttgggaggctgaggtgggaggatcacctgaggtcaggagttcaagaccagcctgttcaacatgggaaaaactccatctctactaaaaatacaaaaaattagccaggcatgattgcgcgggcctgtagttccagctactcgggaggctgaggcaggagaattgctccgcctgggtggcggaggttgcagtgagctgagattgtgccattgcactccagcctgggcgacaagagcaaaactcttatctcaaaaaaaagaaaaaaatatatatttctctgaggagaattccccaattcacagcttttttgggcagtatttaccaataagtcagaataagataaagcaacattatttatttatttatttatttatttatttatttatttattttgagacggaccttcgttctgtagcccaggccaaagtgcagtggcgcaatcttggctcattacaacctctccctcccgggttcaagcgattctcctgcctcagtctcccgagtagctgggattacagacgcgaaccaccgcacccggctaatttttgcatttttagtattttggccaagctggtcttgaactctggacctcaaatgatccgcccaccttggcctcccaaagtgctggaattacaggcatgagtcactgtgcctggcccctttttttctttttttttttttttgagacagggtctcactctgtctcccaggctggagtgcagtgatgcaatcacatctcactgaagtctcgaccttctggcctcaaatagtcctcccacctcagcctcccaagttgctgggaccacaggtgtgtgtcacaccttgctaaaagacagggttttaccatgttgcccaggcaggtctcaaactcctgagctcaggccatccaccctccccagcctcccaaagtgctgggattacaggtgtgagccactgagcctggttttgcggaagtactttctaataaatccctaagcacatgtttctttcatttcccttggccaggctccttttgctctaatacttagctgagtaaattaattattcattaacaattcagcatgatatttaagcctaagaaatctttagtccctttgggacattttctttgatatttttctcacattatttgctctgttaatgtgtaaacttatgaataaatcttatttattgcaaatgtgattctggttgctactaatcattaaggaagtaggagttaataatgctgttcatagacctactaccaaaaaaatccaaatgaacctctgttttcagccgatcagcaagagattgctgtcagctagtctttctcttgtttttccttatattcactcttctctgtggcccaataattagttgtcttttgcttagtcgtaagacagagacaacctactggtgtgcattcagttctcagaatgttattttaaatcagctttgaactaatttgactatgccaagttttaaaaataatttttttctaaccaatttaattagtcactacaacagatgtagttgtcacatctgttagaaacattttagtatgatgaatttgtcttttatgggctttttaaaagcactgtacaaatttgtagttaataactcttcagtattgccactctaatcttactgaaaagtgaagaatggtgtgggtgtgggtatgtgggtgtgaggagagcttgttcctgtaatgtgaaatcgacagaaggtatatcactttatctcttacttcaccttgggtaaaccttctcttaactctcacagctctagattttattatattattcaggtgattatttcaaactaatgcttcggctgggcactgtggctcacgcctgtaatcccagtactttgggaggccgaactgggtggatcgcctgaggtcgggagttcgagaccagtctgaccaacatcgagaaaccctgtctctactaaaaatacaaaattagccaggtgtggtggcacatgccggtaatcccagctactcgggaggctcaggcaggagaattgcttgaacctggaaggcggaggttgcagtaagctgagatcacaccattgcactccagcctgggcaacaagagcgaaactctgtctcaaaaaaaaaaaaaaaaaacctaacacttcacattttagagtggtctatttactagctcaaagtatgtaccttgtgatctaagtaaaataactttgtagtatttctccaaagccatgtttcttttatgagtttgttgaaaatgctaacacagaaagccattttcactattatacgatttctcaagaagataaaacatagctagttaatattcaataataattttctataataatagctgtctgttgcattggttctgtagaatcaaggtaactatttcttgggttttttgtttgttttgtttcgtttttgagacggagtctcactctgtcaccccggctggagtgcagtggtgtgatctcggctcactgcaacctccgcctcccgagttcaagctgttcttgtgcctcagcctcctgagtagctgggattacagacacccgccaccacgcctggctaattttgtatttttagtagagatggggtttcaccaggttggtcaggctggtctcgaactcctgacctgaagtgatctgcccacctcagcctcccaaagtgctgggattacaggcgtgagccactgggcctaacctcaaggtaactgttttctagatatcaaattttcttaaatgcttattatgactttaatcaatttttagaactgagacttctgtgaaatccagccaaacaaattcaattttgttccattctaacttcagagtttttgtactggtcatagctcctttttctccaccttcatccctccacccctacccttcatagtgtaatgaaataaaactgaccaccaaacgcttctggtctgttagacatgcttagtataacctttaatatttgcccaagcactttgacctctgtagatctattcagatttgagaacactcatttgatctgtggagtccttgctggtgagtgcagtgtaaaggcaaaattttctattacctaatagttaaaattttgcatccggcatggattttgaagctgtttgcttttacgttcacctattctggggataatctaataacagcactatttaggaaattataaaaacaatgtttgacagataattatcattggctaatttcatttgctgtcctttgtgagaggctgcattgtggaattattttcctatcataagcaattttatcaactctagtaaaggcccacatcttccggaataagcccctttatccagattttatacaaatgtaatctttatataccagagaatagcaatagactgtgaaaatgactctgagtttcatggagaagctagtgagcactataaggatatatttctagctagaaactaatagcatacaaccttgaaaaaaaaaaggcgagagagggtacatccaagagagaaaaattagaatgaagagaaatgtattgcatgataaagaatgtcacactagaaaggaaagacagaattttaacatcaccttttgctagcccatggttactctgttgttagtttatccccatcttgagtgcttgtgattctaatgtcctttttcaaacttctaagtggcctgagttgtccactgaaactgtacaaaactattatttacaagcttttgggggtgggaaccagaggatgtttctcctttcggtaatttttgttcttctgtcttcatttgtttccttttttggctgaagaatgggctcctactgcttgacttgtcatctttatgtgctgtttacacatggcttttgcaaaagaagccattaccacatctgatttatcttttattgcaagtgcccatttaaaagcatttgttttaacttaaaaaaaattgttttaatcatcaggctaatgtgcctactgattattatacaacctagggaaatgctgatataatttttcaaaataggaaattacaaatattaatattaatgtataaagacatatgttttgctcttaagaggttttcccctaggcacttaaagccattctttgctgagacttaatcttgtcatgttttgttaaagagaagaatatagaagcaaagcactcgcaattaactgatcttatcaggattaaattctacattttttagtttgcatgttgtagaccatctgggggtattacttaaatacattgttgataatttaagtgactatgatatttattgtttactttagttaagaaccaggagctggactcttctgctgggtatcttccttctgtgcttagcaagataacctcgattcctgctggttctgtggtcatttgcactgcaaagcatttcttactgggtttgcaaagcaagggtaatgtgctctgtgggtgtatgtgtgtctgtgcaccctcatcccctattcccactgccatctctgttcacttccttttacttatcaaaacttctttttctcaatctatgtcaatcttattaaaaagtttaatgaatcacttttcccagacgtatagaaacactaataaaagttttatgtgttaaattttcctcacatatttgcatttcagcaagccacaaagtcattgcacagatgatggtgactgattacagcattggttatatcattaagcagtacttacaaggccagccttaaatctcattttacttgacagaatgcaaaataaaatgaagataatgtggaaaacaatggtatagcttaacggatgtagtggattggggattacaattgtgtaaagtgactgcagaggtatatgctaaatctcagactctcattttgaggaaaatttagtaatttcaaggagcaaatgtgtgggtaatagcaatatagaaagataagctttgaggctagaaacagtaataaatctctgacattttaaaatagttgtaaattgtgtgactaatcagaaatattctattttctttcttaacagacagtatgtatcccaaaactatccattataaatggtattcttcctgaggatcttggttcgggaatatttatgaaatagcctcatagtatacccattttaattctcctgtcacaatttctttcttcaaagttgtgatgttctctaaaatataatgaggacctgtttgagaacttgctaacaaaagctgaaaggaagcccaattttagttaaatccataggcttggcccacttcaggagttcaagaaacaccatgtagggacttcctgtctttattgctttggttcacgttactttgcaaaaagtaatattttaagaaatataaatcattctggatatgaattgtgatgtgatagaatcaatctatagtgtatatcactaacctaaagttattgtttagatcagttttggaaatactttgatcttcttttttttttttttttttttgagttggagtctcactcagttgccaggctggagtgcagtggcatgaccttggctcactgcaacctctgcctcctgggttcaagtgattctcatgcctcagcctcctgagtaactgggattacaggcacccgccaccatgcccggctaatttttttgtatttttagtggagatggggtttcaccatgttggccaggctggtttcgaactcctgatctcaaatgatccgcctgcctcagcctcccaaattgctaggattacaggcgtgagccaccacacctggccaaaaaccacattttaaatcactttcctgataatatcgcttctacctctaaatcagaaaacattaaaatacaatgaagctacaacttaaatttgaagtatttcttttccaccagttatacagatatattaaattcatcatcattgactttgactttcttttcttttcttttttaccccaagtttacaacctccacctgccaggctcaagtgatcctcccacctcagcctccttagtggctgggaatataggcatacaccaccacacctggctaattttttgtatttttggtagagatggggtcttgccatattgcccaggctggtctcgaacttctggactcaagcaatctgcccgcctcgtcctcccaaagtgctgggattaaaggcgtgaaccacctcacccagctgactttgactttcaaaaccaactaactaaattaccaaggtttaatattatattccccttataaaagagaacttttatattacataccagttactagcttataattctttcctctaactacttttttcttttagaagcctattaaggcttattttttactgtttttaaaaggcttggaagatgttaaggattttttagcactttctgcataaattgtttactagactcttcaggttttaaagatcatttcactactgaaaccagatacaagtgcttgcataagaaaataatcactttttattaccaaagtaatacatacttgttttagaaaggttaggaaatagagaaaaaccacaaacaaaaagatcgtttgcaatcccttgattattaatattttagtacaccttaaaatcttttgtctttcctttttttttttttttttgagacagagtcttgctgtgtcaccaggctagagtgcagtggtgccatctcggctcactgcaacctccgtctcccaggtttaagcgattctcctgcctcatcctccggagtagctaggactacaggcacatgccaccacacccagctaatttttgtatttttagtagagacggggtttcaccatgttggccaggatggtctcgatctcttgacctcatgatccacccgcctcagcctcccaaagtgctgggattacaggcatgagccaccgcgcccggccaccttaagatccttttcatgtgtatatttatacacattggaaaatataatttttaaatggctaagaaatgaagcataactgatcaagaggaggatttagtctttgaattatatagaaagataaaatgagacaatagcagtgtgttttcttccttttaatagagaaaggagttgtttttctattgccactaaaaggtaaaattggtcttcactaagtggggaacaagtgactaaatgtgtggggataaaattactacacaggtactcatacatggctcttatgtagcaaaattttagaaaaattttcaggatatattttcactttgatctcttaaaggataagacactcttgtaagcttaactgtggttcttttttttttttttttttttttgagacagagtcttgctctgtcgcccaggctggggtgcagtggcacaatcttggctcactgcaagctccgcctcctgggttcacgccattctcctgcctcagcctgagtagctggaactacaggcgcccgccaccatgcccggctaattttttggagttttagtagagacagggttttaccatgttagccaggatggtctccatctcctgaccttgtgatccgcccgccttggcctcccaaagtgctgggattacaggtgtgagccaccgtgcccagccaactgtggttcttttgatagtctcttcaaatatgtaaatccttacttcaaaaataacctgaaaagaaatagactctggattgcatttgttggagtggcagcaaaatacctataaaacacccatatcctgctttttttttgagatggagttttgctcttgttgcccaggctggagtgcaatggcacaatctcagctcactgcaacctccacgtccttggttcaagcaattctcctgcctcagcctcccgagtagcagggattacaggcatgcgccaccacacctggctaattttgtatttatattagagacggggtttctccatgttggtcaggctggtctcgaactcccaacctcagatgatcacccgccttggcctcccaaagtgctgggattgtaggcgtgagccactgcgcccggcccatatcctgcttttaataatatctggaattcataggtcaaaaaaggggtaatttataactcataaaggcatatatataatcagggtctgatgattctgagacataatccctttgcataaatagtttttgagagaaagcctttaggaaaaaaaatcttgttttcttccccaaaacaaagaaaatactgaattatcatacttagcaggagccattgactttttaaatgaaattgagaatcttcaaataatgtttctgttcagttaaatatttgtctaatattctttttttcatattattaaaaccaactagatatcattgcagtactttatatatataggcagccaatctttctatcatagcatcttttttcctttttctttttttcttttttttttttttttttgagatggagcctccctacctgtcgcacaagctggagtgcagtggcacgatttcagctcactgcaacctccacctcctgggttcaagcgattctccttcctcagcctcttgagtagctgggattacaggcgtgcgctaccacgcctggctaatttttgtatttttagtagagacggggtttcgccatgttggctaggctggtcctaagctcctgacctcaggtgacccacccgcctcggcctcccaaagtgctaggattacaggtgtgagcccctgcacccggccagcatcttttttcttacagattccccatcagttcaggtaagcgacatctagattaacacctttgaatcacattaagtctcagctttgcctttttgtcactgaggatggttcagacacagccatatattcatcttctacttgagaagatccctttaaagttttcaggctaatttggtatgtgcagttgcagtcttatataatccaatggcccttgatgatggtcacagccaaaggcaacaacactgtcagaattctttactgatattaaatgccaaattctgggtgtcttgtgtcatggagactttatattttcttctggccagtcttgtcttctggcttctcagccttcttatatgtaaaaatctagtgtcagccactcagaacagactctgttaagaggagtttgggcgctgtttgtatgtctcaaagttaaagtcgggtttgctgtgtgttattttgagcataataggacatgtcctgaagctgggcacactggcatgtgcctgtagtcctagctaatcgggagcctcagatgggaagatcccttgggcccagggatttgaatcctgcctgagcatcatagtgagagcctatgtctaaaaaataaatatatacataagtaaaataaataggacatgtgctttggtcctacttgaaataccttctggtgtcatgggaagaagatgggctttagaaccagagatagatctgagtctaaacactagctgctcatctgttcatctataaaatagaaataatgactacttcataattatactgtaaataattaaatgaaaaaacatgctcaagtgattagcacagcacctggcacatggtaaacatacaaaaatattagttttctcttattttactgatggaggagataaaatgctggactagactatgagtctggtcaaatgagccactgtttatttcttcctaaacatgcttttctaaacattttagttacagaatagcacaggacaaagaagaagttctcaagtgacctggatttacctaacataccttcaacacgtttttactgagcatctattacataccaaaaactgtacaagaaagatagagagctaagtaagacagtaacaagttctcatcccccaaggatttcataggctaatggaaaagacagatgaatatgccagtgatgatagggtacaatgggaaccaaagaggactggtatctaaacatacttcaggcagccaaggaaaatctagaagaaatgacagttgagctaagtgtggacttccaggcagaaggaataagatttacaaaggcacagagataatagaaagatgctctgtcctagggaatacaaatagttttggagtaatggggagaaggatatatgtggagttgtagctggatgaagctggagagagaggtaagggtcagattttaaagtattttctgtcttactaaaacccagtgaagggttttaaactagaaaactgaattttcagtgtttaattttagaaataagcactttagcagcataatagaggacacgttcaaggaaggtttgagatgagaaagaaggaaggaagaaaggaaagaagaaaaaccgttgagggcatttgtggtaatctggatgaggcgttctaagagctttaacaggctgggcacagtggttcacacctgtaatctcaacactttgggaggctatggtgggcagatcacttgaggtaaggagttcaagaccagcctggccaacatggtgaaaccctgtctcaactaaaaatacaaaaattagctgggcatggtggcacgcatctgtaaccccagctacttggaggttgaggcaagagaatcacttgaacccagaaggtggaggtttcagtgaatcaagattgcaccactctactccagcctgggcgaagagcttgaacaaaggtagtaaatgtgggaattgatgagggaaacattaaagcaaatagataaagtagatattaaaatggaataaaaatgccttgatgacataatctctgggggttagcggataaatgtaaggaagaagttgaagatgattctcagaattctggcatggatgattggatggatggatggagatgccttctactaatatgatagaagtgacggaggggccggatgtggtggctcactcctgtaatcccagcactttgggaggctgaggcaggtggatcacctgaggtcagaaggtcaagaccagcctgaccaacatggagaaaccctgtctctactaaaaatacaaaattagccgggcgcgatggcaaatgcctgtaatcccagctactcgggaggctgaggcaagagaatcgcttgaacctgggaggcagaggttgcagtgagctgacatcgcgccattgcactccaacctggtcaacaagagcgaaaccctgtctcaaaaagaaaagaaatgatagaggaagttggggtgggaagcccagagagcagcagagatgagtttagtttgcaacatgttgcattctacacccctgggaggatgctcaacaaataattgtctgtgttgtcctggagatctggataacagtgtcaacttgagaagttgatttgaccatatgtgagtgtgctataaatggtaatccaacccaactgttatgtttttcttttatttctgaagactagtacatgttaggtgctcagtaaatatttgttgagttgaaattactgtggctagggcttttatcattgttgtcttctacacatgctttggaaaaaaagagattgttctgtctaatttaactcagcagtaggcaagtttgggtcaggtggtgctggcctaagtaatgtttagttcacaaatagcttcttgatgacagactactacttatcacttgaacaaactggcacaaaattggctcttacttgattatcttaggtatttgtctgattattaatcagccttctcagttgtgacaaattatttgaagaagcccaaagttcctctccatgtgaatgggtttagatagctattcacaatgctaggactagcatgtagcaatttcagaaagcctatttgtttaataccagctgatctatttttggacagctctatagccacttgcctgactcaaaagaaacagtgagataagtgccctggaaagtagcatagcatcttaacaatatgacaaattcattctagtgtcccccaggccctaggacattataggtgctctgctcattggttggttgaattaaataagtatagtactttagaatttacaatatggtttcatatacagtatattattgtattttatcttcagaaccctataagtcaaaccaagtattattttcatgttaaatatgaggaaattcatacattcttgtcaagaataattgctgtatctcagatacatttgcagacagagacagccttgttgtcagtctttcagttccatctttcatatcctaagtcatatttgttatcagccaatgaaagatctacctaatatgaattcaactagtgccagtttgagacgcttttgagttgcatgtttcaaaatggcttgggagtgaagctggcctgaagttcttgtgttcagtgtgtctttccttgcctttatggagccctggttaatattcatcacaatggaggctggtttacaagttaaggagcagcagtgattttcctaatataatacctataacattgatttgagtactacagtgtgtaagctggttcaaactgtattgtttactcataggaacaccttcttaccttcttttttttttttttttttttttgagacggagtttcgttcatgttgcccaggctggagtgcaatggcatgatcttggctcaccacaacctctgcctcccaggttcaagcagttctcctgcctcagcctcccgagtagctgggattacaggcatgcgccaccacgcctggctaattttgtatttttagtagagatggggtttctccatgttggacagactcgaactcccaacctcaggtgatccgcccacctcagtctcccaaagtgctgggattacaggcgtgagccaccgtgcctggccaggaacaccttcttcctttctttattgtttctctgtggtttgtaatatggtcaaaggctcttaccaagatttcatgcctaagtggcttatatacagctctctggtgagcacatgcagatgtcacttgccataacatttggctttcgttaggttatttctttttcttcttttaacttttattttaggtacacgcgcaggtttgttatgtaggtaaattcgtgtcatgggggtttgttttacagattattttgtcacccaagtactaagcctggtacccaatggttattttttctgatcctctccttcctcccaccctccaccctcaagtaggccctggtgtctgtttttcccctccttgtatccatgtgttctcatcagttaggtcccacttataagtgagaacatgcagtatttgcttttattgttcctgtgttcgtttgctaaggataatggcctccagctccatctgtgttcctgcaaaggacatgagctcgttcttttttatggctgcatagtattccatggtatatatataccacattttctttatctaatttgcgattgatgggcatttaggttgatttcatatatttgtcattgtgaatagtgctacaataaacatacacatgcatgtgtcttaatggtagaacgatttatattcctttgggtatatacccgtaataggattgctgggtcaaatggtagttctgtttttagctccttgaggaatcaccacactgctttccacagtggttgaactaatttacattcccaccaacagtgtgtaagcattcccttttctctgcaacctcaccagcatctgttattttttgactttttagtaacagccattctgactggtgggagatggtatctcactgtggttttgatttgcatttctctaatgatcagtgatactgagccttttttcttatgcttgttggccacatgcatgtcttcttttgaaaagtgttcatgtccttttgcccattttttaatggagttgtttctttcttgtaaatttgtttaagtttcttatagatgctggatattagacctttgtcagatgcataatttgcaaatattttccccaattctgtaggttgtttactctattgatagtttctttcactgtgcagaagctcttaagtttaattagatcccatttgtcaatttttgcttttgttgtgaattgcttttggcatcttcatcataaaatctttgccagttcttagctgggcactgtggctcatgcctgtaatcccagcactttgggaggccgaggtgggtggatcacaaggtcaggagatcgagaccagcctgaccaacatggtgaaactccgtctctactaaaaacacaaaaattagccgtgcgtggtggcacacacctgtagtctcagctactctggaggctgacgcaggagaatcgcttgaacttaggaggcggaggttgcagtgagccaagatcacaccactacactccaacctgggcgagaaagcgagactctgtctccaaatatatatgtatatttgccagttcctatgtccggaatgctattgcctaggttgtcttccagggtttttattagttttgggttttacatttaagtctttaatctatcttgagttgacttttgtatatggtataaggaagggatccagtttcaatattgtgtatatggctagtcagttatcccagcaccatttattgaatagagaattcttcctttcctcattgcttgtttttgtcagctttgtcgaggttcagatagttgtaggtgtgtggccttatttctaggttctctattctgtttcatatgtccattttcataccagtacaccatgctggtgtttgttttttgttgttgttgttttcttattttttttcttttttttcttttttgaggccgagtctcattctatcacccaggctggagtgcagtggcttgatctcagctcactgcaacctccactttccgagtttaagcaattctcctgcttcagcctcccaagtagctgggactacaggcacatgccaccatgcccagctaatttttgtatttttgtagaggcaaggttttgccacgttggccagggtggtctcaaactcctgacctcaggtgatctgtgcctgcctcagcctcccagagtgctgggattacagacatgaaccaccatgcccagcctaccatgctgttttggttactgtagcgttgtagcgatctttcaccttcctggttagctggcattcctaggtgttttattctttttgtggcaaggttatttatttttcaaatgactaattcatttcctactagtgtgaattccttcttcttccacctagagcacctttcttttaactttaggaataggtccatctactgggatggtatcttctcttccacattctcttccatgtgcagtggtccctcatcctctgtggggccttggttccaagacctcccctggataccaaaatccacaaatgctcaagtcttggatttaaaatgacatggtatttacatataacctatgcatattctcctgaatactttaaatcatctctagattactcataatacctaataaaatataaatgctatgtaaatagttgttatactatattctttagggaacaatgacaagaaaaaagtctgtacatgttcagcatagatgcaattttttttccagatacttttgatccatggttggttgaatccatggatgcagaacccacagatacagagtggtgactctacttgctttagaactgtttttcctgtggagtgaggtatttggcccaggagggaactcttgtgtttccggaatttatttctcttggaggttggaggtgttgtgtcattcatctgtgaagaaatacatctcagctgctgggtcattttaattgtttacaaagaaacatttcaccatttttgatatcatgtttgatgccatgacagtgattgaagtaagcctgtgctagatgtactcaacttctgtctccctgacaactagtctagattttagcttctccatgcagggctagtgtgaggatacatacagtttggaaatatgaaacatttttcaacctgattaggttcctcaagaatatgttttacctgtaatcccagcactgtgggaggccgtggtgggaggattatgagaggccaggagtttgagatcaacctggactacatagtgagaccctgtttctccaaaacatgtaaaacttagccaggttttggtggagcatacctgtagttctagctactctggaggctgaggcaggaggatcccttaaacccaggaattcaaggctgcagtgagctatggtcaggccactgcactccagcctgggtgacagagtgagaccctgtctcaaaaaaaaaaaaagaatatattttgattgatgcacaaattgcattgtgtcctgtgcatagtaataacttaggcatttaggaatgacaaagtaactcctttaagtaacacaaggaagaccataggaatataaattgctggataattgtttttcagattaacaatgatatagaaataggaccaaacttaggttggaactgcttaagctgctgataatgtgtagtgaacagcagctcttccttttgaccatgttatcagctaagattcttagtttatattagtagcaatatttttgaggcttccaaaaatcattgttgattctcagagttcattctcccacttatacctaatcttcttgcttttgtatctgttcattcatttgtagagtataaatggcattcgcacagaggaggtggctgtcgtgacaaaggggccatctactaaccctgactctgaatgggagggtcccaagcattcggtagttcctagtaaaagccagatgaccacctcgtcggagtctctgcaaagctttgcctttggctccctctccataagcagcaaggagacagaagagaaggaggagggggcagctggctatcttgatattaaggagatgccaagaggcccaactgggggatgtataggagtggaggaacaggccagtgccttaaagttctcagtaacaccagcttcctgtcagctgcaacctggtgtaaaaaaggcagagagtagtgaagaacatgttacaccaggagagccacctggaaaacaaaatggatcatttcttgactttcatgtgggtaaccagttccccaccctcattcgaagtttccaggtagtaatttattcaatgatgcaggtctaatgactgtctttggaagagggccagaatctgtcctgtggaggaggtggtggtggtatggtgagggtagtggcctccctgctgttttcaaaatcacagactaaaagcctttgattgtgccaaagaaattcattcagagcaattaactgcatggctagaaatgctttcttctctgataacttaacaaaactccagctgtcagtctttatgaagctggttaagtgtgttcatcttttccttgctcaagtgtgggctatggaaagaggtgaattgcggtgacttctgtggtgaggaggcttcagtgttctgagaccatgcttaaaaaattcaaatactcttaattaaaggggcaactcatcttcttatgagatttcaggccccaaataatttatgtactgcagccacattgtgcagcccaccactcccactgaccccacccacaagagcattcaggatcataggcactgatttcctatgctaaggtggttggccacttaaccttattacaatcaaatggtagtttcagtgtgatttatactcctggggaaggtgagcagatggacaagaaggcctttggtattccactaatgttcattcttctgaaattctgggattaatcaccaggtggtggtagaactgattgtttttttctttccagttttccaaatactgtctcttctcaataactccaaagtgaatctctgacattgatttgaaagaagttaatgaattcgagggtaatgcattccattgccactgctgtttcatgtaccattcgtacttagtggaggaaatgtggctgattttcttaattataatggtacagacacaaggacaaatcaaagtgattgctatttggcaaatcgttttatattcaaattctgaaggtcagtctgaagtgttttatatcaccaatcataactgtctgctcttacagctttccattaagcttatgaaagtgattacagtaatgctgctttttaatatccctcatgatttgacaccttgtcagggttactttggaatactgtcgaagtcttaggcagggtaaacacctttgtagattgagctagctctgtacttaattaaagctaacactttgatcagatcagtgtcagaagattacttctccattgccttcagaaatactctagtaactctttccttactgcttcacagcctcccctggtgaagacacaaactgtcaccatctcagataatgccaatgctgtgaaaagtgaaatcccaaccaaagacgtccctattgtccacactgagaccaagaccatcacttatgaggctgcccaggtaggacatgttttgatgcttcagaaccaaaggctgcaaacaaaattaataacctttcttcacagagtttctagtcatttatcgccaagaataccaggtttttctggggcagttctttttagaagagattactggtctaagaaggtcccagactactttatctaaagcaaaaaattgagcagagcacactggtgtatgcctgtagtcccagctactcaggaggctgatgtgggaggatctcttgagcccaggaaacgccatctgaatatttttttttgagacagagtctcgctctgtcgcccaggctggagtgcagtggcgcaatctcggctcactgcaagctctgcctcccgggttcacgccattctcctgcctcagcctcccgagtagctgggactacaggtgcccgccaccacgcctggctaatttttttgtattttcagtagagacggggtttcaccgtgttagccaggatggtcttgatccgctgacctcgtgatccgcctgtcttggcctcccaaagtgctgagattataggcgtgagccaccacacctggcctaaattttttttaaagcaaaattgtcttagatctgattgcttatatccacccaattcatttgcataaggcagtctggtgtaatggttgagaacatgggctttgggtctgaaaaaacctgagttcaagtcctggctcctccacttactgacttggacaagtaattgaatatctctgagccttgatctcctctgcccatgacgttaatatctacttcatggtgttatgaggatttaagtgttttttgtttgtttgtttgttttttgagacggagtctcagtcactctgtcgcccaggctggagtgcagtggcgtgatgatctcagctcactgcaacctctgccttctgggttcaagtgattctcctgcctcagcctctacagtcatgtgcacatggctaatttttgtatttttcgtagagttggggctcaccatnnnnnnnnnnnnnnnnnnnnactgtacaatgtgtataataatggttcctccctcagatattgagaggcataattgagacaacagttgaattatatgcttggcacatagtaggagtataataaatattagttgagtctgaatctaaagtagatgactggtcttggctgaagaaaatattagttagcggctgggcgcggtggctcaaagagctgtaatctcagctctttgggaggtggaggtgggcggttcacgaagtcaggagttcgagaccagcctggccaatatggtgaaactccatctctgctaaaaatacaaaaattagccaggcgtggtggcaggcgcctgtaatcccagctacttgggaggctgaggcaggagaattgcttgaacctgggaggcagaggttgcagtgagccgagatcacactattgcactccagcctgggcaacagaagcgaaactccatctcaaaaaaaaaaatactaaaaatacaaaaattcgctgggtgtaatggcaggcacctgtaatcccagctactcaggaggctgaggcaggagaatctcttgaacacaggaggttgcagtgagccgagattgctccactgcattaaaaaaaaaaaaaaaaaagaagaagaagaagagattactggtgagccactacacctggccaaattttcttttctgagaaagggtctcactctgttgcccaggctgaagtgcaggtggcatgatcttagctcgctgcagcctagacctcccaggctcaagcagttctcccacctttgcctcccaagtagctggaactacaggcatgcacagctgcacctcgctaattttttgtagtgacgatattttaccatgttgccctggctgatctcaaattcctgggctcagaggatccaactgtcttgacctcccaagatgtgccactatgccctgctaaaaatttttttacttcccactttcagtaaaatgtctctcacttttggtagtttcaatggactagaattgatttatgttgaattgtttttcttttgttattcacagaagccaaaagtaagaaaaacagttccctctataaactgagctgttatttcattcctgcaacaaatatttattgagtgttcacaatattaagccaaagcaatgtacaaggtatacatagtccctaccctctggaacttacattctagttaggagaaacaggcaataaagcacataaacaatgtataagtaaatttcagacagtggtaaatgctataaggaaactaaaatggggtaaagagttagacaatatgagattacatgaaagattgctgctttgagactaggataatcagggaattcctctctgaggaggtgacattttggctgaggtctgaatgatgggaaagagatagccatgtgaagttctggctaggtgctttcacataaatcttttcacttaatcctcacctcaccatgaactggatgatgttatctccatttaggaaacagtgtggcttggtaatttaaaagcatgtgcattgctgggtgtggtggctcacgcctgtaatcccagcactttgggaggccaaggcaggcggagcacgtgaggtcagaagttcaagaccagcctgaccaacatagagaaaccccgtctctactaaaatacaaaaaaattagctgggcatggtggcacatccccagctactcgggaggctgagacaggagaatcgcttgaacctgggaggcggaggttgcggttagccaagatggcgccattgcactccatcctgggcaacaagagtgaaactctgtctcaaaaaataaataaataaataaataaaataaaagcacgtgcattgcaattagaaaaaagagaattagggttggtcacagtgactttgggaggctgaggagggaggatctgttgagaccagtagttccagaccagcctgggcaacaaagtaagacccccatctcttttatatatatataaataaaatattatatatatatttataattatacatattaaattatataattataatatatatttaatacaacatataattatattaaatatgtaaattaatatataattacacattaaatatataatatatataatatatatattagctgggtgtggtggcatagctgtagttgcagctattcagaggctgagttgggaagatttcttgagcccaggtgttcaaggctacagtgagctagagtcatgccattgtactccagcctgggcaacacaccaagaccctgtctcaaaaaaaaaaagagggccgggtgcagtggctcacgcctgtaaacccaatactttgggaggccgtggtgggtggatcacctgaggtcaggagttcaagaccagcctgaccaacatggtgaaaccccatctctactaaaaatacaaaattagccgggcacggtggtgcatgcctgtaatcccagctagtcgagtggctgaggcaggagaatcgcttgaacccgggaggtggaggttgcagtgagccaacatggcgccattgcactctagcctgggcaacaagagcaaaagtccatctcaaaaaaagaaaaaaaaagagaaagagagaaatagaatttgtatcctagctcaatcaggtaggtaccaactaggtaaccttaggcaagttgctaatctctctaagcttgtatttccttgtttgtaaagtggggataataccactgaccattgcaagctttggaggaaaattaggtgaaatgatgtctgcaaagcactgggcatgtttatggacacttagtgtcagtatgcttccctattctctctttcgtggtctagagtgcagattttgagtttggtacataatgagagtttaattagccaggcgtggtggcgtgcacctatagtcccagctgcttgggaggctgaggcaggagaatcgcttgaacctgggaggtggaggttgcagtgagccgagatcatgccactgcattccagcctgggtgaaagagcgagggtccatctcaaaaataaataagtaaataaataaacaaataatgagaggttgcgtaaagtttatcgatactaacaaagtggcataattgaagcaatgagccaggcatggtggacgcacccatagtctcagctgctcggaaggctgaggcggaggctcccttgagcccaggagttcgaggctgcagtgagctgtgattgtgccactgcactccagcctggggaacagagtgaggacctgtatcaaaaaaacaaaataaagtagggagaggtctgggaccaggaatatgactagaacatctctggagaaatgcttgtaaagaactgaagtgtctgaggaaacaagaaaaaagaaatgtgtcagtcgagagagacagagaaatgaatgaataggtcttggcagtgaaggggactgaaaaagaaaggaataggaaattacttaaaaattgtacacgctattagccagaggatataggaaataattacttcatatggcagaatccctttaagttgtcactaccatggaaacaagctaaatgtccatcagtggagagctggttaaatacattatggtacatccaattaaggtaattctgtgtggcctttaataaaagcttctgatgggaacaagctacatgataaattggtaagtgaacaagcatggtgcactatggtggtactgtttatggaggggagaagggatgtatattgcagctatgtgtgtttaggtttgtatatcaatacactctctctgaatgggtactaaaaaacaaaacaaaaaaccaacaaccaaaacgtatagtggcccctgatgaaggagactgagactgcaggactcgggtcaggagtgggagggaaactgacttttcactgtaaaacattttgaagtattaaaatttttatagcatagacatagccaaaaaattttattttattattattattattatttagagacagtcttgctctgtagcccaggctggagtgcagtggcatgatctcagctcactgcaacctctgcctcccgagttcaagtgattctcgtgcctcagcctcttgagtagctgggattacatgtgcatgccaccacacctggctaatatttatattcatatttttatttttatttttgtttgagacagagtttccctcttgtcgcccaggctggaatgcagtggtgccatctcggctcactgcaacctccacctcctgggttccagcgattctcatgcctcagcctcccaggtggctgggattacaggcacccaccaccacacccagctaatttttgtacttttagtagagacggggtttcaccatgttggtcaggctggtctcgaactcctgacctcaggtgatccacccaccttggcctcccaaagtgctgggattacaggtgtgagccaccgcacccagcctaatttttatatttttagtagagacagggtttcaccttgtgggccaggttggtctcaaactccaggcctcaagtagtcagcccgcctcgacctcccaaagtgcagggattacaggcatgaaccaccgcaccctgcgcccccaaaatttaaatggttcaaaataaattgttttaaaagttagagccacactgaccacagaagtccctgtggtgtgggtgtaggtagctcctacaaaaaaaggaaatggaagcagtcattttaaaatatcctgacatattagagaaatataaaggcagcgtgatattcttgacagagcccgtgggctttggaattagagtgacttaggtcttaattccgacatttgctagttttgtgaccttgggcaagtcccttatctttttgagccttagttttctcttctgaaaaatactgtgatcaagttattgaaataagcacaatgtttgcctggtatttattagctattcataatggtagctattattatattgcgttgttaaacatttgcctttatttcattttaaccaggcttaagacagtcaagatacaaattgctttttattttatttgtttgtttgtttatttatttatttttgagatggagtctcactctgtcacccaggctggagtgcagtggcgcgatctcggctcactgtaacctccacctcccaggttcaagcaattctccagcctcagcctcccaaatagctgggaccacaggcatgcgcccccatgcccggctaatttttttatttctagtagagatgggttttgccacgttggtcaggctggtttcgaatgcctgatctcaggtgatctgcccgccttggcctcccaaagtgctgggattacaggcgtgatccactgctcccggcccacattgctttttattacttatgctagacagtggggtagagtggggaagagtgttgactttcgagtcagagtcagatttcctggctttgaacctgccctgtcactagtgtgcagtcaaattactaaatcgccatgtgcctcagtttcctcatttgtaaaatgtggctaatagttgtacctcataggattgttgtcaggaataaatgaattaatgcacataaatgtttccaaagtgcctggcagataataagcactagatattcatttgcaattgttattatttatttactatttctacttttgcttttattatcttgctggataagtaagccggagcaccatttttttatttattcacagtctctgtgctttggaaaacatggtcagaggggatagtttttacgtgtagttttttatgtgtgtatatgggtgtgtttgaggtaaaatttacatacagtgaaatgcacagacagggtctcgcactgttgcccaggctggagttacagtggcatgaccacagttcactgcagcctcgaccttttgggctcaagtgatcctcccacctcagcctcatgagtagctaggactccaggcgcacaccactacatgtgactttttaattttttttttttttcgagacggagtctcgctctgtcacctggcctggactgcagtagcatgatctcagctcactgcaacgtctgccttccgggttcaagcaattctcctgcctcagccttctgagtagctgggattacaggtgcgggccaccatgcctggctaatttttgtatttcttttttcagtagaaacagggcttcgccatgttggtcaggctggtctcgaactcctgacctcatgatccttccgcctcggcctcccaaagtgctgggattacaggtgtgagccactgtgcccggcctaattttttaattttttgtacacacgggactcactttgttgctaaggctgatctcgaactcctgggctcaagcaatcctccctcctcagcctcccaaagtgctggtattacagatgtgagccaccatgcctagcaatttgattggttttgacaaatggctatacatgtgtaaccaagacacatttaggatacagaacattacccctgaaactggcttcatagccttttccatctgatttctacccctttaggcagccagtgctctgctttctatcagtattgcttagttttgcctggtttggacttcatgtaagtagaagtatacagtagtacacttttgtgtatggcttctttctttctttttgaattggagtctcactcttgtcatccaggctgctggagtgcagtagtaccatctcagctcactgcaacctccacctcccagattctagcgattctcctgcctcagcctcctgagtagccaggattacaggtgcccaccacttcacctggctaatttttgtatttttagtagagacggggtttcaccatgttggccaggctggtcttgaactcctgacctcaggtgatccacccaccttggcctcccaaagtgctggtattacaggcctgagccaccgtacccaacagtgtctgccttctttctgaatataatattttttagattcatccatgttatgtgaatcagtagttccctcttttttattgctgaatagtattacattgaatgaatataccacaatttgtttatccattcatttgttgatggacagttggatgaatttcagtttgggaaaatattaataaagctgctatgaatgttcatgtacagatcttttttttttttttttttttttttgagacagagtatggctctgttgccgaggctggagtgcagtggcatgatctcagcccactgcaacctccgcctcctggttcaagcgatcctcctgcctcagcctccagagtaactggactacaggcatgtatcaccatgcctggctaatttattggtattttgtggtagagatagggtttcatgatgtcggccaggctggtctcaaactcctgacctcaggcaatccacctgcctcggcctcccacagtgctgggatttcaggcatgagccaccgtgcctggccacaaatcttgttgtgggcgtttcatttatcttgagtaaacatctaagagtcaaattgctgggtcataggacaaatgaccagtatgaggaaacattggtaagaggatcaaggaaaacaggccctgtatgggaacagggtaagtaggaaaacataacagtgtctcctgcatctttagcattcttcagagacagaaaagagactagagggagcgggcaggaggtagataaagatagagtcacaggtttatagaggagttcttcaaaaagctttagcccttctggcatgcaaattcatgttataacaatttataagctaattttatttgtataatttctttgtatgctcacaacagtgctacggtgtaggcagaacacatattcccatattgcttttattttttattttatttatttatttatttttttgagatggagtttcactcttgttgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcctgtaatcccagcactttgggaggctgaggagggtggatcacctgaggtcaggagtttgagaccagcctggccaacatggtgaaaccctgtttctactaaaaatacagaattagccaggtgtggtggcatgcgcctgtaatcccagctacttgggtggctgaggcaagagaatcgcttgaacccaggaggtggaggttgcggtgagccgagatcccactattgtactccagcctggggaaaaagcaaaactccctctcaacaaaaaataaaataaataaaaatttaaaaatcaaataaatgagaaaactaaagctcagagaagtcagagtgacttgcccaaggttccacagctggttactgtctgagtggggacccaaaccccagacttcaaacagggagtttcttgccctgagtcctagttcaaacacccattagagtcttggacaaattcttaacctctctggagctctgttttcttaactgtacaatgtgtataataatggttcctccctcagatattgagaggcataattgagacaacagttgaattatatgcttggcacatagtaggagtataataaatattagttgagtctgaatctaaagtagatgactggtcttggctgaagaaaatattagttagcggctgggcgcggtggctcaaagagctgtaatctcagctctttgggaggtggaggtgggcggttcacgaagtcaggagttcgagaccagcctggccaatatggtgaaactccatctctgctaaaaatacaaaaattagccaggcgtggtggcaggcgcctgtaatcccagctacttgggggaggctgaggcaggagaattgcttgaacctgggaggcagaggttgcagtgagccgagatcacactattgcactccagcctgggcaacagaagcgaaactccatctcaaaaaaaaaaaaaaaaaaaatacaaaaattagccgggcgtggtggcgcgtgcctatattcccagctactcaggaggctgaggcaggagaattgcttaaacccaggaggtggaggtttcggtgagctgagatcacgccactactctccagcctgggtgacagagcaagactccatctcaaaaaaaaaaaaaaaaaaaagctaatgtttgaaaggcatttgtgaactataaaatgctatacatgtgcttaattattgtcactaatgttgacctgtggctatgttcctgcctcttatttctttttttttttttttttgagacagaatttcgctcttgttgcccaggctggagtgcaatgtcgcaatctcagctctccacaacctctgcctcctgggttcaagctattctcctgccttagcctcccgagtagctgggactgcagacatgcaccaccacacccggctaattttgtatttttagtagagatggggtttctccatgttggtcattctggtctcaaactccccacctcaggtgatctgcccccctcggtctcccaaagtgctgggattataggcctgagccaccgtgcccggcccctgcctcctatttctgatccattcctgtcactgactcagtgctaaggaaactatacccatccaactttcttagaaggaactttgtgcccagggaatttattttattttattttatttatttatttttagacagagtctcactctgttgcccaggctggaagtacagtggcgggatcttggctcactgcaacttccacctcccaggttcaagcatttcttctgcctcagcctcccgagtagctgggattataggcaagcaccaccacgtccggctaattttgtttttttagtagacacagggtttcactctgttggccaggctggtctcaaacccctgacctcaggtgatccacccgcctacccctcccaaagtgctaggattacaggcatgagccaccgagcatggcccaatttattttatttgttaagaggttaccctgaaaaaaaaaaaaaaaagaggttaccctggccgggtgcggtagctcacacctgtaatgccagtactttgggaggccgaggcaggcggatcacctgaggtggggagtttgagaccagcctgaccaacatggagaaaccccatctctactaaaaatacaaaattagcccggtgtggtggtgcatgcctgtaatcccagctactcaggaggctgaggcaggagaattgcttgaaaccgggaagcggaggttgcagtgagctgagatcacgccactgcattccagcctgggcgacaagagtgaaactccgtctcaaaaaaaaaaaaagaggtcattctaagggaatgagatttttgcatcagaatgtgcagctgaagagcaaagctgcagcctgcaacatttgcccagtcttcctgagaggcatgatgatgagccatgctttcttctgcagactgacgacaacagtggagacttggacccaggagtcttgctgacagctcaaactatcacatctgagaccccaagcagcaccaccacaactcaaattaccaaggtaacagaccagctagaacctctttatggaacccaggggcaggctaagcttgctgccacctctctgcaagaaggaccctagtccataagcaaatattttcagctccatccctagtaagccacattattcaaagagtcctggatggaaaggccctgctgccttccccagcaataaatctagggagataccctgagagtatccctgcctacttagtagtctcctaaaggtaggtgtggttgttctctttacacatctgtctctctggtcagtgagtcccctgtctggctgtggaagtaagtttaaaaagtcagcatggccaggcatggtggcccacacctgtaatcccagcactttgggaggccaaggcaggtggatcacctgagatcaggagtacgagactagcctgaccaacatggtaaaaccccgtctctactaagaatacataaattagccgggtgtggcggcatacacctgtagtcccagctattcgggaggctgagggaggagaattgcttgaacccaggaagcagagattacagtgagcagagattgcgccactgcactccagcctgggtgagcgagcagactctatctcaatagaaagttaacttaaggggccaggcgtggtgtaatcacacctgtaatcccagtactttgggaggctgagacaggtggatccctttagcccaggagtttgagattagccttggcaacatagtgaaacctcatctgtacaaaaaaatacaaaaaaaaaaaaaatgtgctgggcataatggcgcatgcctgtggtcccagctacttgggaggctgaggtgggaggatcacttgagcccagggcatcaaggctgcagtaagccgtgatcatgccactgcactccagcctgagtgacagagcaagaccctaaaacctatctctgtaaaaacaaaacaaaacaaaaagtcagcttcagggaaattatttttggtatttttatacaaccatattttccaagcccaaaatcagaactctgggtctgaggaagaatttttacagcattccagggacaaggccatgagaacttgtttggatgctgaaatattggaattattagaatgtagtttataggaagcaagagagagaaaatatctaaaattggaactacccccagaaaatcagaggcaatcgatgtttgctgtaacactagaggaaaatactttttttaataggtaagaaatatagcttcttgaccaagctctctcatcaatacacagatgactggaaactagttaacttaatgtgtctagaccttggttttcctcatctaccagaaagagaaatctactcaccctcaggagattatgtgaggaccttttgacatcaataatatgaaaatgctttaaaatacaagagcccagtttcaagctgtgtgacatatttgttcatagccttcagatttttttcctcttgaaaatgatcatggtggctcatgcctgtaatcccaacactttgggaggccaaggcgggcggatcacctgagatcaggagttcaagaccagcctggccaacatggcgaaaccccatctctactaaaaaaataaaaattagccgagcatggtggcacacgcctatagtcccagctactcgggaggcttaggcaggagaatcacttgaacccaagaggcggaggttgcagtgagctaagatcatgccactgcactctagcctgagcaacagagcaagactccatctcaaaaaaaaaaaaagaaaaagaaaatgatcaattaaaatgtatagcatcagtatccagtctctaaaacagaaatgtatgagagaagagcacagaaagtcctattttgtttacttgctagatttctgtggtattcaggaggaagaaaaaggagaaagtaaatacagaattgtgactttctgtttagcttaataaagattttagtaatccaggctgggcgcggtggctcacacctgtaatcccagcactttgggaggccggggcgggcagatcacgaggtcaagaggtcgagaccatcctagctgacaaaaaaccccgtctctactaaaaatagaaaaaattagccgggcgtggtggcaggctcctgtagtcccagctacttgggaggctgaggcaggagaatggtgtgaacccagtagacagagcttgcagtgagccgagatcgcaccactgtactccagcctgggcgacagagcaagactccgtctcaaaaaataaataaataaataaataaaaaagattgtagtaatcaaggctggatgtggtggctcacgcctgtaatccaagcactttgggaggctgaggtgggtggatcacaaggtcaggagtttgagaccagcctggccaacatagtgaaaccccatctctactaaaaatccaaaaattagctgggcatggtggtgcgtgcctgtagtcccatctactcaggaggctgaggcaggagaattgcttgaacccgggaggcagaggttgcagtgagccgagatcacaccactacactccagcctggacaacagagcgagactctgtctcaaaaaaaaaaaaaaacaaagattttaataatccaggggagtagaagtgtactctacaagggagtagaagtagcaggtctggttgagattttggacaagtaggttagaaagctgtcctttgcagtacccagcagtagattaaaatttggagtggagctttcggaataatctttgctatttttctttttttgtttgtttgtttgttaatagagacgaggtctcattatgttgcccaggctggtctcaaactcctggccgcaagcattcctcctatctcagcctcccaaagtgttgagattacaagtgtgaaccactaaacctggcctctttttctttttttttaattcttgttatatcgctgatctcatatgacatcttctctttggttccagactgtaaaaggtgggatttcagagacacgtattgaaaagagaattgtgatcacaggagatgctgatattgaccatgatcaggtgggaatgttgaagagatctgggcctgggaggggtccctgggcaggaagaccgatgaatacaggagtttgtttgccatcttcatctgcaaaaagcctctttggccactctagctcttaattgagaagaaagacaaagacaatcaaagtaagaggcctgtgggatggaggccacagattgaggagccaggaaatgtaatggaaagaacatgagctttggattccaagacttgattcaattgctggttcttaatatattctagctgttaactctctgggcctccattttgcatctgtaagatgaagatgatagtatctccctctcagggttgttgtgagaatcaggtgaaatactggatgaacagctggtggcacatggtgagctcagttaaatggagctattgttattccgaaggtaaaggtacctgaacccatgctagacaacatcaaaacaaagggaagcatgcccctacccttagagagctgtaacagccgagaagacacgagcgggagcatagtatggtggacaagacaccagcagactcgaaacttgttttctgccctacatctctaacttgctgtgtgaccttgggcaaatcacttttccgctgatttttttctcctttcctaaaagagagtgggttgatctagataatttctgggactgagtgctaaaattctatatttttatgttaattgggtgctaattgtgtgctgcaagcaattagcaaataataaggtcaggattaatgttcccagttctctgctgggtgaggttagaacagtaaagctgcagagaagagggggtggaagagattgcatgcaaatgcttctggaatcgttgactgggttgctggagcaataattctgtggcctttttatgctgatatgctgagtgcctttaaaaaaagaaaaactgagctacagtgctggcagttcccttggaggcagggttgagagttacagctgagaatagtggacacagggtcccagaaacaaggctgcaaagcctaaatatcttgcagcctgttggcccagctcagtgggtcccgctgctttagaagcctgcacccacccactcagtctggtgtgatctgagcccctgctacgtgctcagtctgcactagacagcaaaagcaatgtggtgaaaggtgtttgaggtttggagtgagacagacttgggctgaatcctgactctgcgacctaattggttatatgtccttgagcaacttatattaccaacctgagctctagttttaccatctgtaaaataaggatgatcacaggtttcttccagggtcataagggccaaacacacttggtagctcagagagatgctccagtgtccctcaggttttctagttactgagagtgcatggaaggggtaagctatggtacactctggctggcgagggaggcactttaagaactgttaaggagaagcagtgtggagcagcaggtttcatagagaggtgggcggaggcagagtcacaaagagaagacttgagctgggcctgaggtgtgagcagatgggttgggcaaacaggatcagggaggatggtcaggggcccacagaggtggtagttctaagaatgccattcatagagccaggagaccagaagagggttttccttcttcccttgccccttctagagatggttcttaagagccaggtgagtagtcagctggtcatttctagctgagtccttttccataggggagcctgcaaattcagagactgcagcccaaagaggatggtgtttttgctcttttgactttccctctgctctctttagcttttctaaagtaatcaaagctcctccagatcctcaaacagggaccccctcagaaactaaacaacagtgtggtaaagaggaaagtctgatcgacttgagttaaaatccctattgcacggctgggtgcgttggctcacgcctataatcccagtactttgggaggccgagcaaggtggatcacctgaggtcaggagttcgagaccagcctggccaaggtggcaaaacactgtctctactaaaaatacaaaaattagccagacgtggtcacggacacctgtaaccccagctacttgggaggctgaggcacaagaatcgcttgaacccaggaggcagaggtttcagtgagccaagatcacaccactgcactccagcctgggcagtgagactccgtctaaaaaaaaaaaaaaaaaaaaaaagtccctgtttcactacctactagctatgaaacagtaagctctttactgaaattcagtttcctcacctataaaatgcaaaaaattacattaccttaatgcactaagttgtcatgtttaagtaaaaagtaatgataatagttattatcttaataacaatatagttattaataaattataacttaatagagtttaagtaataagtaatgtacttaggctagtgcatggcatataacagtcccttgtcctcttccttcctttcttctactttggccaaggacatctcttcctttttcttgcacacttctttactttcctctcccgtcctgaacttgccacttacccatgctgaacacagatgttgttttgtcctttagattcacatcttgagtgaatcctctcagaccctccaggtataatgatagataatagataggtataatagataatataggccaggtgcagtggctcacacctgtcatcccagcactttgggaggccaagccaggtggatcatttgaggtcaggagttcgagaccagtctggccaacatggtgaaaccccatctctacaaaaaatacaaaaattagctgggcgtagtggtacacacccgtaatcccagctactcaggaggctgaagcaggagaactgcttgaacctgggaggcggaggttgcagtgagccgagattgcaccattgcactccagcctgggtgacggagcgagactccatctcaacaacaacaaaaaataaaaaaaaaataaaggatcatataacagatacagctatgacccccgaagtccctctccagttcctagaagacagcgctaaccttccctgtccctgtgttatcagtccagaagcctccctatgcaggatagggtgggtaaggtaattatcagcttggcttagcctaaagctgccctggtactgcagacaggagtattggatctgtcagaacatcagagaaatgatgaccactgccttccttcgccatcaggctattttctgcctcattgcccttgtttctgtcttttgtaggtccttgtacaagccatcaaggaggcaaaggagcagcacccagacatgtcagtgaccaaggtggtcgtccaccaggagaccgagattgctgatgagtgagctcaggtactgggcgttcctgctggggctgagggtgcccacagtcccagcctgagagggctctggatgggaccctcggacacactgggagcccatccccacaaagaggtgttcaccctgggacttgataaaggcagacgagaggctgatgtgggagatataggaaattaagtatttggctccaactaaagcagcctgtagcagtgccagcattattgggtaagaggagggacccaaacttggatataagcccccagctaccctctgagtcttcatgcatcctgctggagatccacttcaccttccccctctcttctctctactgctctgcttgctgctgtcacaggtctctcttttttttttttttttttttgagacggagtctcattctgtcacccaggcttgagtgcagtggcatgatcttagctcactgcaacctccgcctcccgggttcaaggaattctgccttagccttccaagaaggtgggactacaggcatgtgccaccatgcccagctaatttttgtatttttagtagagacggggtttcaccatgttggccaggttagtctcgaactcctgacctcaaatgatccacctggcttggcctcccaaagtgctgggctgggattacaggcatgagccaccgcgcctggccagtcacaggtatctttgagccagaacctgggaaagccagaggagaaaaaaccaagaagagcaggatcaggctgtctggagatgggtgggcatgcagagcagggaggtaatggctgaagctctgagaccagagtagagagctgggagcagggaagctgctttttgggaaccagggatccagataaattcatgcctaaaagtaattttaaaaagacttgaagaagccaccaatctcactaggtgggaccaggccctgtaaacctgctcacatccccattgtcactgatggccacaggaacttggcaatgggactaggaagctttttcctttgcaggattttaaattttgcttctttgttttctctaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccacggaattcttcgggaaatcctccaaggactcttgtcagctgtgttggaggccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacacactgaatattccgtgtgatctagaacagtgtggcagctttcacagcacaggaccgttcatcgggggcctaaacgtttccctcggctctgtcaccaactcacttctctcggct

SEQ ID NO: 13676 - DNA, 11989 bp, Human
tgcaaccttcgcctcctgggttgaagtgagcatgtctggctaatttttgtattttttatagagatgggagtctccctaagttggccaggctggtcttgaactcctgggctcaagcaatccactcacctctgccttccaaagtgctgggattagacatgagccactgcgcctggcccacttcactgttttaagggcttcatgaattcacatgcacctaccccggctcaggtaacctgccctcactggaggcacttaggttttttccaatttcttgctgttccaaaccatgccacagtgaacttcgttgttcctgtgcagtgccagaatgtctgtggtgcaggctcctagaagcaggatggcaggctcctacctctagacatttcttttttttttgagacggagtctcactctgtcacccagtctggagtgcagtggcacaatctcggctcactgcaacctccgtctcctgggttcaagcaattctctgcctcagcctcccgaatagctgggattacaggtgccgccaccacgcccagctaattttttgtattcttagtagagacggggtttcaccatgttggccaggctggtcttgaactcctgacctcgtgatccacctgcctcggcctcccaaagtgctgggtttacaggcgtgagccatggcgcccggccagcatttcccattttgatcttagctgcatttcgaagcctctgggtaggcgatatgctcactttcttccttgtgtgtgtgtgatggagggtaaatggtgctgaccgaagggtcccactcaggcagcctatctgttcagccctcctctgaccacaagcccctttctgcaagatgggaagctccagcttcttccagacctctctctaggcaaacttcatggaggcatgaagacattgtgctttaccatttactagacctgagtttgaatctcacccatgctccttaaacactctggattccattatcatagctacgaaaagaatataaacctctcagggttgcagggaggatgaagctgaacacgtgaagtgcgttgcaaacagttacacaggagttagctattgtcctcagctggtgctgacagctctttcccaagcatgagagaggctcttccgtgctgcctatccacacttacctgcagcaataaggctgtctcctgagtttacaaaagggcttggtccttgacctatttcctcacttcttctggacttcttgagcgctaaagtaaagaatgaaactcttggacaaagccattcattcaacaacaaatatttattgagcacctactacatgccagccactgtgctaagcaccatctgggcctcagtttttccatctgcaaaagtaggaactgtgcttctgaacagggaaacgctgggcctctgggtgggggcagcctttggggcgggactgcaattccgtcattggaacccagggacgccccgcatgtttccgaacggcctccagggggcaccgccgccctgaactgagagccaccggagccgggtagggggaggcccaactttccgctctgtcagaggatgatgccgagggcccagatgagcaggatttggactgtgttgctgggaacgggggcctacactggccccaggatgagttcgtccgtacctgggggccctgggttctgactctcaggtcagacgcagccaagatgcaactcaggaacttcaaggtttccgctccggccaagagccccagtccggcaggggaaagggtgggggagtcgcccttgctcccccagcctcagccctcgggaggcgcagcgtcagggcgggcggcagcacagaaaccccccgcgccgctagagggaccctcgcagcagctgcgcgggcgacctcgcggtcacgtgcggcaagggcgggaccaaacgagcgtccggccaatcgactatgccgtcggcgagcgtgatagccaacaggaaccgggagcggggtcccgggactgggaagaaacggcggccgggagggggctccggggaccatggggctcctgaccattctgaagaagatgaagcagaaagagcgggagctgcgactgctcatgctgtatcctaccggacgccggaaccgcgagggtggcggggtccagccgggcaggcggtgccgggcgccccctgtcgggagcggaacgcggcggccggcgcgtcccaactgcccctggcgtcaccacgcgggccccatcaatcgccccgtcgggccgggaggagccgcaccccaggactggggcaggggccagctccgagggccgcagaagcggtcctgcaggcgcagcggcggggctaggcggcccgagtgtcaggggtggtgggtcccggagataactcggacgccaccacccggcggcctggcccaagcgtggggccgctgccctcccggctctgatctcctcccccgggcccgagggttccaggccccggccccgccctcgagctccgaatcccgggggcgtgcggggtggcgggtggcgcgtgtgggctccgcggatcctttcgagcgtggatccaacagtccgtctctttggtgttacgcggcccgtggttgtccctgcggctgaggatgtgtgtgtgtgggcccgagtgtcccgtgcgccctgtgcgccttctgagtccagttaggcgcccgcacctgttcccccagctctgtgccaggctccgcgggggaatggctggggagataagacgcttacgtgcacatataacttaataatcacatcatgactgttttgttttttgagacagggtcttgctctgttgccctggctggagtgcagtggcacaatcaaggctcaccgcagcctccagcttctaggcttaagtgatcctcctgcctcagcctcccaaaactctgggaatataggcatgagccacggagtccggcccatgtctgttttattttgttttgtttgagacggagtttcgctcttgttgcccaggctggagtgcagtggcacaatctcagctcgctgcaacctccgccccccgagttcaagcaattctcctgcctcagcctcccaagtagctgggattacaggtgcccgccaccacgcccggctatttttttaaatattgttagtagagacggggtttcaccttgttggtcaggctgttctcgaattcctgacctcaagtgatccacccgccttggcctcccaaactgttgggattatgggcgtgagccactgcgccgggccgcatgtctgctttaaagagctctaagaaaagcatacagttcactcatttgataaatattgagtgcctaatatgtgctagacactgtcctagtgcccagggtaataaaactaaaaaatcttaccttcatggaaattctgtaatgcgtgtgtgtgtgtgtggcgggggggttgcccgcgggtagaaagatgataacacaggaagtaagtaaaatatgtaatagaggctgggtgcggtggcacacacctgtaaccctagcactttgggaggctgaggtgggaggttcgcttgagcccaggtgtttgagaccagcctgggcaacatagtgagactctgtctctatttatacatatatatattctccatacatactatatatatatgggccatgctttggaccatgcttctggggaacagggccttatactgctccaggatgaactcccactacgtatataggtatggagaataatgcaatttagggtggtcaaagaaggccactgtatgatggcagggcgcagtggctcatgcctgtaatcccagcactttgaaaggccggggcggatggatcgcctgatgtcaggagttttgagaccagtctggccaacatggtgaaatcccgtctctactgaaaatacaaaaattagctggatgtggtggtggacacctttaatcccagctacctgggaggctgaggcaagagaattgccagaacccgggaggcggagactgcagtgagctgagatcacgccattgcagtccagcctgggtgacaagagcgaaactctgttaaaaaaaaaaaaaaatgacaattgagtacatgagggaggcgagggttgaaccatatagcaattcgggggggggggaaactttaaagcaaagggaacagcaagtcagaggccctgggaggactaactggcgtgttcagaggactggtgaggagggcagtatggctggagtggggaggaggagcgttgactgggaaccccctcacctagggccttttggtttttggttttccctttcagtgagaagtgcagtggagagaaggaatcgcagaccagttaggccactgcagtgacgcaggcgagataggatggtggcttggaccaggatggaagtagtgaggtcatggaagtttctggcctgagcaattagaagggtgaggaaccatttgctgagatggagaggactgggggaggagcaggttcagggtggagatgagaaccctgtgtgtgcctgtgtgtgccatgtgagatgcctccgagacagcccagaagtgtcaggcaggcagctggatgtaggcactgaggtccagtgtgtgggaggtgcacatttgggtgttatcaggatagagatggtatttgaagctgtgatcctggatgaggtcacccagggatgagcgtggccagagaagagaacccggttgtaccaggatgaagtcaggtgaggagcagaaccaggtgagggtgtgtcccagtgccaagggcagcgcatgtgctggggaggagggtgagccactccatcaggtgctgagtggggaacagaagatgactgagcgctgtcccagcactagagggccacagggaggtctttggggactgaccttggtaaggacagttttggccacagcagcagcaaaagcctgatgggagtgtgttcttgaaagagcaagaaggcagaaatgggggtgagcacaaacaactattttgagatttcctgtaaaaggaaagatataaatgaataactagatggggcagagagatcaagggctttgtttgctctttttttttttttaatcagacggggtctcgctgagtcgcccaggctggagtacagtggtgtgatctcggctcattgcaacctctgcctgccgggttcaagcaattctcctgtctcagcctcccgagtagctgggactataggggcccgccaccacgcctggctgatttttgtagttttagtagagatggggtttcaccttgttggtcaggctggtttcgaactcctgacctcagatgatccacccaccttggcctcccaaagtgctgggattacaggtgtgagccaccgcgcccggcctatttgctctttttaaggtgggagaaagaacggcaagctcatcagccagtgggaatgatcaagaggggaaggaaacatggatgatggcttgggggcagggggtcatcagcggctaggttccaggggctaaggctgggcctcaggggaaatgccctcctcacccctctcctgggcctaggtcatttgccccagctccgatgagcagggaaaggtggtcgagtccaggacccgcccaccccaccatgcccaactgagctgcagtgttgggaagatagaggagggtggttccttccacaggtaagcacacccattaatttgcactgtgcagtagcaggtctggaatattccagaaacaaatgagggtggctgcctccagatatttgttcttaccttagttcttcaaaaagcttgctccttgtattttgggtctcagctccagacacctcagagaggccttccccggcacctgagctgaaagagcctcctccgatggccctcttggaaagcctctctgttgtgttgatggcgctagccgggatctggcagggccttcttttctcatttgtttgtactttattgactgtcttcccgctagagtgtaagcttcctaagggcagggctttgtcctctagcacccagaagagggtctggcacatagtaggtgttcaacaaattaaggagcctttggtcagtagagatgatatttataatttgatactttcatatttattgtgggccgattatggtcaggcatgtgctcaactcagtttgatacatggtgggaaataatgagtcccctaaggggctctgcaacaatgtcaccacctggcagagaacagggacttctccttaacctgctgcgccccagtggcctggacaatgctggaaagacaaccatcctgaagaagttcaatggggaggacatcgacaccatctccccaacgctgggcttcaacatcaagaccctggagcaccgagggtgagcaggggccccatgggagggccagcccagagcagggcagggaaggtgggagaggggcccagctgaccctcctgtcacccgctccttgcccagattcaagctgaacatctgggatgtgggtggccagaagtccctgcggtcctactggcggaactactttgagagcaccgatggcctcatctgggtagtggacagcgcagaccgccagcgcatgcaggactgccagcgggagctccagagcctgctggtggaggaggtgggcagctcctaccctttgtgtacatgtatggacgtgtggctgccttctcagcagatgcccagaggggcccgtggccccagagggaaaccagaggcaggatcccttccttctctgggcccccaccatgggaggcccatggtgccagaggcaggacacatgctgtggactgagattgagttaacgtccctgtggtgttactacgtcactaccctgagcatcagtttctatgccttgaaatggtgatgatgacacccacatcactgggctttagggaggataacccaaggccagtatgaagcttcgagaggccatggagcctggctcaagagtctgactctttgctgtgtgacctcagctgggggtggtggcacgcacctatagtcctagctactctggaggctcagacaggaggatcagttgagcccaggaggttgaggctgcagtgagctgtgatcgtgccactgcactccagcctcctgggcgacagagcaagaccctgtctcaaaaaaaaaaaaaaaggaaggggccaggtgcggtggctcacgcctgtaatcccagcactttgggaggctgaagcgggcggatcacgaggtcaggagatcgagaccgtcctggctaacatggtgaaaccccgtgtctactaaaaatacaaaaaattagccaggcatggtggcgggcgcctgtagtcccagctactcaggaggctgaggcaggaaaatggcgtgaacctgggaggcggagcttgcagtgagccgagattgtgccactgcactccagcctgggcaacagagtgagactccgtctcaaaaaaaaaaaagaaggacacttgcaaagatagtacagaggtcagaggtcccccatataccctttaccttgcttccccatcttacctaaccgtggcctgtccaaactaataaatcaacactggtgaattactattatcttaattacagattttatttgaatttcacgtttttccactaatatactttttgtgttccaatgtttgattcaggctacaaaattgcatttagttgaaaatgaggacacttgtgagagtgaaaggggggattctgcaggcagagtggggactgtcctgggcacaccgcacacatctcctatgtgggtggagcaggtcagatgagatcagggccgtcaaatgctggtcaaggcaggtcaaggcccaagggttagacccgtccacccacatctctcccaatcacagacacatatgtggaaacaactagaatcagaggtggacagtgaggcctgtcgggagtggaacggttaaagggctgtgtgaacccagaagagggagagttcacatcctctgtgcatgtctggtcatcagattggagcagtctagaaccacggagagctcagggatcatcttatgcaacacccctccctgttcatggaagaggaagctggagcatggggacagcggtgtcccctgggtggtggttggctggaaccagaaccctggcccagggctgctccattcatgtgggccagccttgatggctacgtccacaaactcactcctgggcctctcccaccaccacggggcctcaccttgatcttccaggtcgatccttcaccccagatgctctgggccattagaggaggggtcaggctgtcctctgagtccccaccccacccctctatcttttctcccccagcgcctggccggagcaaccctcctcatctttgctaataagcaggacctgcctggagcactgtcctctaacgccatccgcgaggtgagtccaggccccgggacaggctcgctgagggaaaggggcatacatttatttattttaaaagcatttattaaaaataaccaaaaaggctgggtgcagtggctcacgcctgtaataccagcactttgggaggccaaggcgagtggatcacctgaggtcaggagttcgagaccagcctgaccaacatgatgaaaccccgtctgtactaaaaatacaaaaattagctgggtgcagtggcgtgcgcctgtaagcccagctactcaggaggctgagacaggagaatcgcttgaacccaggacgtggaggttgcagtgagccaagattgcgccattgtactctagcctgtgggaaaagagtgagacttcgtctcaaaaaaaaaaaaaaaaagaaagaagtaaaataataataagaaaagcatttattagcctagccctgctaggtggcaggacctatgcagggcactggggatccagtgattaataaggcatggggtggcccacagcctggggaaggcagagctgcgcatgtgttgttcacaggctaacggtagccagcacaagtcagtgctttcagtatgctctgctccttgcatggattaactcatttcattctcacaaccacctcatgaggtgagaactattattttacagatggtgaagcaggctcacagaggttaggtaacttgtcccaggtcacacagccactaaatagacaggaagcctgtgtctgaccccagagcccacattttaaccatgattctagtgctcaagcaccacagtgagaaagagcagggttaaaatcttggctctgccacttatgagctatgttcccctaggcaggttgcttaacctctctgaactttggtttcctccttggtgaaatggtcgacacaatccctggctcatgagggcttgaggagaatgagtgagagagggtgtgtggggctcctagcacgatgcccggatcctggtggatgctcaggagcccatgctgcatttacatcactaaggggcagcactggcatggaactggacagagagcccaggtgcccctggggtctgacaaactctccctgggaccggcggggcttcctggatgggatgacatggagcagggccttgaggaaggcgtggagttcctctgggctggggagggaaggggctgacggcaggcagggtctgcagtcactggccaccaccatcagcacctttgtcctcccaggtcctggagctggactccatccgcagccaccactggtgcatccagggctgcagcgccgtcaccggggagaacctgctgccgggcatcgactggctcctggatgacatttccagccgcattttcacagctgactgaaccactccagatgccccccacctagcagtccaggtccctcaaccttcaccaaacactacccatggggggttgggagtcagccggccaaactaacactccccctcctccaccccagcctgctgctgctactgctgcccgctgctgctctgtggccacccggctcccatggcgggagggctgtgccctggctgtctctctggctcctgacctggcctttggctaccataccaagaagagagggctgggcggggaggagctgctactgctgctaccgaggctgtgggcctcatccttcactcagttgtgaaataaaccgctccttgccccgattcctggctgagtcatttgttgattcaacagcgttagagaccacctgggaccctcaatctagcaggggacagaaaggaatggatcattggagtcgatggtgaactgtggctatgtcaaagggatgcagaaaaagttatagaagcatgggacacggtgcaactgattccatctgcaggcttcctaaaggaggtcacattaaagctgggagtaaagcgcgagtagttttctaggtagaggaaggggaagacagttcaccaggggaaatccaactctcataggtatgaattagaaaaacagacacagctgcagaccagggctccaactttttgcatggaacatgggctgaaattcagctcccaattctctgttgcagccaggaacccatgtgcagtggacaacctgaacagctgtacaaggccagcacagattcaggcagaggggatcacaggacaggcatgatgagcaagggctccggctgggcgcggtggctcacctgtaatcccagcactttgggaggccaagatgggcggatcatgaagtcaggagatcaagaccatcctggctaacacggtgaaaccccgtctctactaaaaatacaaaaaattatccgggcgtggtggcgggcgcctgtagtcccagctactcgggaggctgaggcaggagaatggcgtgaacccgggaagacggagctggcagtgagccgagattgcgccactgcactccagcctgggtgacagagcgagactctgtctcaaaaaaaaaaagcaatggctcttgggaaatggggaggtgcatagagtcatgtgtaggagagagtgcagccagagggtgggaggggggccacatcaggcaggggtaactgaggccttccctgaaggctacaggaactcagaagcagtgccaggttgggaaaggataggaaatgaggccaccccaggggtccaatccaagtggcaaaactggcagatgttttcatggcacagggtcctagcagctgcttactctgcagggttctgtgtgaaggggtggcctgtccctccacacctgtgggtatatctcgtcaggtgggacgagagactgagaaaagaaataggacacaaagtatagagaaagaaaagtgggcccaggggaccggcgctcagcataccaaggacccacactgggaccggtctcttagtttcttcagtttttattgattattattttcactatctcagcaagaagaatgtggtaggagagcagggtgataatagggagaaggtcagcaaaaaaacgtgagcaaaagaatctgtgtcataattaagttcaaggggaggtactatgcctggatgtgcacgtaggccagatttatgtttctctctgcccaaacatctcagtggaataaagaataacaaggcagcattgctgccaacatgtcttgcctcccaccatagggcggtttttctcctatctcagaattgaacaaatgtacaatctggttttataccgagacattcagttcccaggtgcaggcaggagatagtggccttcctctatctcaagtgcaagaggctttcctcttttactaacccacgtcagcacagaccctttatgggtatcgggctgggggacggtcaggtctttctcatcccacgaggccatatttcagactctcacatggggagaaaccttggacaatatccggctttccaggacagaggtccctgcagctttccacagtgcattgtgcccctggtttattgagactagagaatggcgatgacttttaccaagcatactgcctgtaaacattttgttaacaaggcacgtcctgcacagccctagaccttaaaccttgattccaaggccgggcgtggtggctcacgcctgtaatctcagcactttgggaggccgaggcaggcgaatcatgaggtcaggagattgagaccatcctggctaacacggtgaaaccccgtctctactaaaaatacaaaaaattagccaggtgtggtggtgggcg

SEQ ID NO: 13677 - DNA, 18160 bp, Human
cccatgtttaattctctccaataattgtacagaacaagaaaaacaagcaggtctaatttattatctcagaaaaaattataaccatacatggctgagatcacagtcacctctctctccaggtttcaagtgttgtgggggttccaacatcttttctatttattttaaaaaaccacagcagaggggttgtgcaccctttcatatttcttggctatttggatttgttcttctgagacatgtccattcctattttttgctcattttctattgtttttgccttttttctaattagtttttaagatgtatttgtatattacaggtattggctctttatcatgtatggcaaatattttttcctcatctatcattgtctcttgacttttatcagtgttaattttcggggtaatcaagtatatctttttacagtttgaggttcctgtctttgcagtctctcaacccctagaatacccttatagtctcctaaattatattctaaatgttttgttgtttaaatttaagattctacgccatttatcaacgaaatcatcttttcctgattgaaataaaatactacatttgtggtatttccggattctgttgcactaatgtgtctttcctaccaacaatatcatattgttttattattgtggttttttgtttttgagacggagtctcatgctgttgcccaggctggagtacagtggtgcgatctcagctcactacacctccgcctcctgggttcaagcaattctcctgcctcagcctcctgagaagctgggattataggcgtctgccaccacgctcggctaatttttgtacttttagtagagacgggggtttcaccgtgttggtcaggttggtctcgaactcctgacctcaggtgatccccccgccttggcctcccagtgccttggcactggcctattgtgttttatatactatgtttgtcatctggaaaggcaagctcctgctccgtcttgtaaagttttcccagtactgtagtagttatttttatttttatttttgacagtctcgctctgtcacccaggctgaagtgcagtggccccatctcggctcactgcaacctccgcctcccgggttcaagcgattctcttgcctcatcctcctgggaagctgggattgcaggagtgcaccactacacccaactaatttttgtatttttcgtagagacggggtttcgccatgttggtcaggctggtctcgaccttctgaccttgtgattcgcccgcctcggcctgtcaaagtgctgggattacaggcgtgagccaccgcgcccggccgtagttattgttttatacgattttaagatcatttaattaaatcctctgaactccgtggagattccaatagaagtgtgtatttgtaatttttgaactgacaaccttctgttacctttcatctaatatgttgttgcatcagttcaaatactgttttaaatccttcgataagtcgtctctattcgtagctttttgggtcacttttttttttttttttttttttttccaaaaaaacaggaagtctttttacctgcagcgtcaactgagccggttttccggcgcgcgccagcccctcccctgctcccgccccaaggttctgcgttaccatgggaacaaaggttgacgtcacttagggcttccttgctggacccaagggtcgatggtgaagggagacgggtggagaggcggttttgctccatctacgcatgcgcacttcctgctccaggactcccccgccgtaaatctcgttccggctgggccttttccgccgcgactctcgcttaatcccggagaaactgccccctgggggaggggagtagaaaaaggctgaaaccagcgacagccaatcccgcgacactacaacgcaggcgagattgattgagtccaccaccgcagccaatgagagagctcgccgtcgctccgtcatagagttcgccccaccccatcccctcctttctggactcggagctcagttcacgcagtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttgggtaagctgggcccccccgggctgcccccgctccccgggcccaaaggaggcttcgagccgggccctccgcctgcacccgggcctggggcggggctgctggctcccgggccgccgccgcccccgcccgtgggctcgatgggggccctgaccgcggccttccccttcgcggcgctgcctccgccgcctccgccgccgccccctccgcctccccagcagccgccgccgcctccaccgccaccgtcccccggcgcctcgtacccgccgccgcagccgccccctccgccgccgctctaccagcgcgtgtcgccgccgcagccgccgccaccccagccgccgcgtaaggaccagcagccgggcccggccggcggcggaggaggtgagtcgggccgagagagcgcgagaggcgtcgcgcggacgggcccggccgcctgaggggcgcgcggcggcggcgacggcggctgcacgcggcaggggcgcgcgtgcgcgcacggggaggcccgggcggaggcgcccctgggcgcgcgcggcctggttctagggcctcgagtgcgcacgcgcgctgtggggggagggctgggcgggcgggaggcgctctgtgcgcagacgcagtgaggtggccgggctgtgcggcgcaactgtatagactgggggcccactattgctgtccagtccgctggtgtcgggaacaggggtggcgggtgttcagcgctggacggggtgctagctgtgaatgccagcagggcgtgaaagcctcacctgatgacgtgcagcgactcccttctggtcttgaggaaccagaatgggaaccgtaccaaggatagctcctctgcttctacagcaaggcagggttttcatccgggagaggttggcatgcttcagatgatggttgggtctgatctttcttggtctcttttggggagagaattttagtttgtttttttttttaaatctgttcagtatgtttagatctcagtctgatcggctgccctgtcgctttgttttaaaaagcttttccctctgatcctgtaccccttgggaaatagaaggactcttttgtggcaaatgtagggagtttctgcctatgtacggggaaaggagaacttggctgctattgtataggttgttgaatttttgatagatccttttaagagttcagaccctcagtgtccaactggccaggaaaactgaatgctgatcttggctaaacttatgaagacaaaggtgatcttgttgaagaattgggcttttcccacttggtagggtgtaactaggtttagttgtggtccggcctctcgtacaaaagtgactggtgaggggagtggaggtgggtggagcccccagtcccatcaggactgctttacaaatctatgattcttcagtgtatttttgtctcccctggggatttcagagcactcatggttgatgtagtatctatctaacactctctgcagccatatgcattaagattaccacgtttatatatctgacagtttttctagacaaaagaaggtgaaatgttaacttgcctgaccaaggaccacatacccttgtagtggccataagctttaaatctctgatctctgaggtttgttttctgtttttttaatgtttaagttttaggttaagctctcagcttcacagtctgctgagtttctgtgtagtaccttaaatacccttagctgtctgttgataactacttgtatttacatcggatggattttgtctctgccttttagacttcccaagtaagaagcggaagaggagccgctggaaccaagacacaatggaacagaagacagtgattccaggaatgcctacagttattccccctggacttactcgagaacaagaaagagcttatataggtaaatatacgttctgcatccaaatgcactttgagattgttacgatttattctgagcaagatctgcattttttgaaagtttgagattgtagttatcttttttgagatgagatactttcacgactttggtatcatctgtcagtttttgcccagtgagttctgcatttgcagctccttgttttggtctgttcgtaactgcagtgttctccatgagtatcaggaaggtagggtttcacttaggagtaagaacagtccccagtccagcagccacccttttcagctgctgttcattgccagttgatgaggtgagtgtcatctgcctctctggacaggccccagtggagaacaccgcaggtactgtaaaccaagtacttttcacagcgtggcctttcaccataattttatatttctccccctaaaatgtggtcttttactttttataggtactttctgaaagaaaaaaaaatgacaaaaagtggttctgaaagtgtgtttacaatttacccctttttattttcttgaatttaagagtttaaccttcccttcaacatcttttctggtttggtctatggagagctgtcttaaaatgaaggctcttgtatttacttttaaagaactctgctgggaaagggatattgcatggatatggaatgaagtgctaggataaaaaggttttatttgctgggaggttttgagaattaatgactatccacagtggaattgaaattaacctcaaaattgcttttttggaaaaaaaagtttttaatgcaagttttatctttatatacctgtgcagctgtctcaaaaaagttcactttataaacatttcctactaaccaaataaacatcccctttggaggaaattcgggcaaagacctcctaaacctacgaggctgtggccttcacaaccaaaaagcttcaaggccagcatgttactacttttgagggtcttaatttcctgttttttagactgctgagaattttgaggcgttggaattgtctgtctcctttcacagtactactaatacttgttctttcccctactgttcctgtctactcccacccattccgttgtgtctcatattagactagtctgggtctttacatccttgtgaaatgcccctagtggagtgatatcccaagaacacaagcatacttagaagatgggaagagcacaaattctttatatctccatttctgtttttgtggagggctagttagttcactgggccctaaggactatttatagctataatcaaaatagaatcaaaggagaggtgtagttctccacagaagagaatgaccctttttatttagatcaggccccacatctccatagtcagctaggaagactcaccttctcccctcagtgaaggtgactttcacctcgagttgttgagcttaatactcaactgcaaagtcagaactttttaggcataaaggagcttggggaaccatgtgtcttactacttttctgtctcccacggtacatactgctttgtccaggatgccctcaatatctttttttttttttttttgagagactgagtcttgctgtgtcgccaggctggagtgtagtggtgcgatctcggctcactgcaacctgcgtctcccgggttcaagtgattctcccacctcagcctcccaagtagctgggactacaggcgcacgccaccatgcccagctaattttttttgtagttttagtagagacggggtttcaccatgttggccaggatggtctcgatctcttgtcctcatgatctgcctgccttggcctcccaaagtactgggattacaggtgtgagccactgtgcccggccagtattttctttcgataataatgggttttcatttcttcagggttttagtgtgtgggtgtggtatagccctgtggatgtatttaaagttagaaggaatctttggttagacacgcattaatcctatcttggagccagctcagttttaacccaacctagtaacatttgcccttattggagatgcctgctgaaaattctcagatgctgcgaaggtaaggaacaggtggttattccgcatgttgaagaaagctgctctggctctgcagttcccattatcttggaaaatcagctgtgtaacatttccctggcgtcactggcaacttttgtgaaaccctcatctctctttttcatgcacagcctcattggtcaaggcccgagggccaagtacattgtccttgaacacacattccattcttctacacgcctgctccccatatgaacagtgagcctgaaaacaaattcttagcactttatggttactggtttattaagatatgtggtttgtcatttaatatttgaataaatatttcatataattgaataagagctgcaggtattgggagacccttactagtacaggtctggttgtacagaaagagtatgtacaaatttctataaggtgttgaattttgttattaaatgtcttatttaaggaattttaaatgtattaatgaaaatgatctttgctcaattggtatttttccttgtcccatgttaattgggtctcattttgggctatgtttaacatttaatgaagaaaaaactcaattcttgccctcaagtaatttgatgggagtcgggtattggtgacgtaacatggtttatggttctgggtaccaatggtaagcaagccttggtggggaggaagaggtgaaacacctcctaataattgcttggatgttagccttagtgaacagtctttattgctaacccctcttccaacaaactgtttgcttccttaagtgataaccattttgaagtgaaaaaaacctatagatgtaaaaggactcctgccgataggtggttgggggtttttgcttcaatgtgttcactgatcagtcgtccctttcaaagtctccgagttcttcatgcttgttgttgagatttgagatgtttattggtaacattgtcttttttccatccttttttttctttcctaacctggtttcttccagtgcaactgcagatagaagacctgactcgtaaactgcgcacaggagacctgggcatcccccctaaccctgaggacaggttgggaaacagttttaaccagctgacagtaacgcttttacctttttctcaatacgttttactggtggcaacatattgtgtcagttcaataaaatcatagtatgacgactgtaccctgaccactttggggattaaggtttaattagaaatatgtatggtcagtcaacagttagaaaattggaataaaacttaaaaatgttgggagaataaaaagttacaggaaaatggacaactggtttccaattggtaagcatgtagatcttaacctgatttacccacccttaggggacagtgaggtggcccgttaacctgccttttcagtacctgctttggccaaaagcccagggcatagagtttttctcacaggtacacagtgcagggactaaaaatatttttgagcatcactgaacttgagcaagccaggagctctggtcagctcattgctgcagtcttcctgctcatggttttgagatggtttcaaaatcagatgagatttctaaccaacttctttcactgccagttaactttcagccttggccattgccttgggggtgttgggaggggccagaatattctcacctattttgggaaggcatgcaaccaaccctaaattactttttttttttccttaaagggagcgtgggcctcaaacagctgtggtcatgtcatttcagtttgcagtttctctcacctcagaaaaataaattgtgtgggggagatgaacttttttaaactggaattttattagctgattgaacagctaaaattggtcatttaattagaagggcagtaagtctctccctctcactgaattttctcttagtacatacagaatagttgaaaagactttgctttaaaaagtagtgtttttggtttttgttacccagttaatagcttattaaatcaggaagatgatgtaatggctttagaagtcactcactcatgcatctttcttccgccctttgccaggaaacattaacttccttgtttctccatattgactctttaatttgacttactacatttgctatattttacctatagatagattttggttgtagggttgtgttgtgtttcgtttctttttgaagattttttttttttttaaatttacattgtaggtcatagaccacaactgtttagtgcctttttggcctttttccctttaataatatgtctacaggtcaccagtcaattcctccaaaggttgaatttttaacaaaccttctttgcttcctggataactgggattagaatttagttgatgtagccgatgcctgttggaggtgaagaagtcgggccagtctaacctctagaatactagcttttgcctttcacttctgcaatttgggaggaggttaaactgttgtgaggccttcacatggccaattgggtgctggtaagacttgtttttgtaactagctaagaatgcttaattctagacagctgtggggtgggaattagaaatgtcaagcatgttagaaataaaaccagagcagggtttttcctcccttctattcagttttgaaagaggccctaatgcctgattggttttgcttttgagcccaggttggagggaaatgcatgggttttcttaattaagataatttcttaaaaaggtgttatatcacttaagccactttattgttattttgatgctgcttaacttgcacagtaaaaacatgtttaaaacttttcttgtagacttaaatgtataagatggtagtctaatgagctggggtatgtttgcttttgttcactcttaatggattgtgctaacagtttatacaaatgctagaaacggaggtgtcatttagccgtcattagccatgaacaaacctgaccttttattccatcgtgtgtgtaacgtggtgtgacatggttccctttaggctgaagacagtgggagcagccgagttcagtccttgctctccaactaggcaaggttctctcaactaaaccaagggtataggagtcttgattactttcagtatgtttttttaataacctgatccacatggtctcttcccttcttgcagctgctactaaattttcattcagaatatcaagctatggtcctttttgtaatcttaactcaaaattctaggagtgtaacctctcttttttattaccgcaaaatccagctgtggtaaactgaccattttatcattacatttttttacttgtagcaacagcattttactccttaaaaaaatgagagagagaaaatctgctttctggacttgtaaactctggtggagaatcataggttttccccttgctgtttgcaggttcagaccctagacaagtatgaccaaatctgcatttgcagcctctcgcagaagctgctttagcactttaacgtttttctctacccagactccccaacctcgaacagccagaaaacaggttgtctcctgggccttggacacagccagccaggccattgaaggaaaagcaaagacgaagcgaaccatctctctccattgtgggggccaagtagctgcagtagccttcagtcccagttgcattgggttaaagagctcatacatactatgtgttaggggtacagaagcttttcctcatagggcatgagctctccaagagttaaccttttgcctaaacttggggtttctgtggttcataaagttgggatatgtattttttttcaaatggaagaaaatccgtatttggcaagaagactccaggggatgatactgtccttgccacttacagtccaaagattttccccaaagaatagacattttttcctctcatcacttctagatgcaaaatcttttatttttttcctttctcacacacaccccagacccctaacgttaagccagcttccatctccccattccacacgatcttgagtagcacacgttatggtcggttcctccgaagagtgttgtattagggtctgagaggcagaggggctgggaaagacttgttatagtccgtgtgggaatgagagaagtcggtgcagaatagtaaacgggagtctgtttcccacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaagtaagcggaggggctcggtcatctgggatgaagacacatgcagatcatgggtgacctgctgggatgggacagtattggtactactcacctcttgcctcaagtcacccataattagcacttggtaccaatatttggttttagaaaagccgctggctgtgtcattctccagaaatgtgcggtgacacaggcttttctttcttagacctccagcaacacgtgtgagtgataaagtcatgattccacaagatgagtacccagaaatcaactttgtggggctgctcatcgggcccaggtgagtaactgctggtctataggatatagaattcctttagagcctgtgagatgtgtccgttttgtgcctaattggggactgttggcttacttttcccctttttggtaggacatttcattttggctgaattaatgcctttctgtgagaaggtgtcttaacttccccactagtgcggagaagtcaaatcctcaggtttactgtggctgaccataatatagagttcatggagctcttggtgggaaaatccaattctctgcgcttgtggtttcccaccaatgccaaattggtccagcctctcttccctcttgagtgtgaatttgtcaggtataaacttagtcatttctgcctctctagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacaggtgagcggtgagcccagaaaggaagcctcctggcagaaacctaggtggaggccctaagcacttaactgtccattgcattttcactagataagaaacatcctgaagcagggtatcgagactccagaggaccagaatgatctacggaagatgcagcttcgggagttggctcgcttaaatgggacccttcgggaagacgataacaggtatgtgatcagtttaaaggagagtgtagagacctgaagaacctatggaagtagagattgttcccttgcattgacctctttttcctttaataggatcttaagaccctggcagagctcagagacccgcagcattaccaacaccacagtgtgtaccaagtgtggaggggctggccacattgcttcagactgtaaattccaaaggtgaggggctggctcttgcggtttcctggtagcctgcgatgtgcaggacaacttttctggcacattcattggttgctgttaatcttaccaagagaaacatcctttctgttagtgtggtctgtaatggtgtgatttaaagcccaggatgattagaaataggctgtacagatacccctgtttgtttgtcttgagcccaagaaaactggaagtttccattttgggtatgtttttactggggctcaataggaaattcactgcttttgctgttcagaattggttcaagaagactaagcaatctctacagatttctgaccagttgcaagtcagcactcgatatcaacactttctgactggctggcgaatatgtaaggttttgtttaggaagttcgttctggcagttgtgccagtcttgcatagattttcctttcctcaaactgggaatgaagtttgatgaaattgacttgagagaacctgtgcttcatcggtgctcagggtctcctgtgctcttcgcccaggggcccctctactctggtgatcccagatgcagaactgggcacgaaactgaagatctgatgagactgttgagagccatgcccagtaaggggttagaaagatgtgtgatgatctggtgattgaattcttcaaaactttccatatgttggttcctcaggataaaagcttccttcttaacaagtttttcccctttctctgtttgtgtcccccaccccacttcaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccggtgagcctgggggctggctctcttggtctggcttccccattctctactgcagagactgggagctatggccacgtggtttgggtagagcagacaatggatgtggatggcaacattgttcttccgggatctcaggccagtttggggacttctcacttcgggaagaccttgttcttgtgttctggtcctgtgtcataacccgaagaacaatgttgccactagggggcgcaggcagggacgttggcaggaaatgctctcacgtagtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatgggtaagtaagtgtcagaccagaaaccttgggggctttgggataagcaaggggttacgtcaggtcgctgttggctagaagcagctctcaagtggctgggcaatgtgctgggtctgcctggcttgccagggttgtggctctggaaggagcaagactccattctggttcagggagtgattctgtgttgggtaagcacagacctgccttttacaggcatggttttcagaactcgcgtaaggatagcaactgaggttatcacaggggtggcttccctggccagttccaatgtcctgctaagtccctgctctttccttccatcaagatcagtacctgggaagtacgcctgtgggctctggggtctatcgcctgcatcaaggaaaaggtaatggctgtctgctggctgtgggtcttcacctaggcttgggtgagtgggggttctggcccaagtccccgcctttccctgaggcctcatctttgcctccacctgtccacaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaagtgagtagaatattttgggcttgtgggggtgggtgggatgggggtggggctgacaggaaccatagagcctcacacaagcaggcaggtgtcttgggatgagcccctgggctctgctggggttgtaaacagaaagggcctcctggtccagggggtggaggggcatcttgaagaggagagctgatgtttggtgtggttgtgtctggggagaggttcgtgggggcctggaggggagcctgctattgtaggtagggggccagaagtccagaccctcgcaggctgagtgagcggctggctggactgagcctggtgcatatgggtcgagtgggatggtgcatgcttgctctggcaagggctgcgattggggtgagagactgcagaggtgggactgggcagtggggagacagcagctgtggccttgaggttgaatgtgccgttcggtggtggcggcggctgggcggagggacatcagagctgttcttgtgtctggtaccttcccctcagcccttccaggggcattggtgacaaagggcttactctgttaagcccagagacctcgaggctgaccccagggtagtcctgcccacccctccactccccatcaccagccccgcccacccgccccccaccaccgtaccgcatgccaagcaaggagcaggcgcccctcgcccccatcccaaggcagcagccgcagacagccgcggtgtgcccccgcgcgtgtgaccttgggcttctttaccaccccagatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggtctgcttctttattttctttttaatgcctgccccgcccggtttttcttttcacataaacttcctctaccaccagcagcagcagcagcaccaaaggtgccttaactttcgttcagcaccaggtccgggggggtgagactgtgggtggttaattagggaagcccaccacctgcctcctgtgtgtggctttggtggtgggagctcagtgtgtgggtggctccacagtctcccctttggtgactagttaacatcgctgagaaccaattttgcccctccttgttcactgctcatttttctagtctctgtcctttgaaggctttttcctggggctcagacgtccacgtttgatgagctccagtggtgatttgtgcctggaagctgccacctaaggccctgggcctggggaggcatcaacactaaaggtcaagccaactaatcctgcctgtcaggcacagagcagctaaaattaaaaccgccaagtggcttttttccttctctgctggtgacttgcagcctgccagcgctgtaggctttggcgggggtcggggggacaggataaagtgccccatcttgtgctttgcaagcacttttcaaagggtcttctgctttttttccatgtcttgggcggcgagtgggtagttactgttagggttccagaaaaatccatgtggagtctccaccaggtagtgaggtcctctcctgggcagaggtgccttagagctgccctggttccacctgcctctccttccttcagggcggctgagggacagtaggctcccccagcatctggctgctggggccagcaactggcctgggctgctttccagctgtgagctagggctggctactgctgtttactggggtgtctggtcccccgtccaggaggcctgtgctttgctatgggtctgccaggcttgaggagccctcagaagcaaggcaggctcagtgcgtttccccagccaagccctaaacttcggctcaccaaaaggaggacatcttttttgcctttgtccttaagtggcagaatgggggcagggcctggggcctggctaccctctttgaccttggcttcacctcattgcttctcccacaagcttggtttccctggtgggctcattgggtggttaattagctctttgaagctctggaagcggcaaagtggcgctatgtgggttttagaaataaaatcaataaatgacttaaccacagcttagctatctcctccgcttctctcccccaggccagctccattcctgtgctccctccctttctgctccctgccgtcagcttttgttaaggttttggagaggaagtggctgactaaggcatcagtctccaaggtgctagaggccctgaaatggaagagacagcaggaaggcttggccctctgaaccgtggcaagcacttgcctctggcagaatcagagagagaaaggcctgcccacctgtcttaagacacctggggtgggaaagcaagccatttactccatcacattgtgacagggctgtgcttgccccaccccctctcctcacgttcatttctgctgctgtagcagcactgtccccgtccctcaaggcctggcaaggcctggcaagaggaatgccagtggggaaaggtcagcctcagggctctgttactgaggttcagccaagggctctggagaaacccaggattggtccaaggaaggaggccgggtttctagttagaaacttagacataaataacctcgagtgagttcaggttgtaaaagtgcttcagggttcattaaacctgcatacacaacaccaaggaggggcggaggaagcagggaaacagatgagatcgtgctgcccaggtgtgatcatgctgggctggggcatgcagtgtcaccccgggacaaagcctggaaacagtggggagtgatggcatgacaaagacggaaagaagccacagaaaaggtagttggagaaagttaaaaatttcccagtaaaaatgttcctgagagcaagcgccctgggtgcaag

SEQ ID NO: 13678 - DNA, 18037 bp, Human
aggaccctgagtgcttcgcccacctgctgcgattctacgacggcatctgcaaatgggaggagggcagtcccacgcctgtgctgcacgtgggctgggccacctttcttgtgcagtccctaggccgttttgagggacaggtgagggacagctgcacagaggtctgggcactacaggtggtgacagcagccacgggcttgtcagacttttctggcccaggggcagcatctgcccatccccttcggtgccgatgggactgagaccccctgggtgggatgggatggccagagcagggtcctggagttccagccactggccggcaaccttgctctcaccttgctctccccactggcccaggtgcggcagaaggtgcgcatagtgagccgagaggccgaggcggccgaggccgaggagccgtggggcgaggaagcccgggaaggccggcggcggggcccacggcgggagtccaagccagaggagcccccgccgcccaagaagccagcactggacaagggcctgggcaccggccagggtgcagtgtcaggacccccccggaagcctcctgggactgtcgctggcacagcccgaggccctgaaggtggcagcacggctcaggtgccagcacccgcagcatcaccaccgccggagggtccagtgctcactttccagagtgagaagatgaagggcatgaaggagctgctggtggccaccaagatcaactcgagcgccatcaagctgcaactcacggcacagtcgcaagtgcagatgaagaagcagaaagtgtccacccctagtgactacactctgtctttcctcaagcggcagcgcaaaggcctctgaactactggggacttcggaccgcttgtggggacccaggctccgcccttagtcccccaactctgagcccatgttctgcccccagcccaaaggggacaggcctcacctctacccaaaccctaggttcccggtcccgagtacagtctgtatcaaacccacgattttctccagctcagaacccagggctctgccccagtcgttagaatataggtctcttctcccagaatcccagccggccaatggaaacctcacgctgggtcctaattaccagtctttaaaggcccagcccctagaaacccaagctcctcctcggaaccgctcacctagagccagaccaacgttactcagggctcctcccagcttgtaggagctgaggtttcacccttaacccaaggagcacaggtcccacctccagcccgggagcctaggaccactcagcccctaggagtatatttccgcacttcagaattccatatcttgcgaatccaagctccctgccccaaataacttcagtcctgctccagaatttggaaatcctagtttcctctccttcgtatcccgagtctgggacacaaaactccgcccccagcctatgagcatcctgagccccgccctcttcctgacgaaactggccccggatcagagcaggacctcccttccgaccctctgggaacctcccagaggtccagcccatctcggagcatcccggaggaaatctgcagagggttaggagtgggtgacaagagcctgatctcttcctgttttgtacatagatttatttttcagttccaagaaagatgaatacattttgttaaaaaaaatataaagcgcaagtccatgtttatctgggaaattggggatggggcggggagtggagcgccccctcttccctctgtcttctggctcccgggactttgcgctccctacctgtggagcgcgagcgacagtggcggcggaaggacgtaggctccgccccggccttggggcttcccccgcgccgccgagggcccgtcccgcgggcgcctcctcccggactggcggtggggcatccccggcgcggccccgcccccgggcttcagccccgcccccgcggcttcagagccacgggcgcccgccccgccccgcgccgccccgcgccggatccgcagctcgcgcccgcccgcctgccggcccgcccggcgccgggccatggcgctgctgcgggatgtgtcgctgcaggacccgcgggaccgcttcgagctgctgcagcgcgtgggggccgggacctatggcgacgtctacaaggtgcgacgggacgggcgggagagccgggaggagggtgccagccccgcaccccgcggcaggatctagcccccggccccgccccccatcccgcttcaccctccgcccctgcaggcccgcgacacggtcacgtccgaactggccgccgtgaagatagtcaagctagacccaggtgagggcccgggtcgggcctctgcgccagaggaagggcagagcgcccgcgggcgcggggtgcgggcggagggttgacgtttccgagacccctgagaggcgtgccccgggaggtgctgtcacctgcacctgcctggcccggagggaggcactctgtgcccattttgcagatgggggcactgagtcagggcaaccccagcgcgccttccccatgatgctttgtgcttcccaggggacgacatcagctccctccagcaggaaatcaccatcctgcgtgagtgccgccaccccaatgtggtggcctacattggcagctacctcaggtgaggctgccttatcctcctggccccaggcagcccccatgtgacctgctttgtgcccaccccagctctttgtccctaggaatgaccgcttgtggatctgcatggagttctgcggagggggctccctgcaggagatttaccatggtgaggccagggctccaggccccagcaggccccagccttcccccacccctaccccactggggtaccagaggggactctgggccctggacttgggctcctctccactcctgcctggctgtgtgaccttgagagaaatactgtccatctctgggttcagtatcctagactaaactgggaggggacgtggccaacaccgctttcatttaacagtgcctgctgcttttcccacacacggtagcctgggagggtgggcatgacccccgggcccccaagccagcctctcccttttcctttcagccactgggcccctggaggagcggcagattgcctacgtctgccgagaggcactgaaggtagctgggcctgtgaggtgcccacacctctggtctccagaagctgtgggccaggagcccagatgaccagcagggaggcgggtggagtgcctcgggtggggctggcccgaggggctgtaggtcctggggaaaaggggccccagccctgttgccggaagcagtccatttccctcttggctcagtcacttcctgtttggggagaggggaggaagaagcagcctgagtggggggccccagtcctgagagggggtttggggaggtgggacagtgctgggtggctgctctcagggactcctctttgtcgccaggggctccaccacctgcattctcaggggaagatccacagagacatcaaggtaggcacctagctgggggcactcctggggagggaggaggaggccctcgggggcaccagatgggattgtctctcctccattcccacagggagccaaccttctcctcactctccagggagatgtcaaactgggtcagtaccctggggacaccatcagggtgagggctctgtggaccctccccggctaccctggactcaagggttgggtgtcactgggcaagtcactttgccacttgagtctcagtttccctgcttagaagatggaacggtactccctccctgctggaaaatagaggaggttgggtctgcacggagttgacatgggaccaggcactccgtcagggatagagggtggttgacccctctcaggagagggacctggccttgcctagggcctgcggcagctgtgaccaagcggggccacctgcccgtctgagccctgccaggtgcagccgagccagagccctgggcgtgggagggtgagtggcagccagagggctggtgagagtggctgtttctccccacagctgactttggggtgtcaggcgagctgacagcgtctgtggccaagaggaggtctttcattgggactccctactggtgaggctgcgcctggggcggaggggtaggggccacagagcagggcacccggccatcccatctgtgaccccacctctaggatggctcccgaggtggctgctgtggagcgcaaaggtggctacaatgagctatgtgacgtctgggccctgggcatcactgccattgagctgggcgagctgcagccccctctgttccacctgcaccccatgaggtcagcccaacacttgcccctcacctgacccttgatctgcggcctgtggcccctgacctcgcgccctccacagggccctgatgctcatgtcgaagagcagcttccagccgcccaaactgagagataagactcgctggtaagggccacaccctgctgccgggacccccttttctgtcagccccatagtggacaaacagcctctgccaactcccggggggcaaccccaagagccctgtcctttctgggctactacagaccatctgagtcaggggcctggtccttctgtgggttgaagacccagcgtggtcaggaaagaagggcagagggttggtggaggagccgctgtgtcgcaaggcagcgttgctcggccagtggcccttggcctcggctggctccttcctgggtgggcccagcagacgcctctggaggggtggtagggcagctggcaggacaccctgcacgagggctaacctggatctggcgctggggggctcttgtgccttctaggacccagaatttccaccactttctcaaactggccctgaccaagaatcctaagaagaggccgacagcagagaagctcctgcaggtgggaggcagggggccgggagagaggcccagtactcaaaagcagggccctggatcaggggccaacctgatcacccccctcccccactttccagcacccgttcacgactcagcagctccctcgggccctcctcacacagctgctggacaaagccagtgaccctcatctggggaccccctcccctgaggactgtgagctggaggtaggtgaggggggctggaaagtgagtcttgggctggtctgcttagaaagagcccgagggtgatgttggtggaggtcctttaactggcaccattccagctcagggagctggcctcagctgagccctcccattaggagtctctgtcatgctgacttttgtttcctgtaccacccccttgataggtccctgcccttgagtccaagctgaccatgaccacgactgtgccattttcttgctttctgtgtgatctttggcactgctctgtgtgggttctctcatctgtgaagtggggttccattttattttacagtagtcccagagggctgtcatgaaagcaaaacgcactggtgcgtgtgaagctcctagagcagccccggcatgaggcgcgtgccaggtgtgtccacactgtttctgtttttccttagacctatgacatgtttccagacaccattcactcccgggggcagcacggcccagccgagaggaccccctcggagatccagtgtgagtctgcagcaggggctgtgtgtgtgcagattttggggggcctgtgtgcacatggatttggtgtgagtagaggtccatcctgagactccagctccttcactcttgtactctgggccccccagttcaccaggtgaaatttggcgccccacgcaggaaggaaactgacccactgaatgagccggtgagtgggcaggccttgaggggaaggtggtgcccagaggtggggcagggaggtcggatggaggccgagcagctcaaatcaagggagatttgaagctgggtggcctcgggccttgggccttggactgtccaagcaagcctgtcctacccagggacctggagggttaggggctccttcctgggccaagttcttttaggtgggtgtctggaaggtagcacagagaccatgcctttcccaaaaggaggccgtcatgtgcctgagccctcaccctaccctgctcagcctcgttttcccacctgtgtgtccccagtggtctgactttctgtctctgccctcatcggctctgtcactggtctctcctcaccccccagcctgtctcttcctccctcgctgtctgttgccctttctttcacagtcttcagctctgcctcccactgtctgtctctctcatcttctgtgtgtttccatctcacctttcccgtctgtctgtctgtctgtctttcctttcctgaatctcttgagcgccctctcacgttgcatctgtctctgcttcttccccggtctctaccttggtttcccccagtgggaggaagagtggacactactgggaaaggaagagttgagtgggtaagtgaggtatggggaagctgcagggggtggcaggggcggcagaaaggctgacctctgaccgggcgtggtggctcatgcctgtaatcccagcactttaggaggctgaggtgggtggatcacctgaggtcaggagttcaagaccagctttgccaacatggtgaaactccacctctacttaaaatacaaaaattaggctgggcgggtggctcatgcctgtaatcccagcactttgggaggctaaggtgggtggatcacctgaggtcaggagttcgaaaccagctttgccaacatggtgaaaccccatctctacttaaaatacaaaaattaggctggctgtggtggcttacgcctgtaatcccagcactttgggaggccgaggtgggcggatcccaaggtcaggagtttgagaccagcctggccaacatggtgaaagcccgtctctagtaaaaatagaaaaaattagccggtgtggtggcaggcgcctgtaatcccagctactcaggaggctaagacaggagaatcgcttgaacccgggaggcggaggttgcggtgagctgagactgcaccactgcactccagcctgggcaacagagcgagactccatctcagataaataaataaacaaacaaaagttagctgggcatggtggcccacgcctgtaatcccagctactggggtggctgaggtaggagaatctgggaggcagaggttgcagtgagccgatatcttgccattgcacgccagcctgggtgacaagaatgaaactctgtcttaaaaaaaaaaaaaaaagcccgggtgtggctcatgcctgtaatctgagcactttgggaggccgaggtgggcggatcacaagggcaggagatcgaaaccatcctggctaacacggtgaaaccccctctgtactaaaaatacaaaaaattagccgggtgcggtggcgggcgcctgtagtcccagctacttgggaggctgaggcaggagaatggcgtgaacttggggggcggagcttgcagtgagccgcgattgcgccactgcactccggcctgggtgacagagcgagactccgtctcaaaaaaaaaaaaaaaaaaaaaggaaaggttgacctctgaccccttttccccactgcccaggagcctgctgcagtcggtccaggaggccctggaggaaaggtgagggatgtgggcctgggggaggggcaaggggcaggtggccttggtgccagtcacacctcatgcctcacgcctcatctccctcccacaggagtctgactattcggtcagcctcagaattccaggtgccacacagagggaggctggagctgggatccaggccactgcagagggtacgattggagtgggatgtggttacagggcaacctggtaacggccgggctgggccctgcccctcctaccaggagctggactccccagacgataccatgggaaccatcaagcgggccccgttcctagggccactccccactgaccctccagcagaggagcctctgtccagtcccccaggtgagtctcaggcttgggaggccaggaggcagccccagggtgggggctacagcaggaaattacagcacgcctgtgcctgcaggaaccctgcccccacctccttcaggccccaacagctccccactgctgcccacggcctgggccaccatgaagcagcgggaggatcctgaggtaagagggtgctacagtggggtggggagacgggcggctacagctgtcatatcagccctgactcctttcctccctcccagaggtcatcctgccacgggctccccccaactcccaaggtgcatgtaagtgtttgccccaagccctgcagtcccacagccctgccacccaccacccctgcactccctcgccagcctcttgcctcctctgcagatgggcgcctgcttctccaaggtcttcaatggctgccccctgcggatccacgctgctgtcacctggattcaccctgttactcggggtaggtgggggcagggaggaagcgggagcccaaggaatccctcagcttgggccaggggccatgtctgacctctgaccccatgcccaaactggcagaccagttcctggtggtaggggccgaggaaggcatctacacactcaacctgcatgaactgcatgaggatacgctggagaaggtgaggcccggctggctgtggggggcagaggccttgtgggggcctggggtgctgaccatctgtccctctgtggcctccagctgatttcacatcgctgctcctggctctactgcgtgaacaacgtgctgctgtcactctcaggtacaaggtgggatgggcagggaggcagggcccgcaggggctccagcgcctcagcatcctgcccaccaacaccccaggcctggcctcttcctgtttctgcagggaaatccacgcacatctgggcccatgacctcccaggcctgtttgagcagcggaggctacagcaacaggttcccctctccatccccaccaaccgcctcacccagcgcatcatccccaggtcagggatcttgggcgtgcagggagcgggaggcagaggggcagggaggggctggaacatggccttgccagttcctgggattgcagcaatcttagacgtgttgtctctctgagcgcccgtttcctcctctgtcaatacaattgatggccttcccaccccctcccgccggcttgttgggaggcaagaaggagacagtggatgtgaaagtgctttccaagttgtaggagctgtggttgttcggatgtggggcttgacagttaagcaaacgtttactgagcacttatgctatgttggcccctatgctgggcttcgggacatggagaatcccatgagtcctcgctttcaagaaatgggggagatgggcaagtccttgctttcaaggattcccatgagtccttgctttcaaggattcccatgagtccttgctttcaagaaacagcggggctgggtgtggtggttcatgcctgtaatcccaatcctgtaatccgaggcagaaggattgtgtgaggccatgtgtttgaaatcagcctgaaaacacagggagaccttgtctctacaaaaaatcaaaaaagtctgggcgggggggctcacgcctgtaatcccagcactttgggaggccaaggcggatggatcacgaggtcaggagatggagactatcctggctaacatagtgaaaccccgtctgtactaaaaatacaaaaaaaattagccgggcgtggtggcacatgcctgtagtcccagctactcgggaggctgagacaggagaatcgcttgaacctgagaggcagaggttgcagtgagccgggatcacgccactgcactccagcctggccgacagcaagagtctgtctcaaaaaagaaagaaaaaaagcccaaaaaatcaaaaaatggggccaggcgcagtggctcaggcctataatcctagcactttgagaggccgaggtgggcggatcatgaggtcaggagtttacgaccagcctggctaatatggtgaaaccccgtctctactgaaaatacaaaaattagctgggtgtagtggtgcgcacctgtagtcccagctactcgggaggctgaggcagaagaatcacttgaaccctagaggcagaggttgcagtgagtggagattgcaccactgcactccagccagggcgacagagtgagactgcatctcaaaaaaaaaaaaaaaaaaaatcgaaaacttagctgagcatggtgatgtaggcatggcgttgtgtgttggtggtcccagccactcaggaggctgaggtgggaggattgcttgaacccaggaggttgaggttgaagtgaactgtgatcgcgatcgtaccactgcattgaagcctgggcaacagagcaagaccttgtctcaaaaaaaagaaaaagggaaatgtggacagttagcagccggtactgaggtccagttagagggagagctgggaggtgtggagaggcctcagagaccgggcaagcttgggaggttcgaaagtgtgtcagggtttctaggcaggtgaggtagggaatggcactccaggcagggggaagagcaagtatatgttagtatgtgttggggcggagcagcctggtgagctggggagctgttaagagtttgcctgggggccaggcacagtggctcacgcctgtaatcccgcactttgggaggctttggcgagtggatcaactgagtcaggagttcgagaccagcctggtcaacatggcgaaaccccgtccctagtaaaaatacaaaaattagccgggcatggtggcgggcgcctgtaatcccagctactcgggaggctgaggcaggagaatagcttgaacctgggaggcggaggttgcaatgagccgagatcgcaccattgcactccagcctgggcaacagagcaagactccgtctcaaaaaaaaaagaaaaacagaagagaaaaacagtcagattctgattctcttttgcaagttgagccagtaggatttcctgatgaaagagaaagaggagtcaaggatggctccaaggtttttggcctgggtgtcaggaagaatgcagctgtcatcagctgaaggtggagcagtttcagggggagctgaattcaattttgttgcatgaacatgcttattagatgtgcaagtgggacctgcgtcagtccatggcttggtggggctgggctctgaagggaggggccctgggctatgggcccccgacattgtcatgaccaggtgggtggtgtgggaagcagtggactgagtgcagagggtaggggaggccaggccagtggctgcaacagctggggagctcaggagcccccttcctgcaacgtgctcactccaggaccacatctggagcccggtggccttggggcttcctgagctcagtccccaagtgagtctgctttggcgcaggacctacaggaaacaggcccatcagagccccaacaggtcacaggcagctttgagcttgtgttcgggaaatggcagaggcacagtgagcactttgaatgcaaagaacagagaactggagttgtttggagaaaaaacaaatacaaaatatatgcctttgtcccatccaaagaccagatggggaggagagtgggaggaatgtggggagagggagggacgaggaccagggacagtgagagacagacattggcttcctccatgtcctggcagaaggtacaaacaggacatgggccactgggtggaggtggcagggctgctgacaggaagccccattccccagaggaagaaacaggctgagagggtcccctggagggttaggggacactcagtggccaaggcaacggcccctctgataacttttcctcactacttctaccccgacagcaaggcaagccaccccctggccccacagggctgttgcctctgctggagaagcagagggcaggccatttgccttttgaagttcattcactgccccgggcctgttttcccatctgtgaaatgggccgtgtgcagtctgtgcaacctggtggggctggagcctgcatcctccccagcccctccatgctctcatttcttcattccttttttctttttctttttttttgagaccgagtttcactctcattgcccgggctggagtccgatggcacaatctcggctcactgcaacctccgcctcctgggttcaagcaattctcctgcctcagcctcccaagtagctgggattacaggcacgcgccaccacgcctggctaattttgtatttttagtagagacagggtttctctatgttggtcaggctggtctcgaactcccgacctcgggtgatctgcctacctcgacctcccagagtgctgggattacaggcgtgagccgttgcacctggcatcatttctttctttataccctgcctttacctgacaaggactttcagtgactcaaaataggtggaaagtcctaatatgggatgataggagctggccctctgtgagcacacacgattcccagcactgccgagagcacctcccctgtattaactcatgaagccttcactgtgactctctggggtggggcccgccattatccccaatctacagatgacgaaactgaggcatggagagattaagtggcttgcctggagtcacacagagctagaagcaatcctgagacccaaacccctggcctggatggagacactccctcctggcttcagggctgggagactggcttcagatcctccacctttcccagctgttcttggggcaagttactctgtgtctctgagtctcagtcccttacttgtaaagagggaagctgatagtgcccacctcatagggctctgcaggggccttgcccatggatggcatcccagacacaggccctggttatcacccctacaggcgctttgctctgtccaccaagattcctgacaccaaaggctgcttgcagtgtcgtgtgggtaagaaatgggctgggcggggtggggcggggcctggtggggggcagcgcaggcccagcccggtgcccactgcctgctcccctgccagtgcggaacccctacacgggtgccaccttcctgctggccgccctgcccaccagcctgctcctgctgcagtggtatgagccgctgcagaagtttctgctgctgaaggtgaggggcggtggggggaggcccagggcaccctcagagctctggggggagaaatggagacctgagcatccctgctgccccctagaacttctccagccctctgcccagcccagctgggatgctggagccgctggtgctggatgggaaggagctgccgcaggtgtgtgttggggccgaggggcctgaggggcccggctgccgcgtcctgttccatgtcctgcccctggaggctggcctgacgcccgacatcctcatcccacctggtgagcagaagggccaggctgctgggggtgggtgtgtgtgcatgagagaccgagggagggaggcagggagggccaaggctcccaaactaggctccccacagccagtggctccacagagaccttgagggctgccatgtggggtctggggcccacagcctcccttcaacaagcttcacctgggcttccataaaagggttcattagacggaagggcttggcagctaagaaaatcctggccaggccgggcacagtggctcacgcctgtaatcccagcattttgggaggccaaggagagagaggggcttgagctcatgagtttgagaccagcctggacaacatggcgagaccctgactctacaaaaaattagctgggcatgttgatgcacgtgtgtagtcccagctacttgggctgaggtgggaggatcacttgagcctgggagacagaggcagttgtgagccatgttcgcgccactgcactccagcctgggtgacagagtgagaccctatctcaaaacaaaaaacaaaaacaaaaacaaaaactggtcaacattgctccgggctgcagggaagaggcagatctggcaaggcagggcctagaggccccattctcagccaggaagcaggactccaggtgttgtggcagcttggggtgataatgagcagtgatgggtaagggagaaaggagggcgcacgtagttaaggcacctggtgccaggccctgagccaggggtctcacacacaggattttattctttatttatttttttattttttgagacagagtcttgctctgttgcccaggctggagtgcaatggcacgatctcggctcactgcaacctctgcctcgtgggttcaagctattctcttgcctcagcctcccgagtagctgggattacaagcatgtgccaccacgtccggctacgttttgtattattagtagaaatggggtttcgccatgttggccaggctggtctccaacacctgatctcaggtgatccacccgcttcggcctcccacagtgctgggattacaggtgtgagccactgcgcccagcccaggattttattcctgatcctcatgatagcctctcaaggcagtgccatcttgtctgtgttatgaggaaacagaggctccgagaggtaaagtgatttgtaccaggtcacacagtgactgggtcacgaggcctggtccccttaaacctggagccctcccgtggctccccgtgactcctcctccactccccatgagccctaggacgggtcactcatcctctcagagcctcagttcccagccctggagggagatgaggtttcccagccccacagggctgttgtgaggctgacgtgccctcatggccaagggctgtctgtagcctggcccccgtatcctcttggggttgggggactggtggctcagccaggccatgtctctcttctctgcctgcagaggggatcccaggctcggcccagcaggtgatccaggtggacagggacacaatcctagtcagctttgaacgtgagtgccctgggggcagggcttagggcaggggactatggaggtaaggcgaccacgtgggtctgccttcccagaagggagcctccccgtccccactcaccaattccttccctgtgcaggctgtgtgaggattgtcaacatgcagggcgagcccacggccacactggcacctgagctgacctttgatttccccatcgagactgtgggtgagtgagccagaggtggggtgcaggcctttccctggcctggagcacgttgttgctcaggggcctggggctggcggtaggatgaggaggcagatcccctagcccctctcctgagccatcctggtcacctgaggtcagtgaggacccctgtggcccagacccaggctcaggcgtggctgagggggtgccaagatgggtgcagggctgatggtggcctggcccccatagtgtgcctgcaggacagtgtgctggccttctggagccatgggatgcaaggccgaagcctggataccaatgaggtgagtggggcccagggaccttgctgtcccctgccttgtggtccctacctctttggaaaggacctactggagtggcctcagtgcttcccacctgtcttcccaggtgacccaggagatcacagatgaaacaaggatcttccgagtgcttggggcccacaggtaggcggtggtaccctagcctccccttcagatgcccctgaggccagagaaggggctgatgtaccaagtgtctcccgccctgccccctactcctctctcctccagagacatcatcctggagagcattcccactgacaacccagaggcgcacagcaacctctacatcctcacgggccaccagagcacctactaagagcagcgggcctgtccaggggctccccgccccaccccacgccttagctgcaggcccttttgggcaaaggggcccatcctagaccagaggagcccaggccctggccctgctggggctgaaggtcagaagtaatcctgagaaatgtttcaggcctggggagggaggggagcccccgacgcctctgcaataactggaccagggggagctgctgtcactcccccatccccgaggcagcccagtccctagtgcccaaggcagggaccctgggcctgggccatccattccattttgttccacatttcctttctactctttctgccaagagcctgcccctgcatttgtcctgggaaacacggtatttaagagagaactatattggtattaaagctggtttgttttagtcctctggtccctctgggtagggggagtgaacccacctcatctcccgcctccttccctccaacacacgtttctgtgggcaccacagaagggcagggcccccagggttttggagaagccaggtagaggtgacaggaggccatggcccccagcagccttctaggggcactgtgccttcccctgcatccttgctcagaactgaccctcagctttgcagtttgagggctctgctgtagtttagcaccccaaggactcatgcagatggggggacctcaacaaagggactctcatccagggcacccttgccccacgtaggatctcactgggtgacccctggaagggcccaggaggagcccccagagggctgttccctccattcccatggaggctgctgcccatggaggtagcctgtgtgacctgtatcccctgcctccacctactgcctaggtgttagaccaggaacatcagatgacagcacgatcatcagattggatgggaaggctagcctgtgtccgtctaccagactcccaagggctgcctcagtgccaggccctggggtcactaccagaaacagaccagcccccagggagggcgtcctccttgctggagcctgcatcttgagggcatggccattctcctgtagcttgtgcttacgctgtcattctccaagggtctgtctgctcagctctgaatgccagggcccccagggctgggcatcctcttttgccccaggcactgatcagccgctcttgactggagcctttgggcagctgcagcccaggaggcaggatgggaactgccttgagggcccacagctggggggctgggaaggtgggggcagggtggggggaacagctggagcaaaggccccatggtcacccctacattcaaggcaggtgttggaggaagacctttgcacctggtgggtggcaataaagacttgcggagtgacgtggtaggtggatggcagccatgcgagtaggctcagtggttcccagggtgtcacactgtcccctcagccaccctccagcagagtttcaactgttctgactctgtccagtgactgggagggtttcttggctggaatggggagccagcccaggggagggaacacatctcttcacaccaggcattcacacccatgttcccgtgagccccaaggagggtgaggggcaccttccaaattggggtcggtggtaacagggatacaaagtgaattcctaacttccaattttccagatttctcggaggaatgttgggaccagggtggggtaagtggggacagggaggtgagctcctgctcagcaaaggccctgaccaaaggcgccctggggaggactggctttccgttcaccaaccggccagcagcagacagtgcctccttgtggcggatcttcccggacctcagattcagtctggaaacggggtttggactgcagagtgtaaactgccaaagtgggggcctcccataaaacgcttgctgccagcaaaggcaggccaagagcaaagaaaggccgagaaaccagggaatatgcactgagagactaacactttaaattttatttatgtatttttaaatgcgtaacctttgcccatggtacatatttttttaaatacagcagagatataatgaagtctccctcttaccccgtccccagccaccctggtctcagttacttatgaacccttctagaagtattttgcgtatttaagcaatttggtatattttattcttggcgattttttatatacgtattaacatattccacatactgtactgaccttgccctttaaaaatatatcctggggggccaggtgtggtggctcacacctgtaatccaagcactttgggaggccgaggcgggcgaatcacgaggtcaggggttcgagaccagcctggccaacatggtgaaaccccgtctctactaaaaatacaaaaaattagctgggcatggtggcgagtgcctgtaatcccagctactcgggaggctgaggcaggaga

SEQ ID NO: 13679 - DNA, 22547 bp, Human
tgggttttgaccctggggcatgggacttctcagcttttctctggaagaggagccaggaacccctttccggggagctgaccacagctctgtcctggcaggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtgagctggttggcccgggaatcactcaggtggggccgcagggcagatcgaggctcaggtgtgtggtggggaagccggacgcgggtcctggtagttggagccaggcgcctttggaagcagcatgaccctctaggtccccggctgtccactgggacagggcaggcttggcccttgacctcatagaacttatcctagccccctaaaggaatagcacatgcctatcctttcccctccaggtttaaagtcttcgcagattatgaagactacattaaatgccaggagaaagtcagcgccttgtacaaggtgaggggtcctgggccaggggttggcagggctttggtggccctggttgggatgaggcagaaggtggagatcctgccagcagagtgaaccagagcttccctttgacctgcagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctccttactcctctttgttgggaaatatttttagctcttggcgggctcaacagcagccgcgcagtcacccccttatcctccaccctcggcaggtgcgtcccacggcgggacggtgatgggaggtggagggggcgacccgtgggggcggggcctaggcctctccagcccctttcctggcgtcaccctccacgcctctcttcccagtgccgtgtccatactaggtcagcggccagcctcgctggccgggggcggggcgtctgcctgggtggggcccaccggggctgggagccgggacttgggctgaggcttcccggaccacggaggatccgcgctgtcgagggcaggacccaggagggggaggaagcagaggatgctcggcgccttcttggctccgcccttagccccgccctactgcggcgtttaagggtctcttagcaggtggctacactggatccaaagtcgggggagtgttacggcagggaacactcgcagaccgcctagtctaggccctcattatggggaaactgaggaacagaaaggtcctgtttctaagtcttacattaccaagactgaggtgcgggggcggtcctggatcccccgccccaaggctgggaggggcacgcctcggaagggaggtttggggtcggtggtttcacagtgagtgtgtctgaagccaaatggtcggaaaccgttacccgctctcctaggcccggctagtggggaccccaaccgcctgcggctgcccctcccaagttcctccctgttggccaggcatccaggtctccagtctccgagctgcggagaacccaccgccacatgcggctgcccctttccattcgaccctgtggggagccaggcttccggggccccgttcctcctgtgtgaactgggccccccgcccccattcccagacatcaaggccgcgtctccagatagccacgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggtttgtctcgaaaacaggaacccgagctgggggctgggcggggcgccccttccccaccgcagtccgcttcctgcccctcccggcttcctccgcccgacacccaggcagggcggggggcactggggcgtccgcggttgggggaggggctcttcgtttcggtcccccctccgcgtcccgggcggcggggcctccggtcgcccgccctcggggcagctagtggcgcagccccccgcccgcggccctggcctcccgggcggcgcggcaggggaggggttaagctgccgcagggaccgccgcgtgcggggcgagagggagcccccggtgggggtggcgcagccggcggtgcggagctccgcgcaggggcggaggggggagggggcagcctggcgcgggggcgggggcggggcggcggggagcggggccgcggcgtggagagcgggcgggagccgcagccgcagcgaggccggcgggcgggagcgcacggaggtggggtcggccaggccggtgcgggctccttgcggcaggtcccaagagtgagtgggcgagcgcgggcggggcgccaggcgaaggagggcgcggcccccagcgactccccccccgcccagggcggcgcgggcgggctgggggcggcgagcgggtggggagtctgcggcccgggtctgggagagggggcagcggccacgagagctaaggcgcgctggatccccggagggcggaggacctccacggtgcacccagcttttcccagccaccttccagcggggccctcccccgcgtacccccatttggcagatgagaaaattgaggctcccagaggccaagtgattctcaaggtcacacgaggaagcggtagagccaggcggggacggctctgggtggctcttaggaaaagtccgcctgagaactccgtacaggagctcccctgtcctccagcctgggggagtgagtatgtgtagggccggggtacctttccgtggggcaaggctctgccaaaatctgggagtgaggggagtcagggagctggggccgcagggcgggccctgcaccgcaaatgggaggggggcgacggaatgggcgtgcgcacccatgggggtgtgtgcatgtgtgtgggagtgtacatgcgtggagaggcactgccttgcgtgtgtgcacacgtgtgaggatgtcagcgcctgtgtggccgcgggactcaaggctggcctggctcaagtgaacagcacgtccaggaggcgacctcgtccgcgggtttgcattctggggtggacgagctgggtatgtgtgcctgagggtttcttcgtgcaggtgtgcacagggtgtgggtgccattgtgtgtgagagacggaggatgggaggccggtgcctgtggcccggtgcgtgtaagtgcggacgcctgcacctccacttaggtccccggcctccgacgactaacttgggtgtggagtgtttgcccctgccagggtgcgtatgaccccgccagtgaccggagttgctaatggtgtcatgcacccaccggccacccttggcgcgagcgcccccctctggacaccctgctccgtgcgcgctcacagttcgcctgtgcggggccggggccagggtcaggagccggggatagggaggaagagggcctgtggacaagctgagccgggacccctgggacctttgcggaggtggcctgggagcgctcagttcccaggctgaggcttcccgctgacgcctcctggccgcagcgggctccccccgccccaggaatgttcctctcccatccagtccgcctcccctagggcaggccccctgggggctgccgcagccccgcctcgccttcctgggctcccgggagggggcgaggcgagcaggacgcctgggttctctccccccacctcccataccagggagaaattcctccgaggtcccctcaggctctgggttcccaaaataaccctgcgggggaagggaggctgtggagggagggaagcgggaggggcgcagagccgagctgcggggtgctgcaggtgcctctggggagagggcgcgaggagaaggcgccctgcggggggctgggcgccagccagtcctgggatcttggttcgtccccatcctcgtgaagcccctcggccttcccgcgactccgagggtgggccggaagcctctctgcgggtccgtttcccaactggcgggttgcaccatcccgggccagaccgtttaaccccgggagtggccgcgggggacaactccgcccctgtccagcagggggcgtgcccgccccgccccgtttctgcccgcggggccgctcccccgcccgcgactccgcagactcccgctctgcctctcccgggacaggggttcggtccgagcccggtgggaggctcccggagcgcagcctgggcccagcccaccccgcgccggcggccatggcaggcaccctggacctggacaagggctgcacggtggaggagctgctccgcgggtgcatcgaagccttcggtgagtggctcgggagggcacacggagcctgagcctagccccgagtctgagcccgggtccctgcctcccaggcacagtccagggcacagccctgacccggacccaccctgctccgcagcgtgcagtctctttaacgaaagcctcctccgcaacgcagggcagagagatgcacgcccttcagacagatgaggtttcccttctctagccttccccagcggcggcgaagggagggccgggtcccggactctgacacttgaggggcattatctgtctcccggggaatccggaggaactcgctatctccggcctgggagctgtttccggctaatggggggcggcttatctggtgaaggggtgccccttccccccaagcgctcaggaaatgacctctggattcttgaccccggggaacccaggctccttccgccccagctggttcccctccggacgatgggcggctcgggcgctcccctcctccagtcctcagggcgtgcctatctctcgcccaccacacctttcctctctaatttgcctcctgctctcggagtcctgggcaagcaggaggtgggcggggtcgagcgtgcacccgaaggaccgatacctggcgggttgcggggtgaggatgaggcatggtagctgcggacccagctcagccacctgtctttgacccttcggagtcagatgactccgggaaggtgcgggacccgcagctggtgcgcatgttcctcatgatgcacccctggtacatcccctcctctcagctggcggccaagctgctccacatatatccttcgccggccttgccaaggcccccgccgtcggagcccatgcgcagcccctctgcccagcccaggtgcagaatgagcctcgctcctaagtataggccactccttatcccagagctcaggcgtcgtcccagcctccaactagggcctaggctctgccccctccttgctcctagcgactcggtcctgtccccaggctctgtccccagccgaggccttgccctccttctccctagagtctagggcctgcccctgcttcaggcttgggtgcgccccgtgcatctctctctcccagagcccaggctttgctttcagcctccctcagcacctagtcctccacccccacctccaacccctcccagagctcaagcctcacccccagcatctccgcagagcgcaagccccatccctagaacgtgtctcctagaaccaggccccgcccccagcctccctccacgcaggcctccctttctagagttaagcggcctccttaaccctctccttcacctaccaacaatcccggaaggacaactccaattccctgcaggtgaaaacgtgccacctggtcaggtgagtctttcccctggggctctagcccctcccctttctcccttctctctggcttcaggctggcctggaggagggggcagggcgctgtttctgggagtgggtttgaaccctggcttgtccgggtgggcagtgctgccacaggctcaccccttcctgggtctgggccttaattttcttttctgcgcagtgcgggtggttgtctcaagggtctaatgtacacttggagtggcgaaggaaagagctggaaccatagtttgagggtctttttgcttaggtgactataatctcaaatagctccttgcagcctgctgggtgatggtgggggaagggctatcttgggtgactccccgctcctccaggtactggatctccgccttcccagcggagtttgacttgaacccggagttggctgagcagatcaaggagctgaaggctctgctagaccaagaagggaaccgacggcacagcagcctaatcgacatagacagcgtgtgcgtggggggagcacagagggctgggggggcactcagtatcctataccatctgtgcttaataaatgtctgttgaactgaatgagtgagggtcatgttgctctctcgcttaaaaaccttccatggctccctattgccttcaacatgcctcctctgggcagcttggcgttcctgcctcatcttccactgccaccacccatcccacacacctcctcctgtagctgcgctgggtcggctccccgtcggctgagctctcgagtcctttctcatcatggtgctctgctcatatcatcccccttgctgcctcctccgtgttaccaagactcagttcaggcatgaagtctccgtgggctctgagggttcggggctcttccggggtagaatttgtcgttcccacctctgttttccatggcactttgtacagactcctgtacaaagacctctgtacatgtgtcacgctgttttgtgatcatgtgtttctgtgtctgtctccctcagtagactgtgagctcctcgagggcaggaaccgtgtcttactcatctctgtattcccagcgcctagcacagtgcctggcacagagtacgttgttcataaatgtgtgttgagtgcatgacggggtggggggagatgaggaggagttgctgggactgggaacattcgtgcctaggacagtgcctcgcattatgtaggttctcagtaagcgtgaatggtgtgtctgtgtgagtggggggccacgaggcatgcgcatgtccagcaaagggctcactacccctgcccccccagccctacctacaagtggaagcggcaggtgactcagcggaaccctgtgggacagaaaaagcgcaagatgtccctgttgtttgaccacctggagcccatggagctggcggagcatctcacctacttggagtatcgctccttctgcaagatcctggtgcggcccgagggctggggggtcaggggtccaatgtgggctggaagagagttctaggaggggcagggtccctggcgtaggctgggtcacagggtgcatcaggggtttcagtgtaaccactgaaggtcagctggagggtgaggagtggctatcagtgaggggagaggccggcaaggtgctgaggccactcctcatgcccccagtttcaggactatcacagtttcgtgactcatggctgcactgtggacaaccccgtcctggagcggttcatctccctcttcaacagcgtctcacagtgggtgcagctcatgatcctcagcaaacccacagccccgcagcgggccctggtcatcacacactttgtccacgtggcggaggtgcctgcccctccctcccggtgtctcccaaccaccccacatgccagtcaggccaacccttcccttcccctaacccactgccttctctctagataagctgggccaaattctgggcccactcagtgactccctgcctctccgtccccatttgccttccagaagctgctacagctgcagaacttcaacacgctgatggcagtggtcgggggcctgagccacagctccatctcccgcctcaaggagacccacagccacgttagccctgagaccatcaaggtgcctgggactggggaggggccggtgcttcccaggtctgtcttcactgggtcctcccagcagcactgggggctgggcacagctgtcctcatttgatagatatggaaatggaggctcagaggggttaagtgcttttctcagtttgcacaatggcaacagcagagtgggggctcacaggtcgtcagggaccccaaagctagtacttttttttttttttttaagacagggtctctctctctgttgtccagactggagttcagtggtgcagtcacaagctcactgcagccttgaattcctgagctcaatcgatcctcccacctcagcctcctgagtagctgggactacaggtgtacgccaccatgcctaatttttgtattgttattaattttttttttttttttttagagatggggttttgccatgttgcccagactggtcttgaactcctgggctcaagtgatccgcctgccttggcctcccaaagtgctgagattatggcttgagccattgtgccttgccacttgtagtttcttcttttctttctccttcattttttattatttttgaagtattttgaagtattgagtaacatacatatagaaaagtatataaaaacatatgagactgggcgtagtagctcacacctgtaatcccagcactttgggaggctgaggtgggcagatcacgtgacatcaggagtttgagaccagcctggccaacaaggtggaaacccatctctactaaaatacaaaaattagccaggcatggtggcacgcacctggaatccaagctacttgggaggctgaggcaggaggagaattacttgaactcaggaggcggaggttgcagtgagccaagattgtgccacttcactccagcctgggcgacagagtgagactccatctaaaaaaaaagaaaagtatataaaaacatatgaatagtttaaagaaaaattgtaaagaaaacactgtgtaactactgcccgggttgggaaatagaaccttgccaggcccccaagcgcccagcactttagagcataactccctccccacgacttttgcaatgatgatcttgcttttctttatagcttcaccatgtaggtatgcggtccaaaacaatgtggggctttttgttgtctgttttgaactttctatgaatggaatgttgtttgtgttattttatgtcttgcttttttcattccacatggttctgagagtcttttcattctgtcatgtggagcaattgttttttcattttcattgccatataatattttattgtacgtctaccccaattcatttatttatttatttttttgagatggagtctgtctctgtcatccaggctggagtgcggtggcgagatctcatcactgcaacttccgtctcctgggtttacgtgattctcgtgcctcagcctcctgagtagctgggattatgggctcgtaccaccacgtctggctaattttttgtagagacaggctttcaccatgttgccgaggctggtcttgaactcctgagctcaggcaatccacccgctttagcctcccaaagtgctgggattacaggtgtgagccactgcccccagcctaccccaatttatgtattgattctattgttgaatgttggggtttttccttttcttttctttctttctttttctttcttttttttttttttttgagatggagtcttgctctgtcgccaggctggagtgcagtgacgctaatttggctcactgcatcactgcaccctctgcctcccgggttcaagcgattctcctgcctcagcctcctgagtagctgggactacaggcatgcaccaccacacccggctaatttttgtatttttttagtagagatgaggtttccaccatgttggccaagatggtctccatctcttgacctcatgatccatctgccatggcctcccaaagtgctgagattacaagtgtgagccaccacgcccagctggtttttccagtttttgctgtttggacggggtggctgagtatgttcttccaggtcattgtcctgtgctgccttgcctccctgagcctctgtttctcctgttaaatgttgatgattccctgcatccaggcctggtttagaggtgtggtgcttttggcagtgagtattgccttgaattcatggcaatgaattcaatccccaggggctgagagagccagtcgtgggggacagtaagggaggtttttactctttcacctgtccctgaccctgactcctcctcaccccctcctacatttccagggctgaggtagggaggatagttgtgggggtatgactcctctgtcctttgtccccagctctgggagggtctcacggaactagtgacggcgacaggcaactatggcaactaccggcgtcggctggcagcctgtgtgggcttccgcttcccgatcctgggtgtgcacctcaaggacctggtggccctgcagctggcactgcctgactggctggacccagcccggacccggctcaacggggccaagatgaagcagctctttagcatcctggaggagctggccatggtgaccagcctgcggccaccagtacaggccaaccccgacctgctgagcctgctcacggtgaggagcagggggcagggaggtggggagctgggcaccaggggttgacagtttccccaggtcctggctgtgggcgtggcctggggctctgggttctggccaagaaactgagatctagcgtgggctctggggtttggagtggatgctgagaaggggtccaggctctggttggggctgtggactgaggtctgatctccaggctggtatgtggactgtgggcagtttgaactgggcctgggtcccgggttgagttctggcaatgggctgtgttctagggctgggccaagctctgcattctgtgggcaggggtggtttctaagcatggccctgggctcggagtgaagttctgggcttggctttacacttggtcttggggtctagggtgggagttgggttctggtttagatccagacaaggttctagacattgggctggggcttaagtgttaaggtttggagtggattcttagctgcttctgggctctggaggggatcagggttgaaatcagagcttctggctgggttccgacctggcttcttccctgacatcttggcaatatgttgtgttcaaggtttggggccatgctgtggtttgatctgtgcgctgggatgacatgggggttgctgtgctgtgttctaagccaggctttgtcctgagtctagcttctgacccgagctctggctgagctgtggcctctaggtcgacctttggccctgggctctgtggccgtgggcaggggccagtgggggtgatcagatctgtgtgtcccaggtgtctctggatcagtatcagacggaggatgagctgtaccagctgtccctgcagcgggagccgcgctccaagtcctcggtgagggggtactccctcctctccactctgcccttccctcctgagaatcccaggatgtgaggatgggaagagctcttagcagccacctcacccatccatcttgtaggacagaggcatcctgggggtagggcagtagtgttgggcagacttccctctcccagggattcccctctctgttccccggggctctgggctccccctgcctctggccctagctcaggcccgaccatttccatagccaaccagccccacgagttgcaccccaccaccccggcccccggtactggaggagtggacctcggctgccaaacccaagctggatcaggccctcgtggtggagcacatcgagaagatggtggaggtgagctcctgcggagcctgagcagtgtgtggggagaggccagtttgccggagcactgccctggaagccagcacgagtgtcctgttcaagacccagcactcagcccctaggagtcacagggcctggcaggccagctgcacggggctgaagtgcccctgggtagggtgggggtggaggtatggaacgggggtggtgtcagagacctctctgagacacacctcatcaaatggactgggaacgtgggaagggacaggacctgatgtcccctttactctcccctcttctggctctgcgtgtccctctgcgtgccccagtctgtgttccggaactttgacgtcgatggggatggccacatctcacaggaagaattccagatcatccgtgggaacttcccttacctcagcgcctttggggacctcgaccagaaccagtgaggagggctggggacctgggggagagggaaggcaactcagcccacttctgcctgggcttcagtttcttgtgtgcaagatgaggtcactgagccagatgatcttggcctgggaagctgccagtgtgggaaagggcacttgcttttgtggggaggagaggctgccagctgtggaggcgcagtggtatctcacaaattcagacagatggggggctccacctgagtcttgcaaagactgtgacctggggactgtggctacaaaagtgctgttttatttgtggagctcacagctgtcaagaagtgtgggcaacttgagctcctggatagtctgttctaatgaatagataagaaaggtttgtaattagcagtacccagttgtttatcaacagttcatatgctgacaatttggaaaaacagctggttctctgaagtaggttaaacatgccccctgaagccagattcatgccctatttttgctgagcagaaaaaactccattcaaaatttaaagtccatctcaggtcgatttattttttaatgttacctgtatttcaaaaatctgttgttttttatttccacattacaaaaatccacggtaaaataaaatctaggtggtaaaataaatttatagtgaacaaaatgtttaaagtaagaagtgagaggccaggtgcggtgcctcacgcctgtaatcctagcactttgggagactgagttggcaggatcaattcaggccaggagtttgagcccagcctgggcaacagagtaagaccctgtctctacaaaaattattattattatttttgagacagagtctcactctgttgcccaggctggagtgcagtggtacaatctcggctcgctgcaacctccacttcctgggttcaagtgattctcctgcttcagcttcctgagtagctgggattacaggcatgcatcaccgtgcctggctaatttttgtatttttagcagagatggggttttaccatgttggccaggctggtctcaaactcttgacctcaagtgatctacctgccttggccccccaaagtgctaggattacaggcatgagctactgctcctagcctaaaaaaattttttttgggcatgggtggcacgtgcctgtagtcccagctactcaggaggctgaggcaggaggaacccttgagcccaggaggttgagactgcagtgagctgtcatcacaccactgcacttcagcctgggtgactgcgcgagatcacccccatcaaaaaaaaaaaaaaaagaaaaaaaaaggaagaaatgaaagtcccctctttccttttccactggtagaagttgccatgattaagcactgttaacaatattaagcttggcagtatgtggattcttccagtcttcttttcccaggcaggtgcacattgatagagattttgtttgtttggtgtctgtttcatggacaaacaggattagagcataaatctagttctgcttgtggcttttatcatagctgctttatttcttctcccagattttaggcagaggtagttgagttccatgttttctccctgggttggtgggtggatttttatctagaccaccttttcagtgagaatgaccctttgagacgatggaggcctcagcttcatgcagcggtctcagccttaaccctccacctcctgcaggccccaggctgtgtgtgtgtgtgtgtgtgtgtgtgtgtgtgtgtgtgtgtgtgtgtgttggtgagggggaagccctggttgggtatcaaaacctagcacctggttcggcaggagggagaccagcaccggctcccaggaccaggcccagctcaccacttcattgtaaagctccctctttgtttctggaacttgggtgtttccatttctttcttacaaaattatctatgcatttacagcaattgttgatatatctttaggcagcatctaggtacttgtagtgggttctcttttttcttttttcttttttttaatcaccctctcttttttttgagacagagtctcactctgtcgctcaggctggagtgcaatagcgcgatcttggctcactgcaacctctgcctcccaggttcaagtaattctcatgcctcagcctcccaagtagctgagattacaggcactggccaccagacccggctaatttttttttctttttcttttttttgagacggagtttcgctctttgttgcccaggctggagtacagtggtgtgatctcggctcactgcaacctccgcctcccgggttcaagtgattctcctgtctcagcctcccgagtagctgggattacaggcgcgcgccaccatgcctggctaattttgtatttttttttttttgagacagagtctcactctgtcacccagactggagtgcggtggcgcgatctcggctcactgcaagctctgcttcccgggttcatgccattctcctgcctcagcctccggagtagctgggactacaagcacccaccaccgtgcccggctaattttttgtatttttagtagagacggggtttcaccgtggtctcgacctccagacctcgtgatccactagcctcagcctcccaaagtgctgggattacaggcgtgagccacctcacccagcctaattttgtatttttagtagagatggggtttcaccatgttgcgcaggctggtattgaacttctgacctcaggtgatccgcccgcctcggcctcccgaagttctgggattataggcgtgagccaccgcacctggcctaatttttgtatttttagtagagatggagttttaccttgttggccaggctggtcttgaactcctgacctcacctcaggtgatctgcccacctcggcctcccaaagtgctgggattacaggcatgagccactgtgcacccggcctaaaaatcaccatcttgacagaacttcacgccttgctttttgttttttttcatctttgtgcttgttttccacttaacccttgatcacagacatctttccatgtggattcatgtagaactacctcattcgttagaacagctgcagagtattccactgtgcggttagtccatcatttccctaaccatcctcctgctgatggacagttagactgttccagtttttcagtatgattctatgccaggctgccatgaacgtccttttactgatccactcaggccagtatttctgtaggagaaattcctagaagtgggataattggatcaaaagatatgcacattctaaattaggagagagactgccaaactgacctcagacaaggttgtaccagtttgcacccccatcagcagcgtacaagtgcctgcttcccaacttcctcgccaacagtggatgctataaaaagcttcacaattttgccagtctcattggcaaatggtatcttggttaaatttgcatttctttaatactaatgggggtagggtatcttttcatatgtttattggccatttatttcttctgtcaattgcctgttctgattccttgtccattattctactgggtttgttggtctttttctcattgatttttagaatctctgttaatggatattaaccctttgctgttgaatgtgtttgcaaatattttctccctgtctgtcatttatgttgtctttttccatataaaatttaaaaacttttgtgtgctcaatatgtcagtcttttcctttctggcttcttggatttgtgttctgtgtagaaaggccctcagcccctcaagattataaaattattatatcttttcttttttttttttttttctgagacagggtgtcttgccatgtcacccaggctggagtgcagtggcatgatcttggctcgctgcaacctccacctcccaggttcaagtgattctcgtgccttagcctcccgagtagctgggattataggtgcctgccactatgcctggctaattttttgtatttttagtagagacggggctttgccatgttggccaggctggtcttgaactcctgacctcgtgatccacccgccttggcctcccaaagtgctgggactacaggcgtaagccactgtgctcggccctatatttttttcagatagccagttatcctaatgctcccttgatttgatggaccacctggatcacacattatgagccccctcataagcaggtgggagtctcaagcgagggccagtcccgatgggaatagcacttggtggctgaggaccctcctatctgtgcagacactgttgtaaaacttcacatgcatcatctaatttaatcctcaccaaaatcctatgaaatgtaggaatgatcattacacccatttatagataaggaaacggagggacagggagattactccgctacaggtcaagaggcagggaagtagagctgcgatttgaactgaggtctgtgtctagaacacgtgctcattctttccctaaaatgtattcataggtgaaaaagggcttctgcggaaagccctgggttatgtgggaaaccctggatttacagctgtctttccagcaggatgatgcaggagagagagggatgcgatttctcccaatctctcctggtcccagaactcattagagagttctccctgctgagggctcccgactggtgttgcacacagtacacttcgggagcccgaggctgatggttccatggaaagtacacagtcattttagtttgcacaccaagtgtgaagtgggcaggacaggccactgttctgagaaggaacccagggaaagggactggcccaagaccacacactggttagcggcacttcccacatctgcctgacccctagtccagtgccgccttttctttactctgcaacaggagtccaaaatcaggagttccatgaggacactgggaacagtgggatgggttaggccagcggtggatggttctggggagggcccgagctgaagcgcccccgcaactccccacagggatggctgcatcagcagggaggagatggtttcctatttcctgcgctccagctctgtgttgggggggcgcatgggcttcgtacacaacttccaggagagcaactccttgcgccccgtcgcctgccgccactgcaaagccctggtgagagtccctttcccggctcacggcccaagccacgcccctccagccccggccccgccctcccttctggccccgcctctgccagagcccttctcaagccaggaaaacctggtaattctatttgcctctcctcctgtggttctgcccggggccctgaggcgggctctaaagccctagtctcaccctcaagaaggaagaagtagagtcatcacctctaaatccctcctcccaccacggcccctcctctattgcagatcctgggcatctacaagcagggcctcaaatgccgaggtgagatggaatgactggaagggctgctgggcagtgttttttttgtttgtttgtttgtttgggagagttactattttggtggggcaattgccaaggagtgaagtaccttaaaatcagaggcgcatggccgggcatggtggctcaagcctgtaatcccagcactttgggaggccgaggcgcgcagatcacctgaggtcaggagttcaagaccagcctgaccaacatagcgcaaccccgcctctactaaaaatacaaaaagtagctgggcgtggtggcacccacctgtaatcccagctacttgggaggctgaggcatgagaatcgcttgaacctgggaggcggggtttgcagtgagccgagatcacgccactgcactccagcctgggcaacagagagggctctgtctcaaaaaaaaaaaacaacaaaaaaacccccaaaaccaaaaccccacaaaatcagaggctcaagatgactgatgtgaagggagtggcgtttaagaggccatttattttgatgacgcagctgcccaggaacagagaacatgggagaaggcatagactgacaattaggaggaggagaacactttggaaggagactcttattttggtggggcagctgctcaggaacaaaggttcctggtaggggggcgcaagcctgcgggatgggatggagggtattctgaccaatgtccctggctggctctccatttgctctcccccagcctgtggagtgaactgccacaagcagtgcaaggatcgcctgtcagttgagtgtcggcgcagggcccagagtgtgagcctggaggggtctgcaccctcaccctcacccatgcacagccaccatcaccgcgccttcagcttctctctgccccgccctggcaggcgaggctccaggcctccaggtaagagggagtcattctgtactggcctgtggagggaaggatgcagggctactggggcaaagaacgcaggatggaagccattccaaagtgcataattctctttttgtggtgggataataaagaagggacaggccgggcgcggtggctcacgcctgtaatcccagcactttgggaggccgaggcgggcggatcacgaggtcaggagatcgagaccatcctggctaacacggtgaaaccccatctttactaaaaatacaaaaaaaaaaaattagccaggcgtggtggcggacgcctgtagtcccagctacttgggaggctgaggcaggagaatggcatgaacccgggaggcggggcttgcagtgagccgagatcgcgccactgcactccagcctgggcgatagagcaagactccgtctcagaaaaaaaaaaaataaaaaataaagaagggacaggtaagggtgccagaaagtggccaggaagccctggaccttctgaggctgaggagagagaccctaatttataaagaggtataaaagtgaaagaggcttcaagattccagttacagtcttattttgttggaggggttaacaaaggattggagaaggtgttatatgagccattggcttgcctttccctttctggctgctctggaggctcttctggggaaagtcccttgccctgataatgtcctggcagctctcttggggtatttgatggttttaggtcagtttgctgaatgacaactggccaaatgattattttgctgagaacagtccgaacaactatgttaaactggggtctaaggtagttgatcacaactgtttgggttggcataagtcctcaaaaaacagaggcaggcacagggcatacatcctcaaaaatagaaaagataaatccatttgcattgagccttccagaagtgctggggtctaaaatgtgaaatacacacaaaattgacatttaagcaaactgcgctgacaaatctgtggctgaaaaagctgtggcaaaacaaaaacatagaaaaagagcctcaaaaattgggctgaggccgggcatggtggctcacgcctgtaatcctagcactttgggaagccaaggtgggtggatcacccgaggtcaggagttggagaccagactggccaacgtggcaaaacatcatctctacaatacaaaaatacaaaaattagctgggcgtggtggcaggcgcctgtaatcccagctacttgggaggctgaggcacgagaatcgcttgaacctgggaggtggaggttgcagagagccgagattgcgccattgcactccagcctgggcgacagagagagactctgtctcaaaaaaaaaaaaaaaaaaaaaaattgggctgtgaggtcatgcagggaattgatttttggtgggtgggtctgcttctgggatgatgtggatgcctcccgtggagaggggaagggttgatgaagtcccagggacctggaagtgtgttctgcagcaatccccctcccagcagagatccgtgaggaggaggtacagacggtggaggatggggtgtttgacatccacttgtaatagatggtgagtcctcccacagctggcaccagagctccccactgagggctgggggggagctggggagtatcagggaaatgggtgctttatccaaatggctccaagccaggtgggctactaccttgttgttaggggggtgtcttcctcacaacctgtttttctcttcccagctgtggttggatcaaggactcattcctgccttggagaaaatacttcaaccagagcagggagcctgggggtgtcggggcaggaggctggggatgggggtgggatatgagggtggcatgcagctgagggcagggccagggctggtgtccctaaggttgtacagactcttgtgaatatttgtattttccagatggaataaaaaggcccgtgtaattaaccttcaccatcagcgcctagaatcccggggggtagggggatggtatactttacaggatgacaatcttgggagctagaactttgtagccagagaaacttgggaggtctggaatctcatgtgtctggagtcttggggaagagaatcttagaagcagaaaaccttggaacataagaatcttggggagggtctaggatcttgaggagaccagatccttggacatctaaaacttgaaactagtaggtctgcacccgagaattgcagggccagtcatgcatacccaaagccttcagcccatggccgaaattcccttgctggacagggggcctttcagcccctgcttggacgcttccagtaacagggccctcactgcaggaatcgtgggagggagaggggcagcacagagttgctggctgtcggggaagggagggagggccctgggcagtccgagggccctgctgggcttgtgcctcagggtgggggctgcactcctccgccttgcagcctcctggcctggtgctgctgccagccggaaggacagtgacttccagaggaaatgcatattgatcctgctttcagcctccggtggtggcttctcccaacccagctcttccctcctgagcctgcagcacggaggttttgggggtcactgctacctaaagaaggctaaggccacttctgaggctggtctgggagtttactaaaggttctgaagctgggccgggctgcccctgggatcaggagactccagacagcagtcctgacaatgggaactacctcctcagtcccccaaactgggaggtgtcccacagcagctgtaggattgtcctaggggtggagacctgagcaccttccactccaaagcacagtatctgtgggcctggcagtggcctcagttcccccatgagtgccccggtcccccaccccagggtttccccacatcacatccatccctgctttgagaccccactccccctggcctgttctttattttgggtcactcccttctctttcctggtcatatctctcctgcaggcctaccctgtgttgggccccccagccctgtctctgcatcgggtgcccccctgcccctccttctgtcctcagccccctccgcccttccccctcttgaggctgtaatatccgtttcacgatttgggggctgagttgctataacaacagacggcgattgtgttgtgaagagcagctcgctcctgtgccgcctgcctcctgtgctgcctccatccctgcagcccagtcggttcctcttggctcctctcgtcactaccctccagttccagtctggcctcttcctggtgtgtgtgtgtgtgtgtgtgtgtgtgtgtgtatgcatgcatgcatatgtgtgtccaggtctgcctgcccgggatgtgacaagtagcggtcttcatggttgcatgtgtctgaatttggtgtctgagcttcacattgtatgcgcctgtgtgcatgtgtgtgcatggacatgcatgctgtatctgctgtgtttcccctcccccatgtgtccccactggcctttgcacatgggagaagggcatgtgctcagcatatcactcaactgtccacattgggtgggtacctgtgtgtggtgtgtgtgtgtggggggtgtgtcttgaagtggcaggtcccaaatgcttaggcaatctgaaccttggaccttgcagagaggagagatgtccctgtaggtgggagggacagggagatgcagcagctgcccggtgaccttttctgcccttgatgggcaaagctgggggtagggaaaggagacaagtgctcatacttacctccctccctgcccaggctcctctgtaagggtctgagtctgtctctgtgagccattgcatctgtctgtctatgccctgatgcctggatggacaaggggtgtgtgtgtgtgtgtgtgtgtgtgtgtgtgagtgtgaggctgcaggaagaggaacagtgggggatgggcaggaaagtgggctgtggggtcagggaggcgatttcgcatt

SEQ ID NO: 13680 - DNA, 17050 bp, Human; identical to SEQ ID NO: 12784
  misc_feature (1)...(17050): n = A,T,C or G

SEQ ID NO: 13681 - DNA, 17045 bp, Human
agctcagggagccagggaccccaaggggagtccttggacaaggaggcctgggccctgagatcctccacggtcagcgccggggcccggagatggagctgggacgagtgtgtggacaggggggatggctggcccccacgagcagctccaggctggagttctggttcttccaggtggctcccgctgaggcagcggtctctgggggatcccccagctgaaggaggctggcaggagttggcaagagaaccccctgccctgtccaggtgggaagctgagtcccagtgctgggggactgtggcctgggctgatcttgagccttaactggacatgaggggcatgagaataaagctgaactgcagcctcctgagtcttgctctgtctgttggccgcactgggtacctcagggcaccaggacacatgccgccccagtcctgctggttggtgggggtctgtgggcagagggcccctgcctggacagggcagcacaggcctttctccagggtcttggccagtccggccggccaaagcccggatgtcctggtgaggtggagaggggatgacatcctgggtagccagcagggattggggtctaagatctgggctcaggggtgtggggcagtgaagcccctgttgccccgcccccaccctctcccagggcactgtcttctctctgttcacatcctcctcctactcatctcccctccctccttgaggttgagccccctccccagggagttctcagcctggcggggcatcacttaatgccaggggttgccaggagaggtgggagggacgctggctctctgaccagggcctctagcctgatgcctgagaggcggggcaattcggctggggtgcaggatgtgagtcagggtacctggggccacccaggggagggtggagctgcccagggctgagataaggcagcctgaacttggggggtgcagagctgggagggacggtccgtccggcctcccaggtgtgacctgcagcagcttgagttcctcctcctctcagccagggcttcacaggacaggggcgtggggtggacaccctggcctctccagctggcagaggagctgagagcccctcccaccggcctcagggtgtggggcctcatggctgtcccactctgctaggtggccccattggtggtcaggaagggaaaggcaggaagaagacggagcaggggctcaggaggaccagtcagcaggggccctgggcctcatggggagagggggcagccccgtgtggcactgacatctcttcttgaggcctgctcagggctctaagctgggtactgcaccaggctaggagacaacaggagcagaacacgtgaggtgcgcatggcacctggtgggctctgcacggtgactgggggctgaagtgcttctgcaggcacccccgacagaaagctggtcagaaaactggccactcctctccttgccatggggtcccaggccgggctccagccccctcttggtgatgaggctcctccttgcaaaggccagtcctctggggagaggggccctgctggccacccccaggacgatggagtggggtgggctccactgcctgagagttgggtgacttccaggatccagaccccctctcagcctgcccagcaccaggcacctcgtcccccaccttggggcacagactcctaatgtcctccagccactggctgcagccggcattcccgggcagattcctggcttggggactaatgccccagaggctccaggttacccacgggctcagggatggctcccacggggtgtttccagttcccgggagagtcgagtaaggtcccggagcgcacggccctgaggcctggcctgggggctcgggagacagggcggccccagccggccgcccaccggcagcccggcgctgtcacgttccagccgcctgactcaggccgcgcagggcggggagccgggaggcggtgccggcgcccgcctcggccccggaggcggcaccaggaagcgcccgccccggccggagccgccatgtaaccggcgccgcccggagcccgagccgcgcgggccccagcgacccgcccgccatgggggacgaggacgacgatgagagctgcgccgtggagctgcggatcacagaaggtgggtgtggggcctgactgcggctgcccggggcaggccgggacgggtcatggaccggctgggctcattcgccccctgtgcccacagccaacctgaccgggcacgaggagaaggtgagcgtggagaacttcgagctgctcaaggtgctgggcacgggaggtgaggacccccatccaccgggcaggcgtcccaggcgcggtgcccctgacctcctgcctgctcactcttgggcctgggccaggccactgagcaggccccccaccctttcccggcacagcctgccttgcctgccccgccctgcctcgccagagtttgcatgcccacttccagggcactccacattgacatcactcctccctccacggtcctgtgcgtgcatacccccctggatttgccaacaccctggggagggggactggcgcccctctcaagtgatttgcatagctcctccctttcttccaatatgggatccccctcccacattttgcaaatgccccagcgctggtttgcgcatcccttccccagccaggtgcacacctctgcctcccttccttgcactggcatcttttcacatccatctgatctctcgcaggtttgcatatgccccgcccccatgcctcgcagcaggccccctggagatgcatgctccccagcctggtttgcacatcctttccctggttttgctgggcaccctcccggggtgtgcacaccctttccttagaaggctctgccagctttttgcacacctgcctgttgccccagctccttcgcctcatttgcacaccctcctgggttggcatcgcccccaccccccaagcctgcaccaatctcccgctcacagcccaccctccacccactcgctgctcccacagcctacggcaaggtgttcctggtgcggaaggcgggcgggcacgacgcggggaagctgtacgccatgaaggtgctgcgcaaggcggcgctggtgcagcgcgccaagacgcaagagcacacgcgcaccgagcgctcggtgctggagctggtgcgccaggcgcccttcctggtcacgctgcactacgctttccagacggatgccaagctgcacctcatcctgggtgagcgcacaccacatcccaacgggggtggggtggctgggggcaggcgaggccacctgacggggctgcttcctgacttccactgcacctcccagactatgtgagcggcggggagatgttcacccacctctaccagcgccagtacttcaaggaggctgaggtgcgcgtgtatgggggtgagatcgtgctggccctggaacacctgcacaaggtgggtgaagacctggccgcaggctgttgctatggaaactgggtctgtgccttggaaggaatctgcacgcagggcagcctcaggcttccccctgggcttcctggggggccagtggtgagctgggtgggaattggagctgcttcccctggaccccttgcaggaagcctcaacgttgcctggtggggtcccctcccctggcacctcctcgaaggggctttcctctttcagggaactcggggctgcgttcacagaacttcctcaaatggaaacctcacggcctggctcctaaggcctccttgaaatggagctcttcacacagactttcctctctctgggaccttggggcctgatccacggggccctccttctttgttttatatcttaaatggcctttcttattcagtggctctgccctggagaccccctctacaggcagatgactttctctggggggtctccttatcctgagcagggccaggagctggaggagctggggagggtttcggggaggaagcctcagcacccctcttgctcctaccagctcggcatcatttaccgagacctgaaactggagaatgtgctgctggactccgagggccacattgtcctcacggacttcgggctgagcaaggagttcctgacggaggaggtgagtggaggccacctctgcctgcagtgccccattcaatccttctccttcctgcctcttcctgctctgggcctgcattctggggctgcagaagtgaatagctccaagaagtttccacagctcagctctccaacctcacaagttgagcgagtcttactctgggccttgtggggcactggggcacaggagaggtttcgacatctaagcaggacctcttgccctcccagaaagagcggaccttctccttctgtggcaccatcgagtacatggcccccgaaatcatccgtagcaagacggggcatggcaaggtaggttggcagggaagtggggctgggggaggtggaaaggtggggtgtgaggcaggggagatgcaggccctcaccccggctccacccggcaggctgtggactggtggagcctgggcatcttgctcttcgagctgctgacgggggcctcgcccttcaccctggagggcgagaggaacacgcaggctgaggtgtctcggtgagtagggctggacgtggagggcggccagagggctgcagggcctgcctgggcagggctgtgggtggggggcttgctgcccctgacacccccccaatcctcccagacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccaggtgaggctgactcagggccccatacctcctggtgcatacccaggtggggctgctgttccaggttgaggttgtgcctggccagtttcactttatttggaaatccccccagagaaagaaagcaagtgtgtgtcagctaggtttctcttcacatccatccccactgaaacttggcagatgtgttcctgaaagaaaggattctaggttcattggctgttggggctgtcagggatttgagaatggattggtcggtcctttcactggacagacccagagaaggcaggtgacctgccccagacggcacagtaaatggtgccgagttgggaatagaccttgggtctagatagatctcctgctggtccaaatcagtacggaaacccacacttatggcttttagcacccacccaggcattttgttctttgtccccgtccctgtacagtctgtgtgcctgtcattcagatggacggttgatcagcacacatgggtgtttgctcacttgttaggagcacacacatgttagagtgcagtgcagagtgaatctggccatgcgagaatgcactgactcaggggctgggcctggccagcgtcatcgcccagcaggactttgtaacagtcaatacctactgtgtgtcggccctttgcggacatgaactcatttcaccctcacaactacctgattcttattttttagacggagtttcactttgtcttctgggctggagtgcagtggcacgatctcggctcagtgcaacctccacctcaggggttcaagcgattttcctgcctcagcctcccaagtagctgggattacaggcacaggccaccacgactggctaatttttatatttttagtagaaacggggtttcaccatgttggccgggctggtcttgaactcctgacctcaagtgatccacctgcctcatcctcccaaagtgttgggattacaggtgtgagccaccacgccctgccacaaccaccttgatttttgtccccatctttacagatgaggaagctgaggctccaaacaattaagtactttgtccaggaagtgatggagctcagattcaacccaaggctgagaggcttgaatgcctgtgcttaatggtcttctgcttaagtgtaggcatcagatttgccatccgtctgacatctaaacaaaagcacccatttctgggtacttattgtgggccaggtactgtgttactcatacttcgagtgccatctctttgaatcttccaagccctgggagggcctgcctgagatgatttcttacataggaatctatgtctttgaggtgaagatgtccctttgcacggggtggggaaagcatctgagcagtgttggtttctttcagtgaattccgtaagcccacccttcacctatgctgggtgctgcgctggatgctggagtgggttgaccagtcatacaggagaggccccaaggtcttcaaggcctgatgtgtggaagggtgtttccctccttctgtcttttctttttcttttctttttttttggagacagagtcttgctctatttcccagagtgcagtggcatgatcatggctcactgcaacctctgcttccctggttcaagtgattctcctgcctcagcctcccgagtagctgggattacaggtgcgcaccatcatggccagcttatttttgtatttttagtagagtcagggattcaccatgttggccaggctggtctcaaactcctggtctcgtgatctgcccgccttagcctcccaaagtgctgggattacagacacatgagccaccacgcctggcctccttctgctttttcttggacagcttctttggtgagagcagtgctcaggtccttggtggtagaactggagccttccagcttgagtcagtcatcttggctacatcgacaaaaagtccaactcaaaatggtgatatctgttggaatcaagtttggtgctagccacagagatcagaatgaacagagtgacctaagaggtttacttataagtaaaccttttattatacttacttataaataagtggcttacttatttttcttttcacataaaagaagtccagattagcagaccagggctgccgcagtgtcttcacagtgccacattgtcttcaggaatccaaactcttcctcttctttttttttttttaatttttttttattcttagcaagtagcttctatccctggggttgcttcatggtccaacatggttgctggagctcttgccatctaagctgtctcccaggtagggagcaggaggaaggagaaggggcaaaaggagcacatgccacctagcaacctccctcttcaggatctgttcctggaatcctacctaataatttttttctgataagttttggtcacccctaactgcaagcaagtttgtaaaaatattcttttaattgtgtatattggttcgtggaataaaactggggctatggtactaaggaagacagggagaatggatattgagcaggcaatcaacagattctgccgcattagcttaaacataaatgggcatgttttggctctcataagtgaaaaggtcgagggaaagtggtctgacttaaggcaagaccacatccaggtgctgaaactatgtcccttggttctgctttttctgcatggggacttcatctaaccctgagagggtccccagcagttccagaccacatcctcttagatttaagtccagcaggagaaagagatttgtttttcacgccaactctttttttttttttttttttgagatggggttttcgctcttgtcgcccaggctggagtgcagtggcgctatcttggttcactgcaacctctgcttcctgggttcaactgattctcctgcctcagccttctgagtagctgggattacaggtgtgcaccaccacgcccagctaattttttttttttttttttgtatttttagtagagatggggtttcaccatgttaaccaggctggtcttgaactcctgacctcaggtgatccagctgccttggcctcccaaaatcctgggattacaggcatgagccaccacgcccgaccttttcacaccaattctattaaaagttccagaactgactaagtgtggtgtcatggtggttctctaaggggaatagggattgtgttaccagagggagagagaagccagggaggcaggaggaacagctgcccaccccaaatgccagatgggcccttgcctcatggaggaactgcccagtgagggtgggctgagtggagggagtttctcgttcctggcctttgacacctgacctctgattcccttccctcagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcaggtgaggggaaactcatggaacccagatgcaggagagatgagatgttgctgtctgcctcagccctggctggcccgaggacactgcctaggccttgtgtcctgattgggactcagcgtctcccctagacgtcgccacttcagtgggacctagggttgtcagtcacagagaccacccaggcaggatgtgtgtttgatagttcatggtttatctttaaaccttctgttaatttcccttctattccatcatctctttattgttatgtaaaaatattgtttgaaattattcacttgcggctgggtgtggtggctcacacctgtaatcccagcactttgggaggctgaggcaggtggatcacttgaggtcaggagttcgagaccagcctggccaacatggggaaaccccgtctctactaaaaatacaaaaattagctggatgtggtggtatgcgcctgtaatcccagctactcgggaggctgaggtgagagaatcccttgaacctgggaggcggaggttgcggtgagcagagatcacaccattgcattccaggttgggcgactgagtgaaactccgtctcaaaaaaaaaaaaaaagagatcttcactttctcacgtggacacctaggaggagatgcatgttgatattgtggctttgcatgcccttggcatagcatggtacactcctggagggtcaggtcccctccaccgaattttttttttttttttttgagacggagtctcactctgtctccaggctggagtgcagtggctagatcttggctcactgaaatctctgcctcacgggttcaagcaattctcctgccttagcctcctgagtagttgggactacaggcgtgcgccaccacacccagctaatttttgtattttcagtagagatggggtttcaccatgttggcctggatggtctcaatctcttgaccttgtggtccgcccacctcggcctcccaaagtgctgggattagaggcatgagccaccatgccaagccccctctactgaattttagaagcttacaccttttggacaagtccaaactccctttgcttgggcattgaggcccttcatgatgtggtccttgcttagaaccttagcctcagttctcatcattttcctacttgatgctctggagggcatgatcgaactgctcagaggttccagaatatacctctgtgcctttgcacttgctgctcctgctacctggagtacattctctacagcagtctacatggcaagcttctacccctcttttaggcctccttgtctgctcacctggcccagggggtcaccctttctttgtgctgcagtcctctgtggacagcatctccttctgtgcagtttatcatgttgccataatgatattatatcattatcactaaataaaccagtatggtttgtttaatagacagaccaagtatggctggataagtcccttctctgaagctcttagaattgacaactctgtgcttgaatgtccacattccattccattgtctcacagccctcatgataaagttctttctcttgaattggtaggtactttcattcattcatttaatgattcaaaaatgtgtagtgagtgcctaaaatattccaggtacggatctgggtactacatttttaggagaagatgacacatagtttatttttaaaattattttttaaaattaattaattaatgttttagagacaggatcttgttctgtggcccaggctggagtgcagttgggcaaccatggctcactgcaatcttgaactcctgggcttgagtgatcctcccacctcagcctgcccaatagctaggactacaggcaagtgccaccactcccagataattaattttttttttgagacggagtttcgctcttgttgcccaggctagagtgcaatggcatgatatcggctcaccgcaacctctgcctcccgggttcaagcgattctcgtgcctcagcctcccgagtagctgggattacaggcatgtgccaccacgcctggctaatttttgtattattagtagagatggggtttctccatgttggtcaggctggtctcaaactcctgacctcaggtgatctacctgcctcagcctcccaaagtactgggattacaggcgcaagccaccgtgcctggccacaacacgcaattaaaatgacccttaaaagctcctcaaattgccaggacatggatctttaggaaaagcaaagaattaactctgccttctttttgcatttcttcagtagctccccttgcagaagaagccaaagtccggcttgaaagggaggaataaggtttttttcctcagcggatagagttggattctcataagctaagcgtgaactcaggccacactttcaatatattcattggtcctttcagtgccttcagcccttggcacctggggaggaataagtggtcactctgatgagaaagttggggtcacaggctggtggggacagacatggccccaagtgattataaaaccaggtggaataaaaagtgtccacacatcctgtgtgtaccagaatgcaactggaacaccccccactgcccccttgtccagggtcttgcctttgcctggttccccaccagagtctcctcacccgcacccccaacccccatgcccatgcccattccccggactcccgccctgcagggatactcctttgtggcaccctccattctctttgaccacaacaacgcggtgatgaccgatgggctggaagcgcctggtgctggagaccggccaggtcgggcagcggtggccaggagcgctatgatgcaggtgggctgggctgggctgggttggggggaaattggttttaggagaggcctaggcccggggactctaggcctagatccaactggcgcccgcagcgtgagctcagcaaggtcctaagcctctccgacatggggcgtggcggggccgcggggctaccaggtgggacctctgacgcgccgccttcgccttcgccttcgccttcgcctccaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggtgggagggcccaggcgcgggcaggggtgggggtggcagagcgctgtcccgggggcggggccgaagcgcggcgaccgtaactccttctgctccgtcccccaggctggaggcgaacacgcagcgcgaagtggctgccctgcgcctgtgccagtcacaccccaacgtggtgaatctgcacgaggtgcatcacgaccaggtgatggcttccggccaggggagggcggagagaaaaggggcaggcggcggggcttgggggcactatgggcgggatctaggggtgaattgggcggggcctagcgtttgattcggggcccaaagggaccagggaggcgcagggagtggaatttgaggggagtagggcctgaggacgggaaggcggagctgaggatggacaagaaaagggactttggccgggcgcgatggctcacgcctgtgatcccagcactttgggaggtcgaggtgggcggatcacttgaagtcgggagttcgagaccagcctgggaacatggcgaaaccccgtctctacgaaaaatacaaaaattagccggacgcggtggcgtgcgcctgtaatcccagctacttgggaggctgaggcacgagaatcgcttgaacccggaaggcagaggttgcagtgagccgaggtggtgccactgcattccagcctgggcgacaaagcgagactgtctccaaaaaagtaacaaagaaagaaagaaagaaagaaaaaggactttgaggagggggttctcgaacattggcagggcccgaaggccgggggcggggcctgggtggtgggagggggcttgccgccgtgggtgggtgttgaccttggcccgccacgccgcccgcagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggaggtgggcgagctgcctcggcggcggggcggagcggtggcgccgggggctgcctctgaccactaccccgccgccctcgcagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctggtatgggacgcggtccttgaggcggggtcagggtcgctcggacctggcgtcttcctgatgtgcagcagcacgagggaggggacaggggtcatcttggtgggggcggctgggtttcgtccgaagctgggatcggggtggttcaaatacagaggtggggtcgctctggtgctagagtcggagcatccgggtattgggggttagaagtcagggttcaccacgcgtgggtctcaggagtgcccctagtggggagggtgagtggttctgtgggagcggaggggtcagcctcggcaccccagcctgggccggcctcaccttcccctcaccctcctagtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgaggtgcggagctggaggtcacagaccatggttggggagggggacgctgggacagggatggtcactgggccaggtgtcctggttggggatgggtaggggaggagagtggggctgttacgatctctttggggctcagcctttacgccaggctcctccccacacttccttgccccgcctccagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggtaaggggcagggtctgttgaagggaaggggtgggcgaagcctcgagaggtggggtctggggaggcccggccatcggagcacagaaaggcgaggtgaggccgggcgcggtggctcacgcctgtaatcccagcgctttgggaggccgaggcgggcggatcacgaggtcaggggttcgagaccagcctgaacaacatggtgaaaccccgtctcttctaaaaagagaaaaattagccgggtgtggtggcgcacgcctgtaatcccagctactcaggaggctgaggcaggagaatctcttgaacccaggaggcggaggttgcagtgagctgagattgcaccactgcactccagcctgggcgacagagggagactccgtcaaaaaaaaaaaaaaaaaaaaaaaaagggaggtgaaccgaatccggtggtcggtctggaggccaaggccctgtcggccttgacctaggcggctggaggcaaggtctgggaatggaggtcaaactagatctggaagccggggtcaggcgggggtgggggcactcaccctttcctttctgccaggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggcatctgcgtgtcctcgttcgtgttgtgggtgtctagagcagagattctgggcagacaggctgctagcccgtggagtttggaacctcagtggggagggacaggcagactcttctgggcaagaagatattctttgttccttgacttttgctatgagcaggagggcgcaactctcatcctgggtgtatatccggacagctctgctgggtatcatttaggatattcttggttgtaaatacagctgctgcttgacttagggtggacctacatcccgataaacccaacctgaatagaaaatgctgaaagccgaaaatacatttaatgtctgcaacacagcagacggtgcctgacttaggattgtttgatttaccggctttcagctttaccatggtgccaaagcgataggctttcagtagaaaacataaataaatggtaaggagcttcctgacttacgatgggattacccatcgtaggtcggaaaattcgtgtcaagcataagtcagtcggggactgtctgtaagagaaaacccaacccaaacttgcttaagcaaaacacagggttttggggggctcttggaactatgcagcttctcgatagcttcaggcaagacctaatccagactgaagcacatgatcaggactcagctgccgagtctgccgagtctgccgagctttttattgttttcttggcggtggtccagtctggaggactctccttatggacccaagacgggtgccaggcgctccagggactccagatggaaatatggagatggaaatggtttcacggttcccaagggaagtcctgagatgtgctctgattggagccactgaggtcatgtgcccacactgaaccaatcactgtggccagggaggcagtgtgctgattggcttaggtctggaccatggcctcccctctggaggctcattgggtggagagtaggggaggggtgggcccttgacggaggttacttgaacccggctgggtggtcagtgaaggtgggagtgagtggatcagccccattcattagggccctcactgggatcagagcttcgttcccctcagggagtgtctgagactcctccctgtgtgatccctgcggggtgtgtgtgtgtgtggccatagggcggttgtggcctgagcacttttgccagcaccgcaggtaggttcttttgtccacacatggggatgtcctgacagctcccgccccagggtctgcctgaaccccaccctgggccgcctccccatcgtttctctccctgtggctaccctgtgagaccatctcatgtggaccttcccctcctgtccccgggaggcctggggatctgggctgggacccagaggtgcccaggtgaggcgaatcaggcagtccttgtgggcaggtggggctccgggggagtggaaagggtatgcgggcgccagctgtgtcccatcctggtggtctgaaagaacaggaaggggcccaggacaaggggccctcaggagaagggaagaaattctgaggctctaattctgactcctgtgttaccagctgtgtgactttagcaagtcacctaacagccccaacctcccctatttgtcgaaaagaggaactagagaattaacagatttaagagtatggtcactcagtcaccaggaatttattgagatttactgaccttttccaatgtgtagggaccctcctgagcactctaggcgggaatctcattgaaggagatgaaagggtcccatttcatcagatactcacaagcactgagtattaccatttcaaaaccttttctaattgagtggatgcaaaatagtctctcatcttcaatttcttcacctctcattccatgtaactcacagccaccctatgaaagaggtatccttagcctcatttcttcctattaattaattaatttaacttttattttaaaaagagatttttttttttttgagacggagtctggctctgttgtccaaggctggagtgcaggggtgcgatctcagctcactgcaacc

SEQ ID NO: 13682 - DNA, 29889 bp, Human
aattgctggtcacgtgggcctcaccagggtgacagagatcccttctttcagtcctttaagatctttggagaaagtcaagtggccatacataacgacagggtctgggttttgtttataaataacccaggaacattttgttgttttcagttttctagggctgggttttcccagcacacagggctctggggagatttgaaaaccatggcgcgtcaatgagaatgctgccggggcgccagtttggagcagcctcattgagacgactgaacaactacttcattcaggatcctcagccctgggcccttccctagatcaacccagaaactgcatctccggggtggatccctaacagtgctgagtaggaggcaaacactgtggcttctaaggctgacccgggaagtctggactaggcccgccggaggctcctcgtcaccaattggcatgcagcctctggtgacagctctgcctaggagcctcagtatcttcttttgagaataacaccaaaaaaaaaaaaaaaaaaaaagggggggggcagtagcttgtgtgctttactatgatgaaaagaatcaaatcaaagcactaaggggcgtaagattgcaggcagggttggaattacttatccgctctccaatggttagggagcaagaggggagggcaagggaactatctattccctcggaagggatcttacaagcggtaggcgaacaaacctcccatcgtgtcctctctagattccaccagactcagttcccctgagatatcccccgttctcagatttgagttcctgcctcttcctcttagcctaccagcccaagttatcccctgatacaggcccctagccctccaggcttccacatctcccagaagcgaggaagttggacctgaggctttcaaagtcgcaggttcaattcagatctctttaagagcccccagggtcctgctaccacaggttggtgtcttgatactggttacataacaatcagtccccaaagctctgacatcacccactgaagattctcaccagcctggacagccaaaggggtctgtgtgtggccggggaggatggcgggggagtgagccccatggaacagccaggaactggtaaggggaggtagggcacagatcccagtaaatgatggtaaatggtggtgaccccgagaggaaagtggaagtatttgggtttttaaacttccccctaaattcccacaagatttcattgttgcccccacacttcccctcttccccacatagggaatttccgatttcacttcccaatacgcaagtggccagagagcctcaacttcctcctcatgccctccctgccctgccccagctatagcctctgtggggaagccttctcttctcccgcgcgagtccggtgtcacccatgtcctccctcgcttgcgtccctctcccattcccaccccgtcggcctgaggggaggtcaggcctctcgctgcccatttttctttccccagtcaccagcccgccccggattctctactccctcagcttgctctgctaccactttcctgtctctccctctcccaaagcagataaaagatgaggggacaaagacagtgtgtgtctgggaagctgggctgagaggaggaggtgccgccgcctgggggtactccgatgcttccggggattccgagccagctggaggaccgcacgtggcgaacggcgggcgcggcgcgtagtcagggaaccagggtgcctgactgggtgtctcgtggagccatcccgcgggggtgtgggggggccacggtgccggaaggcgcgcggcccagaggccgtctccgccgaacgcccgctcctcgccttcctaaccgcagcactttcgcgagcctccctacgaggggcggggcgaaacaggtgcggttgccacggcacccggaccacagcctcgcgagatttggaatcagccaatgggggcggggtaggggaagacgtggcaccagtcggaggggcggggctgggaggggctcctccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctccggattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggtacccacccatcactccagggggcggggggcgcgtccggggcacacccctcactcggagcctgaccctcccgtggctgtcgccccgccgtcctttgtctccgaggccccagtgagaccctcagtgaccactccctggtccaagggccctgccccttcccagagtaaacccactgggggtctaagagtgggcgttgtcggctcccccagcttctgtcctccccagaatcttccagggtaaccaccaagccctcctgcagatcccagccccactcccctcagcagcagggccgcagtaggaagctgagccattcctgcgctccttttcttggtctccacctccgtcccgcaggctggatgcacctaattcacggaaatcaaccctcccctccctgtcttcttaagtgtcaatagcaaaacacaatgaaacttttagccattcccttctctggtgcggtgtgggtctgctctgcctcccctgggacggtggttttgtgtaggagggaggaggaggatcggctgtggcttgctgactttggggcagccccttggaggcaggggacagttgaggttcgaacacttctcccaatggcagctctcaagaggtcagtgctgccctgaggggtttcaggaagcaggatgaggtggtggcagtgggagccctgcaatgagattctggccctaagcccttctgtgcactgagggacagaatctgaggttccttcacccacttggacctcacttttccagttaagtggcctctgcacgcgaggagagtgagctccaggactctgcctgtctcagtgctgtgaatgaaacacagtgctcccgcccctcaaggagtgcaatgcccaagctcacttttctccagagaaactcgagacatgcccgtcccaacccccaggcgacataccaaagtacttcacagaccctgtcctccctgccaccccacgttcacggactccacatgcctttcataattctgcaccagcgaagagcctctgaaggaatctttgaatcctgccttccaggtccccgccctgcacggtcacattcctttccagacgccatccagccgtgcagggcagcttgccctagagccaagctggtggccaggcctactccaggcacagagctgaccttcagcagggtctgttcacttccaggcatttcagcccgccctcctgttttacggctgttgatgtttgtctgtcaaggccaggttgagtgcagccctttgggctaagggtcctgaagaggcggagtcctcttcactttccttgtgagggcacaccttttttgaaaggagagacatggcacaggaccagttttctgaatttggaagcctagagtttcagagctggaaggatcttagacatcatcttggcagcccccacctgactggttcaggaaaccgaggttcagagggtctggctgatgtgtggaagtcacccattaggtcagccagcactgactgcctggcttttgcacagccagttactgctttctgctgcttctacccgaaaaagagcaattcgagattgctttgtccgagaccggtgctttgatgacattggtgccacaggatctgagaggtggcacacgtttatttccttcttgctgccacctcatctccagaggatccctgatcactgatggccctgccgaaagggccctatcagcccacgctgaggcccagagctgtgccaggatgtgtagtgtggggagtgagcccggcgaggagggtgcaacaaaggaggcttttctctggctgatacagcctctcccagctgagtcttgaagagactcattgagtcgtgaacttgacttgccggccttctccccctatgtggctgctctaagaataaaatcagctggagcagaccaaggcaaggtgcagtcagggtgtcttaagagtgtcttgcaaaaacttattgcataactgggactgccacttgtgcgagatgaaacctgtgcgtccttggtgagatggaatcggaggcatctttgctgcttcccctttcttgttttctgccatataccctgggctctgcagagcaactggtttctgggtcctatagatattaactcactttctgggctcatttatgaggcatttttatgtatgtgatttcccagagccaattctgcttcccatccttctattctgtaatcatctctccagcgcctcctgtccccagcaggaaggccaggactggccttcatgcattgctactggcactggcgagagtgaggcccacgttttgctcgccctgcaggtcagctggtcttgctccactgccttgcagagcaccccttgccctggccagctgccctctgcccgtgggcccctggtcactgggggatggggccaaagggagaagctgatcggctcagagtcctcccgtctgttggaaaggcagcttcaagtctgtgtcctacagataatgggtcagtcttttctttgctctcactacctttttcagagaagttttttgtttgtttttttgagacagagtctcgctctgttgcacaggctggagtgcagtggcgcacaatttcggctcactgcaagctccacctcctgggttcgagcaattctcctgcctcagcctgccgagtagctgggactacaggcgcgtgccaccatgcccagctaatttttctattttgggtagagatggagtttcaccatgttggccaggctggtcgtgaactcctgacctcaagtgatctgcctgccttggcctcccaaagtactaggattacaggcgtgagccaccacgcctggcctttcagagaacttttcaaaggagctttttctgcgtccagtgaaggatccctgctctcaactgagactgccccttgcctttctgggctgttctaagcttagtgtgaaactcagatatgcgtggctgagccctggcccgcaagtcgccagcctctccacggctttgttcttcctcagcctgctcggactttcagagaatggcgcgtctgtgcttctccgtcccaccgtctaccagcctgtgtggtccccagcttttgccagccgtccatttcaattccctcacccaagcggctggttgaaagggcagggctggccctagcagcagtaggaagcggccagctctcttcagtgtggagatttagccaagtgctggaggattctgagatgggatttcagcgccccagcgtgaccttctgcttcccctccgaactgaatggtgacctaggcttgcacagttttcactaacaagtcagcagcttgaaagttgacctctcaaactctaggggaaaagtgtgtgaggaagtgctgatttgggtcagtttgagcctgctggttgcattcccagttgagaaagtccatacgatttgccggccaccccgggaaactaagacgatagaaaaccacctgtcagttccccgctgctggagaggaagccagagatggagcgaaggagtacagagagccctttgttgtgtccggagcagtgatgactgtgtcttgacgcctctcttctggctcttgctctcatgtaggttcatgtgtgcccagctgcccaaccccgtcctggacagcatcagcatcatcgacacccccgggatcctgtctggagagaagcagcggatcagcagaggtaaacagctgtgaccacagctcgggctgctggtgttgtcacacatccttctctctaagatctgcaacttggttcagatgctgcccttgagatttctcctttttttttttttttttttttgacggagtcttactctgtcacccaggctggagtgcagtggcgcgatctcagctcactgcaacctctgcctcctgggttcaagcgattctcctgcctcagcctcctgagtagctgggactacgggcatgtgccaccacgcccggctaatttttgtatttttcgtagagatggggtttcactatattggccaggctggtctcgaactcctgacctcatgatctgcccgccttggcctcccaaagtgctgggattacaggcgtgagccgccacacctggctgccctcgagatttcttccagtctcagcctttctaaaaaaaaaaatgtggccgggcacggtggctcacacttgtaatcccagcactttgggaggccgaggtgggcggatcacgaggtcaggagattgagaccatcctggctaacacggtgaaaccccatctctactaaaaaatagaaaaaattagctgggcgtgttggtgggcgcctgtagtcccagctactcgggaggctgaggcaggagaatagcgtgaacccaggaggtagagcttgcagtgagccgagatcgcgccactgcactgcaggctgggcgacagcgagactccgtctcagaaaaaaaaaaaaaagtgtccgagtaagaacccattttacatcagcctcccatctccacagtgctctgtgcactgagagggcgggagctgctttctttcttggctccctgggcctaggcaatgggagcagccatggtgagaccacagccaatcttatgtggctgtcatgcttttgaacccctggggcatgctggaaacaacaggatcagaatcgggccatgctgtgagggtgcaggaagcattgctgactctgaacaagcccctggtccccagagcttattagctttagtctgtgtttaacagcctttgccccccaaagccatatacattcctcacacgtccagcaggactgagagagagccaagcaaaaggagaagctggtagaaattcatgaaacgggctggtggaaatttgcttacatttgcttagaggttgacagcagcctccctggctgaggccttcttgctatgcagtagtgcaccgtgcccattccaattgtgtaaactcctgcctagattctgccaagctcttttgaagatctggttcaggatgagcctgaactgggtcctccatctgtcactgcccctttttcacagacgggtggggcgctttggggcctgatgctttctgggaggagcttgagggtaggctggtacctggcaggtgaggagtggagtctacagctccaaatgtgaaaatgaaataagatcaaactcaaagaggggttgaggacaagtgagcaagtttgttgatgattaacttgcagatccttcccgtgtcccttaccctctggactggcctttgctgggtgagccttgcagtcaaagccggcagctaggatttggggtgcacatgtctctctgctagggctgtgagggcatggggactctgttcttggagctgagaaaccttgcttctctttccttccagccttgcgggccttgcccgtgtgggactgcatcagagcgtactgaaatcactggccctcatctggtttcagagctgccagttaagctgttagattctcccacccctggtgacagtgatgcacctaggagttaagggagtagatttggagacccctttaaaaaaaaaaaaaagcgagggctagtatttttatttcttactgctattgttgttccaacctagttttagtaaatgccggataagcaaaagccctgtcatttgccaaagcaaggtcagaaaatctgattaagttactcttttatttttttgagacagagtgtcgctctatcgcccaggctggagtgcagtggcatgatctcggttcactacaacctcctcctccctggttcaagcgatcctcccaccttagcctcctgagtagctgggattacaggtgcatgccaccacgcctggctaatttttatatttttagtagatatggggtttcgccatgttggccaggctggtcttgaactcctgacctcaggtgatctgcccgcttcggcctctcaaagcatcatcacagccttgaactcctgggctcaagtgatccttccaccttagtctcccgagtagctgggcccacaggcgcgggccatcatgctcggctggggttgtatgtcttgtgttgcttgccttggcccctgccctctgagatgctccctccccacctcccactccctctgcttcctttccctggtaggaaagaggcaggcagaggtgtctacactggctgtctctgggacaagcaccaaagtgtatgctccatatcagtggatctgcagacacagcatggcgttttgattgggagcaaggggtggacgtaggtgttgccttgtggtccctgccctggagttgcctgtgcagacaacaggttggaggaacaagccagcaggacatgaggctgctgtcagtgtgctgccctgctctgcctgtgtggcctccctctcccctccaggtgcaaagtgtggcccctctgcatccctgagaggccaggctcccctatatccacagaaggtcatctctacccattatgggcaggaaggagccggtggctgaaagagaagcacatcacgctgattggaggaggggtttcctgctgtgaagtagcagaagatcaaaccgattttactagaccatttcttttcctccatagccctagaggccttggtttagatgtgttttactaaaagttacctggttagggtttgaatgatggtgttttattgtcaggagaaagaccatcgctcagtacctcttggaggtgctgggtgtaaactccaggatgagccccgctaggtgtacacaggaggagtggatttctgtttcctggaggccccgcccgtcagtcatggaaaggcccgtgtggcctgtccagcggaggaggtcggagtggagcagtgcgttcccggcagggctggccacctgctactgcctttgctggtggcgtggaaagcaggtgtttccctctcggaaagatggggccggcagagcacgcaccagggccccagcacaacacgcctcccctggcctgccagcccgttccctggaaacatgtccttgtggaggccgtggatggacattggggttgctaattgcatttacttccatttcccaccccgtctggccccgcctggcccctcctgactttttttcccctttccccatggtcctaatgtgtgcaggaaacacggtctgaaaagataaggtgggctggtgcaggcccaaagcagtcaggatgcagccaggctctgtcagggacccctgaggactgcctcagggacgagaagggggccgggttggggtctcttgggctgcctttgcctgtgtgctaatctgagtgactttaaagataccgttctcctgtgtcagcagagaaaggtggcctctgggggctgcgttcattcttgagtgctgcctgtgtgactgataagggcattccaaagggcagctgggtccggcaggggtggtgcccttggctccaggggctgccgaccagttgcgtggtcccggcagtgcctcatgccgagtcatcccccggcggggcctctgtgggcagcccggccagttcgttcgttccccaccatggtcactaggcaactgtgaactaagcgggagtttttgtgtctcaatctccccatgaaagctgtatcagcatcagcagggtagtgtttctacttgcagtagcagatcagagacctggccagctttgtgtctgactttctgctggccactgccacatcagtgagttccattgagttatcacagcagctgcatctaggaggaagctcctgcctttcagaggaggaagcagaggcttaggaaagttaagtaattggcctaagatgacaggcaggccagcaagtgtcggcgctaggatttgaacccaggtaggggctgtgctcctactgcggcggagctgagaagggtgccttggcatgaaggctgtgggcgaaggagtgccgggagcttgggtcagacagacctttgcccctgttgggtcattactgtggacacacagtaatgtgtgtccctcctgagacacacagaggccaccctctgtttctctcccacccaaggttagactccagtcctgaaatggacctgaggtctggggctttgaacagcagtgctggtattgtgttccctgttcccagccataaatgatcccttggggtctccagggagcctggtggcctgggctctcgtttgccctctggtggtctgcaggctccctctaagcctgggagctgtcctgatccttagtggttggatggggcctccctgcccacactcccacctgtgtgtcctgagccctccggcccagaggcaggcctgcgccgtgggccgcccccacttcctgccgacacctcctgagatggagatgccgctgccagcagcacccccaggctgaggtttcaccagggtgctccgaagaccatcaaatgctcccaggggctgcccaaaggccatgagccaggccaggtgctgtgtccctcttggattcagcatccatagcacaagtagatcagaaggttcaagtcccacgttagtacttggggagctgggtggctctagggagttgctgtagtccctgggagctgcatcagtccatcaggaaacaccatagcctctccagttattgtagattaccagaatttacatgttaagctcttgccctagtgcctggtgcacagttaagtgttcaagtgtcagctggttcatagtcaagagattgaaaagcccagggctttccagacggtgatctgagtaacatcctggggagtatcctcggggaagtgctgactcagccggggtttcccgttgggttccaggccctcctttgctcccagctccaggcctcccaaaaccctctgctcgccccacctggctgtggtctccctctgtggcccagcaggccaggatgccaagacagcttttggcctcagcctctgctgggggcgtgcaggctctgccacagaggaggcgtaccaggcgctgcccgcgctcagcacctgttccccaggctgcgcactggcggtgggctggggagcagctggccgagcgcctgcaaacattccgtttatatttgggggatgaggcattcttcatgcatttgaagtccttgcctacacacccatcagaatctgagcttcttaagcccaaaatacaaatcctgcgagtaaataagagcaaacatttactcctgctcgcagtgtgccaggctcactccatcctcccgcggccctccaagctggaaacctactatcttcgtgttacagactgagaagctgggaaccgaggctctgagaggtcagagacctgctgggtcacacagctcgttgttgagtagaaggttcaggatggaaatgtgggcctgattccagagttcctctgccccctcccgcccctcttttgttgcttctgtctgatttgctggggtctacgttgtgtgtagtgaagtccaccctcctcaggtgccctgctgtacaaagcattcctgggctgccgccaccatgacagagagtattcccatcgcctgaaagttcccgtgcccctcatagtcactcctggtcccaggcagcccactgacctttgtctctaacttttgccttttccggaatgtcacctaaatggaatcatacaggatgaagccttttgcttccaccttcacttagcaggatgcttctgagctgcatctgtgtgtttgagagcccctgtggcccgctcctctttgttgggggtccttgtcccatcatagggatgcaccatccgttgtcatccattcacctgttggggcgcttgggttgttccacccggggcagttttgagtcaagtacgtggttcgtgtgggcgtgtgctgctgctgctctcaggtaaatgctgaggaacggaggcgcctctgtgctccactggaaaacccttccggaggagcttcagcctgagcaagcccaggaacgaggcccagcacgcgttggaaacctgtgtgatggagagctagggcgagaaatactgaagcccacgcagcttgaatgacaggaaacaaaagtcgattggagacaaaccctctatgtttcatgttctagaaatctttggaatgtataaagcagcttttccccctgcggctggaactacctgtgttttggaggctgctggggtagggcggggaggcctgagaacctccctcttccccttctgtgctggcgggaaacatggtccagctgttctcaggaaggcagaccctgtaaggccagcgcctggagaggggcgccccagagccgcagtggcctggaggaggctgggtgggacgcgggtcgccatgagaggcacctgcgtgcacgctaccctgaggtgccatgcctggctcagcctggttgcccggagccactctgttctttcatcccacagccccaggacttttcgttttcactttttaaaaattgtgataaaatacacctaacatataatatttaccattttaatcttttttttggaggtgggggtacggagatggagttttactctcattgcccaggctggagtacagtggcacgatcaatctcggcccactgcaacctccgcctctgggttcaagcaattctcctgcctcagcctcccaagtagctgggattacaggcgcctgccaccacgcccagctaatttttgtatttttagtagagacagggtttcaccatgttgaccaggctggtctcgaactcttgacctcaggtgattcgcccacctcggcctcccaaagtgctgggattgctggcataagccgccgcgcttagcctttttttttttttcttttgagacagagtcttgctctgttgcccaggccgaaatgcagtggtgcgatctcagctcactgcagcctctgcctcccaaattccagcagttctcctgcctcggcctcttgggtagctgggattacaggcgtgtggcaccatacctggctaatttttgtatttttagtggagatggggtttcaccatgttggtcaggctggtctcgaactcctgacctcaggtgatcagcccgccttggcctcccaaagcactgggattacaggtgtgagccactgcgcccggcctcattttaaccacgttttttggtcatggaccccagaaaagtagattttaactatttgtaggtgtgcatttcactggcatttagcacattcttcattgttcagccgtcaccaccatccagctccagagctcttcacttcccaaatggacactcttcctgttcaacaccagctcccctcgtggctccctgcaccccgcagcccctgcactccccattctatattccttttctgtgcacttgattactcctggtatctcctgtcagtggaatcctacagtgccgtatctgtccttttgtggcaggatgttttaaaaaaacttttaggttcaggagtacatgtacaggtttgttatacaggtaaatggagtgtggtggggtttggtgtatagattatttcatcacccaggtaataagcgtagtatctgataggtagtttttcttttctttttttttttttggagacagggtctcactctgtcacccaggctgggagtgcagtggcacaatcacagctcactgtagcctccacctcccgggcccaaacaatcctcttacctcagtgtcccaagtagctgggaatacagatgcatgccaccacacccaaatttttttaaatttttgtagaggggggtctcgctatgttacccaggctggactcaagcagtcctcctgccgcagcctcccagagtgctgcgattacaagcgtgagccaccatgcccagcctgctaggcagtttttctgtcctcacccattccaccctcaagtaggccctggtgtctgttgttctcttctttgttgccatgtgtactcaatgtttcacacccatggatgagtgagaacatgcggtatttggtgtggaacatgcggtatttggttttctattctagtgttagtttgctgaggataatggtctccagctccatccatgttgctgcaaaggtcatgatcttgttcctttttatgggtggatagtattctctgtggtatatgtaccatgttttctttatccagtctactgttgatgggtatttaggtggattccatctttgctatcgtgaatagtgctgcaatggacgtatgtgtgcatgtgtccttatggcagaatgatttctcttccttagggtttatgcccagtaatgtgattgctgagtcgaatggtagttctgttttaaattctttgagaaattgccaagctgcttttcacagtggctgaactggtttacattcccaccagcagcgtataaatgttcccttttctctgcaacctcaccagcatctgttatttttagactttttaataatagccattctgactgttatgagatgttgtctcattgtggtttgatttgcatttctctaatgattagtgatgctgagagttttttcatatgctcgttggccgcgtgtgtgtcatctttggaaaaggtcacagacttatttcatcacttagcatcatgtcttctaggtcccaggattttctgagctagagcttcctggtggcttatgatcccttatcagagggggctctggcttttactcactaaaaccactccctctgcaggtgggcctttctctccagcccacccgcttgggccatgttttctgtgtccttttgctcggcatcagttctgtcactcccactggggcctgagctagtcaagctaacagcaaggcccctaccttggtgggtgccaaagcctgaaggcttgttgccttgggcagtgccgggggtgctggcaagccctgttctgtacttgataccggccgtccagctctgatctagagagtggctcagtgttaccgctgtgcagtgtagcctttggcacctcttgaaacccggcgtcttttaggctgagtgaggtgcctttgagggcagcgagggcctggtgggctaaggagcgccggtgggcctggtggggcgtgcagttacgtggtcactgcctgcatggcacaggcctgagtgctgtggccctttttgtcacctgtgggtgtggctggccagtcactgtgtttccctcacagcaaaagcacattttctgtaataaacaggaaattttagtcacctgcaaagaaatgggcttacctctgttgactccagcttgagatgacggccagtaactgggtttcagagcaggtggggcagggcttctggacctggggcagggagttttggagtgctcactcttctttcttccttcccctcctttttctctctttccccagggccccccagccatccagggggaggggggagtggggccttgctgggtggagtttgggagggtgacctcagctccccaggcgccgtcctgactcccaggccaaagctaacatgggctgagcacagcccatcagggcgccctcattcccaagaactcggttttggcatcacagcctccccagctgtgtgaattctagtttcagcttgtggcgggctgaagacaaatgatttgacaaggggagaagctgggccccctttttgctgagcgaggaacctcagtccttgagtcatcgccttttcagtactgacctgcgttcccagagctggccataaaaggctgtgggctgcgggccccaggcaggcgctgcaggcttagctagtgtggcctcatcccccgggggcagaggcggcctctccctgcccctgtttccctcatgttgcccttggcctctctttctggttttctgccgagacttcactctttgggcatcctctcctgtggagctcagagccagctgcagggagtccgggtgcccggggccttgtactttggaagcaggagcctgtggtggcatgaggtgccctggcacgatgcccttccacaccttctgggcacagggaacctggcagctctgctgtctccgaccatccacctgagcctctggaaggctgatcgggcctccccgtccaggctggaggccaggaccccggctcccctgcactgctaccctgttaagaagcttggccctcggggctgcttctggtcagagtgccctatttcctgttgagctggggcagggaacggccgcacatcacctgtggagaggctgccgaggctgtgtggctgaagctgtggatttgggattttccttacattttggtgactttgctcaaggatgaaagtccttgaccggtgatgggtccaggccgctggccccttgttcccacagagccctggcttcccctgccccagcctgccaaggaggctgtccctgtcgggtcctgggctggaggcccagtgctcccacacgccctcctccctgcagcccggctgaggaattggtatttaaatttcacagatggagaaagtaactgagaagttaggaaaagaacttcaggtcacagagtcagtggcagggggcgggagtggagtgcagagccatcttagttagtggcccgagttccttctgggagcgccaggtgtggggaggggctccgcgcccctgtggctttgggctcacagatggcgccaagcacgcttgggcctggggccggggcaggcggcaggagtgtttatcccatgagcgagcttgactccgcacaccctgtggtgccatttatcttggcgtgcttgtgcgtagaggcagcctctcaggagcctgggctgtggacctgcctttgtcctggagggctttgcagggtgggagcagcggatgccaccaagggggaacccgtgtagtggaggagtcagcagcagctcccactgggggacggcagggctgccctcccatcaccgtgggcgaccctgtccagctgctgcttttccttaacgctttgtccttggacctcccacctcgctgctgtttttctgccccctcagtctagagagcgcccatctccatccccagcttggcaagagggtggtgtttttcatggagatgccaggagcaggtggtgggctgaggactcgtttgggcccaagctgtgcgactctcagactgttgtgtgcaggagtggcttctcctgctcttttccggagcctgactgctctctgggaagtacttggtgcttctgaagagggccggcctacatttgggtggcctgggacctgtgggaagactgagccagggacgtggaggcttgcccagaatcaggcagagaggatgtggcccctcgggggtggggcccaagctccccaaggattctaggcctttgtttccacatggcccgcctgtcactccttactcttcctagaccgggagggacagaagttttactctaggggcagaggaagaggtgaggatttcttttgttttgtttttgagacagggtgtcgctctgtcgcccaggctggaatgcagtggcatgatcacggctcactgcagcctcaacctcctgggctcaggttatcctcctgccttagtctcccaagtagctgggactacaggcctgcaccacctttgtagagtcgggattttgctatgttgcccaggctgaagtggaaatatttagaagaggcctagttgtcatataggattcaaaactgctgttgaagaggcctagttgtcatataggattcaaaaccgctgttacagagacccaaaaatcattggcttaagtcagatagccaatagtttatgtgaaaaacaacagtctaaggccattctgaacatgcagctttcatctctgaacccgaggtgcttcctccagctcctcccatcacatcagcatccccgtcctcaggagggagaaaacaacagagggctcatgcaccttttcttgttcattctgctgaaggaggctgggaaatgcagtctgaagctgggaggccatgaatccagctgaaactagatagttatatctggttccttcctttaggaggaatttcaattagcagtctctgccacaggcgacagaattcactttaattggtgggccttaattgggccataatgggttggtgggaagcaatatagaatagagtttagaatccaggcgcggtggctcaggcctgtcaccccagcactttgggaggccaaggcgggagaatctctgagcccagcagttcagcatagacaacatagtgagacccccatctctacaaaataaaaatttaaaaattagccagacatggtggcacacgcctgtagtcccagctactcaggagtctaaggtgggggggatggcttgagcccaggagttcaaggttgcagtgagcgaagattgtgccactgcactccagcctgggtgacagagcaaaaccctgtctctaaaaaaatgaatataaaatttttttaaaaagaatatggagcttaaagctggagtctgtccagtccaaccactttgttttggagaagtgtttaagacccaggaaggggaagtggttcgtagcacttcctgggcttcttgtagagcagaggtcagcaaactttttctgtaagggtgggatagttaatacttccagctttgcagaccttatagtttctgtcacaacgactgaactctgctgtgttagacaaaagaagccatggataatacaaatgagcatggctgtgtttcaataaaactttatttatacaaacaggtggtgggccaggtttgatccctgagctgtagtttgccaacccttgttgcagaaaataagtgagattcctgcaaaatggggagcctggcacatcagcactgaaaaagtagcagctgcagttacttttgcaggcgcctcttgtcactaccgtcccagggcatacagcaggcaggtggcaacactggagtctatgttctaccctctgtgctgtgctgagcacagtgctgggtctcctcctcactctcgccctcctctgacccaccttagagcttgcactgtgggacgacctttgcattagcacctgtttatgccaagtgctacatgggttggggagtgttatggtgggggcaggaataggggagataatcctgccctcagggtgctgtgctgtctagatgaacacctaggaatttttttttttttttggaaacggaatccccctgttatcacccaggctggactgcagtggcacaatctcggctcactgcaacctctgcctcctggtttcaagcagttctcctgcatcagcctcctgagtagctaggactacaggcatgtgccaccacacccggctattttttttttttttttttgagatggagtctcacactgttgcccaggctggagtgcagtggcgcaatctcagctcactgcaacctctgccgcccaggttcaagcaattctcctgcctcagcctctcgagtaactgggattacaggtgcccaccaccatgccgggctaatttttgtattttcagtagagacagggcttcactatgttggccaggctggtcttgactcctgaccttgtatccacccacctcagcctcccaaagtgtcgggagattacaggtgtgagccactgtgcctggccttttcttttttttttttttttcgcgacagttttgctcttcttacccaggctagagtgcggtggcatgggcttggctcaccacaacctccgcctgctgggttcaagcgattctcctgcttcagcctcctgagtgctcgcgccaccctgcccggctaatttgtgtatttttagtggagacagggtttcactatgttggccaggctggcctcaaactcatgacctcgtgatcctcccaccttggcctcccaaagtgttgggattacaggcgtgagccaccacgcccggcctataggaattttaaaaactatctcaggctgagaaataccaggccaggttggagatgagagccatcagagcagcaggtcccttggcgcccctgagctctcccttctcttccccccaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggtagaccctggggtgaggggagcagcctattgccaggcagggccatggggctctgagactggcactcagggccccaggattgcccgagacccttcccagctcacttcacaggcagacctgcactgcgctgtttccctctatagaaaccagtctttggtcagcacccgcgtgcagcctgctcttaactaagattctctacccggcctccctctaaacctgttctgtttgtggtttataccccatctactttcaggaagggtttgactgtgcttacaacacagaaacagcacacaggaagttaccgctgaagcaaaggaggcagcctcagaaatggagtgttgggggatagagctctaaggcttgttggcttccctctagggttttttgtttttgtttttgtttttgaagcggagactcgctctgttgcccaagctggagtgcagtggcatgatctcggctcatagcaacctccacctcccaggttcaaatgattctcctacctcagcctcccgagtagctgggatcacaggcacgcaccactatgcccagctgatttttgtatttttattagagacagggtttcaccatgttggccaggctggtctcaaactcctgatctcaggtgatctgcccacctcagcctcccagagtgctgggattacccctctggggtttactgagcctgaagtgcactcagcacagtgctggatgccgggtactggcggggagtgacacacagcccctgtccactcctcagccttcatggggaaagcagagcacgcaaacaaaaaataaacatcagttatttgtgtcgtctcggagcgagcacaggctgctgcgggagctggcgctaggggctgtcccagtggagtagaagggctgggggggcctggcaggagctgaagcttaagctgtgacaggaagcagctcgtgaggagacagggtgccagcctgcagcccggggagcactgtgcatggaagccaaggtcacgctgaggcagtgtcagttcagcaggccttgcagaccatccttaggtctcctggcagcccaggcctggtggcacctatcagcagcctctgaatggccaaagggtttggaatctcagtggctgaccaagtacttgagtgagagccggtgtgggtggggccaggaaacaaaggttaatgccaccagcgggcccttccaacacagaatgacagaacacatgcccttggcgtgtctgactttggatagcaccctatcgtgagccagcctagacgagtcaccatgagtgacagtcccggctgtggttggggttgaccccgtggacaggagtgtttgacacagattgtctgaacagctgagaagtgaccaagcccacatttgtatcagcagggcacctagctattctttcaggctcttagcacagggctcggttgtttcagaaataggctccagccaggcatggtggctcatcctgtaattccagcactttgggaggccaaggtgggtgggcgcatcacctgaggtcaggagttcgagaccagcctggccaacatggcaaaaccccatctctactaaaaaaaatacaaaaattagccgggcgtggtggtgcgtgcctgtaatcccagctacttgggaggctgagacaggagaatcacttgaacccaggagggagaggttgcagtgagctgagatcacaccaccgcactccatcccaggtggcagagcaagactctgtctcaaaaaaaaaaaaaagaaaagaaataggctctggccaggcatggtggctcacgcctgtaatcccagcactttgggaggccaaagcaggaggatcccttaaggccaggagttagagaccagcctgagcaacctagtgagaccctgtctctatttaatttaaaaaaaaaaaaaaaaaaaaggcccttgccgtagctcctatctccaggccagccaggccggagcgtggctggggaactgtcctgcctgccaagccaggccctttggtgatacgtccccagttcttcaacagagcagggtgcttgcccccacctcatggcatgcagggggtaccagggtagacatcatgtgggcatgaaggcttcagtgacagatgtgcctgtggccagggtcacagtcccctgatctccagaatataactgaggactgaggatgggcacttcctggggagcccatgtccctgcctgctcagaggcatggagactgcaggcgttgagcacagtggccctcgtacccactctgtctggaggccagtcagagggcatgtgggtgctacctggtctgagcagtgagaactgacccttcatcctttgccaccactgtcctcccattgtgccccaagtaccctgggccccacctcaccctgtagatgaggaattctcattctggcctgaacctccgtgagctgtgtgcacgggcgtgggtcagatgccggctctggaggacagagggctgcgtgtttttcttatttttaattttattattttattttttgatttttttggagatggagtttcactctgttacctaggctggagtgcagtggcgcaatctcggctcactgcaacctccgcttcccaggctcaagccattctcctgcctcagcctcctgagtagctgggattgcaggcgcccgtcaccacacccagctaatttttatattttagtagagacggggtttcaccatgttgatcaggctggtctcgaactcctgactttaggtgatccgcctgcctcggcctcccaaaatgctgggattacaggcgtgagccaccgcgcccggctggctggatgtttttctagatctctcccttctggagcctccctgtgagtggagccagctttgagagaggaacccatacaaaaacccaggtgactgaccctggcctcaaaggacaaaggacgtcctgagctgaggggtgtgggtgtggccctagctgagtttctctccttgcagggcagagagagctcccttgctcagccacctttgaggacagacaggacaaggggcaggcatgagcccctgcctggtcgtctgtgagaccatgtgtgactgccaggccccaggcacactgagtcaccgcgcctggaaaaccctgtggcctccagtgttgcctcacacctgccacttccttttcctggagtgagtggtgctctctgtgatgactcccaccggcctgggatctgcctgccacagtgtccctggggagactctagatccagacccacatggcacggggctgcctccctcaggcagttctcagccaggcccccacccagggcacaggctcaggctgagcggggtggtggatgggctggagccggggagaagggcagcaaggctggctggccgcagccctctgtggctggacacgacttggcaaggccgagggatctgagggctgggctactctcgagggctgccaggttcccagcttgctgcagggaaatgaagggggtgccgccctgaacaggcacatgcctaagcaaggtattgatgcttggataaagctggcaaccaccaggagaagcctttttgggatttttcaaatccttcgtcatccgagctgtgatgatggagtggagcgtggcacgggcccattggagttctgtgggctccatcggcactcagcagggatttggacgtgcaggctggtgggccctgcaggaagcctgctccctgctctgctgcgtgggagggggcagctcgggggaagggggcttgcagagaaacagaagaacatgggctgtggggcaccttcagcagcccggggttccaatcccagctcctccatgtgggagccaagcaccccaggcagcctttcccagccttgcttagggccgggttgggagaatcccaccccgcagggctgtggtgagggttgaacggagggtgtgtggtgagggttgagcggagggtgtgtgatgcgtggtgagggttgagcggagggtgtgtgatgcgtggtgagggttgaacagagggtgtgtgatgtgcccagtggtacacgacaaattgccttctttgggttgacagactgggttttactcttcctgaatcatcacaatgatccgtgcaaggccaaggctgttgtcttctgtttcaagtgcgttttcctgtcctgtcctctgtcctgtggcagtggacagctgtggctcttgccagattgtgtctgctcctaggactgtgggagccggtggtggtagcggccttgagcttgacccatccctcctgcttccctgttcctgagcgagcaccttggagtatccttggagtgtccttggaggctctgctctcgggggcagcctgggccaagagagcgcctgatgctcaccccgtcctcacaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggtacggctgtcccgaggccccatgcaggctggtggccatcagggcagaaggaaggcccagggcactggatttggagggaatcccatctccatggggaagggcctccctgaacggaagcagctgggttaatcaccagcaccccacccaactcagagttgacccaggcggtgacactgcagaggggaatgtggtgactcaccctgcgtggtggggggagggcagggccatgccaggcgctctggtgccctgtccatgaatccttgccgcagccctgcaaggaaagagctggaggtgcctcctgtgtacaggttagagagccaagggccagatggttttgccgagtcgcccctgctagtgtgggggagcagcactttctgcttgtgaagccctgactggaaccacttggcctggagtctgggaggggcctcccttcccagcccttgtccttcctcccccgcccacaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcccgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggccccaggttgagcaataagaaaccagaaccttgcggcccagtggcccgggccagttcaggccgcctccccctcctctgcctggggccattgagcccagcctccagggcccgggtgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagcttcgggtgcttccttgtcttttccaggggcagcagtcctgggccatcctcccctggtgtctgagggggtgatgccagcagggacagagtggcaaggcagccggggcaaggtgaccaaccctgcccagtcctgctctgctgggcagtagctgccccctcctactaagagggccaggcctgtagggaaaagggtttctggggtgatgcccccttccctgagcaaggtgggagctgagcagttcacttggggtggggaggggggaaacagttgggaggatgttgatagctgaggcctaggctggcacccctcagccacagacggatgagtgggcacctgcagggccctcggcactgggtggcatcaagtaaacaagggtttctgggctttggagccagactggctccttgctagccccaaggacggtttaagtacagggaagccgggcctctgaagacaaagcagatagcctgtgacaaacatgcaactaagggtggggccagtcaggcccaggtgatgtcacagatgggggactgtttataccagcagagggaagggtgactgattagtgacccttcataaaagggtgcagacttgaggtgccatgggtagaggctgctccagcccctctggcagaaggcaggacagaaacaagttcctgagggtttcagggacccagttgtgtgctccgagcctagctggtgtggtggtgtctggtcctatgaccagcacttgaggtgccagtggatgcttcagttgctgcagggctggccggccctccctgcgtcactcagctgccacctgtgggcattcaccctgtgccaggtggagctgcgctgtcacgatctgaggaagttcatgttcccccatttcacagagggagagtccgagactgaggactgccgaaataacaaaggtggtagaagcagatgcaaaccaggccgtccaactccagcgtgctttccatcaggttactaatccaaagcacacactaagaggaaaaaacggtagatccccccaaccccacccttagactgcagctgtactcagggctgagagacccacattaaaggttaaatgctgtcactccagcctggggtcctgaaagcttggggcaggggtcacccaagggaggtggagcatttttgttcaagctgtgagcacattagagaaggcacagaacttagcagtgcccctgaactaggaggaagggaagtgctgcctggccgcccgctctccttcccggagcactccacctgcagggctctgtgtggccacagaggggctgtgaaccccctggggctgccccaggaagcgcctgctgatctgaggcttgaaaggggctgagggcaggtgtctgccccagagttcatagccctggtttcggttctacaggttggggatcatctttgggctccgaccggggttcagggaggaccagaggatgtggtcagagatgtggccgcccacctagagggctagtcccagccctcgcctcctccctagatccatagctggccatgaccctggggaagaagcctcctcttcagaggctggcctggggcaaaggaggggcattgccacccagctaccagagcccgtggactgaggccttcagggcaatctgtcgcccacgcagcacctcacagcccaggacccaagaggcaaagggcccgcccactgcctctggccatgcacagctgttttctatgttgcagttccttgtaagatctcattcagaataaacatttctggctgggtttggttcacacctataatcccagcactttgggagaccaaggttgggggtgaggtggggtcgtgtgaggccgggagttcaagaccagcctgggcaacatagtgagacccgcccccccccccgcccccacaccatctctaccaaaacaaaaattagccaagagtggtgatgggtgtctgtgggtagtcccagctacttgagaggctgaggtggaaggttcacttgagcctgggagtttgaggc

SEQ ID NO: 13683 - DNA, 13426 bp, Human
  misc_feature (1)...(13426): n = A,T,C or G
gaaaccgattttgaagcgtgcgccatatctctttgtgttctacaatcacttcgcggcgccccccatctatgggatcccgctcggtggggtggttcggccctacgatgctgctgaagtaggggcctccccggcccccggtttcatccctggcattccggggcgctcctgccttcattcccttcctcaacatctctgtcgggacccccctgtctcggtgggcgaaaaggcaacccctcctcctggtgttggctttgcagggccctggggtcaattcttcatatcctctctggaacgcctgcgtgtgccgggcttcattaccggcttcctaatcctgtgggaccctcacagggcccccgccttggtatcacgttccaaagcttcttactcgatctggggtctcannnnnnnnnnnnnnnnnnnnttgactcaagcgcggcatccggtccatccccagtggtgtaagaccggacgcggcgacggtgcggggcggcgctggccctgaggtaggcggcggtaagaggggccgcccgcggcccccggctcactccggcactccgggccgctcggcctccatgcctgcccgaccgcgctgccggagccccaggtccgggggcggatgggagcgctgccgcgggggtgggcgggcggggcgcgggggccatgtgcgagcgcggcagggaggcgggcggggcgggctgcaggcggggtccgactctggggccagtccgggccacggttgggacccagtcgagggtcggactggtcagggttcaggcgggatccggcgtccgagtcctggtgggccggcctggggcaggatctggctctggctgcgggtcctgactcgggtcagggttgggcctccgatccagcccgctccggggcagggttcaatcccgcatttgccgaagtccctggggctggccggggtggaagacggggagggctctatgtctgggaaggggctctgaagaccacgtgggggcgctcgaaggggcctggggccaccctcctctctgggtcaaaggtcatcgcaccggcaggggagaacttcctcctccttggctctccccacttacttcctgataacctggtagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgtgaaaagctctggaggtgttttcatgagtccgtgcctgtgcgtgtggatgtggggagacctagtgagagtgtgtgtgatcatgagccttgactgagttcgtggatggggtgtgcgctccaggagaagtgtgtgagcacaagtgtgagcaggagtgagcacgggtttgggaaggccggtgcaagtgtgaaagccctcagcagagagcgagcctgcgtgggcttgtggggctcctgagcaccccggtgagtggagtgtgtgaactcggtgtgagcacgtccactggccttgggtctgctctccaatgcagaatacccagatgagggcagggtctcagaggtccccccaacatctggagaaaactgggaagtatcctgctcctggctagggattccaggtggggttgaaggttgcctgggggctacggttaccctgctccctggcctgggtgggagtaggggctttctaagcctcccccaggttcccaagggggagacctgctgtcagttactggccctgaagactctgtttccatggcaacagctaggagggggcagtgttcctgggcagtccttccttggactctgccccccttcttccccacttgctgggcttggaagcctggccctaggcccgaggttgggcaacccgtgtggcagggtgtctcccatcccccataccagtgctttcctgcgaacctatgggtctctccgtgcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggtgagcccccagcccactcccctgtcctttgccctgcaccctctgggtacactgctgggtgcaataggccccctgatggctgtggcaccgcttgaggctaacaatctggtgtttccagtccctctacctcccagagacactctttccctgagaagtatggtaaaagcaccgggtgtgctgatgcattgcagtggatgtgagtgagttcagggtaccacctgggtactctaggcccagcaccttctacagtggctctgaaagagtccaaggcagcctctgtctgttcctaagctttgttcttgtttctggcagcttctgacctctccccagcatagaacatgtcccctttttgttaattttcccaaagcagcaccaacacaaggcagattttaatttttttttttttgagacagagtctcactctgttgttcaggctagagtgcagtggcacaatctctgctcactgcaacctttgcccctgggttcaagagattctcctgcctcagcctcctgagtagctgagactgcaggtgtgcaccaccacgcccagctaatttttgtatttttagtagagacgacgtttcaccatgtcggccaggctggtctggaattcctgaccacaaatgatccacctgcctcggcctcccaaaacaaggcagatttttatcagtacttgagaggggctacatcatagtttagcacccaactttaaaaagactaacaggcaaggccggacacagttgctcacacctgtaatcccagcactttgggaggccaaggtgggcggatcacctgaggtcaggagatcgagaccagcctggccagggtggtgaaaccgcatctctactaaaaatgcaaaaaattagctgggcatggtggctcgcgcctgtaatctcagctacttgctacttgagaggctgaggcaggagaattgcttgaacccaggaggcagaggttgcagtgagccaagatcacaccactgtactccagcctgggtgacagagcgagattccatctcaaaaaaaaaaaaaaaaggccgggcactgtggctcatgtaatcccagcactttgggaggccgaggcgggcggatcatgaggtcaggagattgagaacatcctggctaacacggtgaaacactgtctctactaaaaatacaaaaaattagctgggcatggtggcgggcgcctgtaatcccagctacttgggaggctgaggcaggagaatggcgtgaacccaggaggcggaggttgcagtgagccaagatcacgccactgcactccagcctgggcgacagagtgagactccgtctcaaaaaaaaaaaaaaaaaggctgggcgcggtggctcatgcctgtaatcccagcactttgggaggccgagacgggcggatcacctgaggtcaggagtttgagaccagcctgaccaatgtgatgaaaccccgtctctactgaaaatacaaaaattagccaagcatggtggcatgcgcctgtcatcccactcaagaggctgagacaggagaattgcttgaacctgggaggcagaggttgcaatgagcccagatcgcgccattgcactctagcctgcgcaacaaaagtgaaactccacctcaaaaaacaaaaacaaaaacaaaaacaaaaaaacccaaaaacgctgggcttggtggctcatggcctgtaatcccagcactttgggaggctgaggcagacggatcacgaggtcaggagttcgagaccagcctggccaacatggtaaaaccccgtctctactaaaaatacaaaaattagccgggcgtggtggtgagtgcctgtaatcccactacttgggaggctgaggcaggagaattgcttgaacccgggaggcagaggttgcagtgagctgagatcatgccacagcactctagtctgggcaacagaatgagacactctcatctcaaaaaaaaaaaaaaaaaggacttacaggcatgtctgctcttaaaagtcactaatttttttctcactcaggaaagcttatcagaatttgggggaatgagcaagatgctgacattaagcattgcctgggaagggcctattatttccgttatttctgcttttatgtaaccattggttactttgggggctataacacgtataattaaaaaaaaaaaaaaaaaggccaagtgtggtggctcacacctgtaatctcagcactttcggaggctaagatgggaggatcacaaggtcaggagttcgagaccagcctggccaacatggtgaaaccctgtctgtactagaaatacaaaaattagccaggtgtcgtggtgggtgcctgtagtcccagctactcaggaggctgaggcaggagaattgctggaacccaggaggcagaggttggagttagccaagatcgtgccactgcactcccagcctgggtgacagagtgagagttcgtatcaaaaaaaaaaaaaaaaaaaaaatcttgagtgcttaccttgtgctaggcactgtattcttttatgatctcagttagtccccacagcaaccctataaggtgtcagtactgttataactgaaactaagagaggcatttgaaactttgttgaagtctcacaactaggaaatggcagaaccaagatttgaacttgggtcagtataggtccagagctgagctcttcaatgttagactgcttcctctgcttattactaataacaccgaactttggacagacgctgaatgactgattgtgacattccagcacgtttttttttttttttttgagacagtctcgtgtggtcgcccaggctggagtgcagtggcacgatctcggctcactgcaagctccgcctcccgggttcacaccattctcctgcctcagcctcctgagtagctgggactacaggtgcccgccaccacgcctggctaattttttgtacttttagtagagacggggtttcagcgtgttagccaagatggtcttgatttcctgacctcgagatccacctgccttggactcccaaagtgctgggattacaggcgtgagccactgctcctggccaggtttttttttttttttttttttttttgagatggagttttgctcttgttgtccaggctggagtgcaacggcctgcagtcgtggttcactgcaacctctgcctcccgggttcaagccattcacctgcctcagcctcccaagtagctgggattacaggcgcctgccaccatgcccggctaatttttgtgtttttagtagggatggggtttcaccatgttggccaggctggcctcaaactcctgacctcaggcgatctgccctcctcgggcttccaaagtgctgggattataggtgtgagccactgcaccccgccaatccagcaagttttaacttggccaaaatccaccaatcttaaactttgtgcacccttcccgctctgaagaacagtgagccagccggccagggtgcgggtatctcctacctaccctggggcccctcactgtatgttgactattgacaaatatttattgtgtgctggctgtgaataggacttgtatattgagcacttaggtgtcatgaaccatgctggatgttttgaccatattatcccctttaattctcacgacccaactctgtggggcacttttacagctgggaaactgagggttcaaggggttaggtatgggacttgcccaaggtcataaaggtatgtggtagccagagtccctgttcggcacagacctgttctttgctgtcctggccagtgttccaggccttggggacatagctggggctgaagcagggctgtttctgccctcaggcagtttacatcctggcagaggggagagctgggcaacagtgagttgcacagacttgtcttattaccgctgtggtatgtgcaggaaggggaggtgctggttctgaggctccagagggcttgtcttttttttttttttttgagacggagtctcgctttgttgcccaggctagagtccagtggcgcgatctcggctcagtgcaagctccgcctcccgggttcaagcgattctcctgcctcagcctccccaatagctgggattacaggcgcatggcaccacgcacggctaattttggtatttttagtagagactgggtttcaccatgttagccaggatggtctcgatctcctgacctcgtgatccacccgcctcggcctcccaaagtgctgggattacgctcccggcctctttttttttttagacagagtctcactctgttgccaggctatagtacagtggcacgatctcagcttactgcaacctccgcctcccaggttcaagcgattgttctccctcagcctcccgagtagctgggactacaggcacacgcccagctaatttttgtatttttagtagagacagggtttcaccgtgttggtcaggctggtctcaaactcctcacctcgtgatctgcctgcctcggcctcccaaagtgctgggattataggcgtgagccactgcgcctggcctttttttttttttttttttttttttggtacagagtttcgctctggttgcccaggctggagtgcaatggcacgatcttggctcactgcagcctctgcctcccgggttcaagcgattctcctgcctcagcctccggagcagctgggattacagacatgcaccaccatgcccggctaatttttttttttcgagatggagtctcactgtgtcacccaggctggagtgcagtggcacaatctcggctcactgcaacctctgcctcccgggttcaagcgattctcctgcctcagcctcctgagtagctgggactacaggtgcctgccaccacacccagctaatttttgtacttttagtagagacggggttttaccatgttggccaggctggtcttgaacttctgacctcaggtgatccacccacctcggtctcccaaagtgctgggattacaggcgtgagccaccgtgcccggccgtggtgtcttgagctgagtgcagaagcgcaaatagggggtaggagaaaatgcaccgcgaggagaaatgtgctgcgggcctgctgtctagctgtgtcatttggtcgttgcggggccctgtgaggccgggagggctgccagcacccaccatgtgccaggcctcgttgctagtgctggggccagttcctgccccggtggagctgccactgaagggggaggcgtaataaacaagataggtgagtgcatatgcagcgtggtctgttgtgctgagggctgaagagaaaccagaagcagggctcagaggccaggaggactctgcaaagggatttggcattatcacagggtggccagggaagatcttcaaggtgacagtgagcagagggaggtgagggagcctgtgtggacttcaggactagagctccaggcagggcctgtttgaggaacatggaggaggcgagagcaaggagtagaggtcaaaaggaggcaagaagcaggggcgtaggcctaggaggacgtaggttcgctttggcttggactcagagaagggaaatccccagagggttttgagaagaggaggtacaggatgtaatggaggcttaataggaccctcttggctgctgagtcgagaacagactggagcaagcagggacagccaagcgaggggcgaggtgacagtgactatcaggtcaagggtggaagtagttgccaggggcaggaggcggattctggaccttggaggaggtaaagcccaccagaatgtgtcggtggcttggatgtggggtgtgagaggaaccagagattctgcctaggtttcttcttgggcaagtgaacacgtggagtccacgtaggctgtgttcggtccgagatgccttctagacatgcaggatgtcaaggaggcagctggagagatgggtctggagctcacagcaagtccaggctagaggtagaaacgtgagagccccacggctggggaagattgccatgggattggagatgagctccaaggacagccctggcagtctggatggaagagcttgggaagatgctcagaaaccacaaagtggctggtgcggtgggaggaaaaccagagtgtatgctgtcctagaagcaaaagaagaaagtgtttcagtgtttctaggagcaggaagtgatcaacagccttagatcctccttttaggccaagtaacatgaggactaagaattgaccactggatttagcaatgcagaggtccttgtggcccttgatgtcggcagatgagggcagtgtggtccagagatgaggcttggggctgagatgcagccccgctgcctggtccagctcctccctcatccaggcagggctcccccgcccagcagccactcccctccctgcctgctcatggccccctgctctccctttcctccccatacccccagacctgtgcttgcccggggagagtcagggctctcctgtcagctgggtcccctcccagccccgggaggccgccactggagccctgcctcttcctggcagggagcatcgagtacagctgtccggcctccaacgagtgtgagatcaccaagcggagacgcaaggcctgccaggcctgccgcttcaccaagtgcctgcgggtgggcatgctcaaggagggtgagcgctgggcaggggctgggcgagggctgggggagtcggggacccgggccaggtgggggtgaggcctgggagttctggtgagtggactcggggaggacagctctggagagcaagccccaccctgcccacagcaccacagtcacagtcctatctgtcccacaattcaaggagtgcgcctggaccgcgtccggggtgggcggcagaagtacaagcggcggccggaggtggacccactgcccttcccgggccccttccctgctgggcccctggcagtcgctggaggcccccggaagacaggtgagagcactgtgggtacctggggctacgaaaccggaggcctatgtgtggcatcatagttaccttgggcactgggacctgtatttccccttcgtctcttcactcactcatttccccaagacatgtgaaactgccttttcctgcatcaggaaaagtagtagaactgggaacagggacgattttccaacactcacagcctgtccacaaacacacgggctttccctgggagacagttagcgctcttccctggagggaagtcactggacagctgctactgaggaaggccacagggggagccactgtgggaagatgcttgacccctgaggcctgacagattcgagtgctcctgactcttgtcctctaattgtcacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggtaaagggcccaggtgacccggggctgccctgaacgggcccggctctggtgcgtttgctcagccaggcccgctccccgctgccccctaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcaggtgagtctggggcaggcactgacaggtgaggtgtctccgtaaggtcttcaggttaactcagtgacggtagcacagccccattttgcagataacgaaaactgaggcttagggaagaacaatgacttgctagaagtcaaaaagcaagccaagtgcaggctccaaactgcacacaggattttgagccctagtgccacactaatgcagaaaggtcatttagtgggagggaaggtggggagggtacaaggtggccacagttgagggagagagggtggggtcctggcccacgagccgcagcaatgagtggtgcctctcagtcagccaatcaacaaatcctcgtttggctcttccttaggccccatccagcagtgctcaagatacggggagtgcccttgccagagatagcccaggccaacaccacattcctctcttcttgcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttggctgtacagagactctattttaatgtatatttgctgcaaagagaaaccgcttttggttttaaacctttaatgagaaaaaaatatataataccgagctcaaaaacactgtgtttggtgtcattgggtcaagggttggggatacacacggcagaattcggaaacagggtatagatcaacaaaaatacacagtcataacaagaaaaactggcgcctggcacaatcaactctcagtttcctcttcactcagcagcatgttggggatcccgcggctgatggggaacatacgtccagattccgggcactgcagggtgccctctatcacttccacctgcgggcagggagggacagagctgagcactggcagcctcagtgcgggaggcaggtggcccgggaagcaagtgatgggccgcttctcacctccagcagcaggtggtgcatggtcctcagaaactcctcattctcctcatatccctcaaccggccctttcggcacctggatcagacgcaactgtgggcaagaggccaaaattatctccgggcatcccgaactcccgcctcagcccggctgaggtgtgcccgccccgcattccccgggatatgctggggcggggtaaggatcctcacgttatcggccgcctccaggaacgccgaccactccactttaggtatcatacgcgccacgaagttggggttgaattccacagggcagatacggacctcggtggcctgcagggcggaggagtttaggcaagcactggaccccggcccaccatcccgcccgaaaagggaagactgccgccggcgggtacctggaggcgcagggggaagccacgggaccccaccccccgcacatgcgagctcagcagattgtgggtaagcagtttcatgtcgccgcacaaactctcgccaggccggaaccggaaaaaggtcgtcctccgctgcctcacttccggggatgctccactcgatgctattggatagccaggagaaccggaagtggcgaacttgctggaacttctcgtgtttgtgggagctgaggtaggtaggtgaaagacctgtcgggtcacgcgccgctaccggaagcgtctcagcaggaggttcctacggcgcacgcccagcttttttttgccacaaattcttcgtaagatgcaaatcatatgcaaaatagctgcaatgcaggagctctcgttgaatgcaaaataaacacattttactcctacacaggcgcctaacaccgtcgtcctctgtatcccactttcggttaaggggcagaaataccgccctatctgtaaattaggcccatggaagccgagccgcacctcattcctatatgcaaattagctgctccagtgccgaaagctccgccccatttgtagttgcgtcggctgtccagcacccagtgcaaacgaggcgtgggtcccggaagctctgttctgcgggtggccgctcgcgcctgcgcagtggaggcggcccaggcccgccttccgcagggtgtcgccgctgtgccgctagcggtgccccgcctgctgcggtggcaccagccaggaggcggagtggaagtggccgtggggcgggtatgggactagctggcgtgtgcgccctgagacgctcagcgggctatatactcgtcggtggggccggcggtcagtctgcggcagcggcagcaagacggtgcagtgaaggagagtgggcgtctggcggggtccgcagtttcagcagagccgctgcagccatggccccaatcaaggtgaccgctggcccggccgggcctgacatcccccactacccccatggcaatccccgtcccgctagtctgagagtatcgccttatttcctgcctgccagacccctcccctccgcccgcccggctcatcccttcagaaggccctcgtggctgcccacctttct

SEQ ID NO: 13684 - DNA, 17086 bp, Human
cacactgacagtaccaataccaccaattttgtggacgtctggaggggcagaaccaagagcttgtgagttggtggtaggatgtgatctagagcttccgagcagcgtggttccacagcatcgccatctttacaggtgactttccatcccttgagccaaggcatgtgagctcttggctcccgcctgttgtgaccactccaaccagatattggcacaaatactactatgtcagagttgtagccaatttcttaatgtaggtgctgatttccttaatgatttctcccatctctcctttttttttttttttttttttagagatggagtctcactctgtcctctgtctcccaggctggagtgcagtggcacgatctcagctcactgcaacctctgcctcctggtttcaggcaattctctgcctcagcctcccaagtagctgggattacaggcacccgccaccatgcccagctaatttttgtatttttagtagagacggggtttcaccatcttggtcaggctggtcttgaactcctgacttcctaatccacccacctctgcctcccaaactgctgggattacaggcgtgagccaccacgcccggcccccatctctcctctttagggtggctcattgggatccattttgttaacaccaacaattagtttcacacccagcgtgtaagacagaagggtgtgctcacgcgtctgcccattcttggaattaccagcttcaaattcatcaacaccagcagcaacaatcaggacagcacaattagcctgaggtcaggtttttgataaagtctctgcatcctgggccattgaggatggtcacatagtacttgctggtctcaattgccagcagggaggtatcagtggtgataccactctcacgttcaactttcagcttacccaagacccaggtatgcttgaaggagccctttcccatctcagcagcttcctcaaaattgtcgatggttcttttgtggatcccaccacacttgtagatcagatggccagtagtgctggacttgcccaaatcagatgatgatgttgagctgagtcttttccctcccctgctccctttcttttgagatggagtctcactctgttgcccaggctggagtgcagtggtgtgattgcagctcactgcagcctcaacctcctgggctgaagccatcagccagctcagcccctggagtagctggaattacaggcgtgcgccaccacgcccagctaatttttgtatttttagtagaaacggggtttcaccatgttggccaggctggtcttgaactcctgacctcaagtgatccacctgcctccactgcccaaaatgctgggattacaggcgtgaaccaccgcgccaaacccccattttggctttgatttaacggtggttttcacgacacctgtgttctggcagcaaacccatcgcaaaaaagctccactgccctacacagattctattataaacatctccattctacagatgagaaactgaggctgagtagttaagggaaactcctacagctagtaagagtcgtgactcagagcccatgacaccatcctgcttctccaaccttctttgcttcctctactttccagaaaacatgaattagggaatcctgtggagggagacagggaaataatttgacgttgtcctgtacatactggacacaataagagttgggtggatgaacgaaagcagggatttaggaagcggggagaagtcgtttggaagtctgtgacaagggtttacgcttggatagggtgggcttgatcacccggcagaaatgagacgagtgatcccagccttcccaaccaatctttccagtgacctgggtttacgcttcaccacagagaaggaacttttcagacgctcccttggccgcgcacccgggatcggaacagcgctgtcacttgcgacaaaatccctaggccagaggaagaagagcgcaggcctgggcgaggcggcggcgggcggaggctgggccggaggggtggggacggcgaggaggtggaggccggcgctccgctccgctccagctcggtttcatgtcccgccaggcgaaggatgacttcctgcggcactacacagtgtcggaccccaggactcaccccaagggctacaccgagtacaaagtaaccgcgcaggtgaggtggggcccagcgcgtactttacccttttaactagaggggcgccgagttttaccttaaggaaaggcggtgcagccactgctccctttttagacgacagaaatgggtttcccctttaaggggaggttgcagtacgaggcttagtttacatctttaaccaccagggggcggggtcctgggtgggcgctgtcttttttaaaagggcgttgacggccgttcccggacaggcaaggcgtgtatgcccacgcccggagtgtagtgtctgggcatcaggctgtgaatttctctaaattaacatgaaaactctggtttaatccaaatattagtactccattctcgtagagtaagttttgtttattggtttgtttgatgttacataaactccctttaacgagtttaaccatttttaatttttcaaaaaataatactgatcagtggttgaaaaaaattgatgcagttcagaaggacttaaggagtaagtcgccatatcaaggtcacagcaggaagatagataggctagagttgatatatgaagcgataacaacatcataagcacaatttatagagagacatggaggaaaccatgacaataattaaaaatgaaacagtaaaacaggacacctgtagaatgataacaagaactggtaacaaggaaggtccccagggagaggaactgtgtcactggggacaggagttaggggaagactttttactgtaaattttttgtacttttagaattttcaaccaggcgactattaagctggtgcattagttaactctaaaagcaaagcaggcacataaggacacttccaaagtgatctaagtgcagaatcttagctatttaaaatatgctttccccaaatcgtttacgtcttttccatgcctaaaaataatgcaaataaggccgggctcagtggctcatgcctgtaaatcccagcactttgggaggctgaggcagcagattgcttgagctcaggagctcaagacgagcctgggcaacatagtgagaccccggatcaatattaaaatacagacacacacacaactttaaaaaaaaaaaaaaaaaaagcaaataaatagattgtccctgggaagatagactggaggtggggctggggtggggaggatgtggcaaggaactgtaaccttttattataagtcttcccagtggtggccgggcgcggtggctcacgcctgtaatcccagcactttgggaggccgaggcgggcggatcacgaggtcaggagatcgagaccatcctggctaccatggtgaaaccccatctctactaaaaatacaaaaacttacgggcgtggcagcgtgcacctgtagtcccaggtactcgggaggctgaggtagaagaatggagtgaacccgggaggtggagcttgcagtgagccgagattgtgccactgcactccagcctgggagacagagcgagactccgtctcaaaaatataaataaataaataaataaataaataaataaaaataagtcttcccagtggcttttttgtgtcgttgttttgttttgtttttgagacagagtctcactgtcgcccagactggagtgaagtgactcgatctcagctcactgcaaacttccgtcgcccgggttcagattctcccacctcaacctcccaggtagctgggactacaggcacgcgtcaccatgcccagctaatattcgtattttttggcagagatggggtttcaccatgttggccagaatggtctcgatctcttgacctcatgatccacccgccttggcctcccaaagtgctgggattacaggtgtgagccaccacacccggcctcccattggctttttaaaccaagcaacatgcattactttgatatatttttatacatattatataatacaatgtattatatataataaatataaaatataaagcacataatatataaatatatgtatgtatatattttttgagacggagtcttgctctgtcgcccaggctggagtacagtggtgtgatctcagctcactgtagcctccacctcctgggttcatgcagttctcctgcttcagcctcctgagtagctgggattataggcgtgtgccaccacacccggctactttttgtgtttttagtagagacgggatttcactgtgttggccaggctggtctcgaactcctgacctcaagttatcctcccacctcggccttcccaagtgctggaattacaggtgtgaaccaccgcgcctggcctatatttttattttattttattttatttgcgacggggtcttgctctgtcacccacgctggtgtgcagtggcatgattcacgtcttactgcagcctcaagttcctgcattcaatccatcctcttgcctcagcctcctgagtagctgggactacaagcatgtaccactacgcctagctcaatttttaaattttttgtagaggctgggcgtggtggcgcacgcctgtaatcccagcactttgggaggccaaggcgggtggatcatgaggtcaagagatcgagaccattctggccaacatggtgaaaccccgtctctactaaaagtacaaaacgtagctgggcatggtggcgctcacctgtagtcccagctactcgggaggctgaggcaggagaattgcttgaacccgggaggcagaggttgcagtgagccgagatcacaccactgcactccagcctggtgacagagtgagactccatctcaaaaaaaaatttttttttttgtagagacagagttttgccatgttgcccaggctggtctcaaactcctggcctcaagcaatcctcccattttggccttccaaagtgttaggattacaggccaccatgacccaccgtacctggcctataattttttttttttttttgagatggagtctcactgtgttgccaggctggagtgcagtggcatgatctcagctcactgcaacctctgcctcctgggttcaagtgattctcctgcctcagcctcctgagtagctgggactacaggcacttgccaccacgcctggctaatttttgtatttttagtagagacaggatttcaccatgttggttggccaggctggtctcgaactcctgacctcaagtgattctcccacctcggcctcccaaagtgctgggattacaggcatgagacaccacacctggccactcaatggcttttaaatagtttcttttaccagaatattttaggcaagtctctgttgtcaaaagcaaagtccagggttttagtcccagccatctttcttacttagtgtgtggtctactatggccacacctctcagagcctccatttcctcatctcttaagtgggcatgtcaattatgtctgcctcagtgggatctaggataagaaatagatgtttttatttatttatttagtgtgtgagagacagggtctcactctctccaggctggagtgcagtggtgcaatctcagctcactgcaacctctgcttaacatgctcaagtgatcctcccacctcagccttctaagtagctgggactacaggtgtgtcacgccaccacacccagctaattttttgtattttttgcagatactgggtgtcactatgttgcccaggctggcctcaaactcctggacttaagtgctctgcccacctgggccccctaaagtgctggcattacaggtgtgagccaccgtgcctggcataggagatgttattaaactgtcaagtaccccaaaccataggacattattttaaaattattatgaacataacgatgaaaactgaatcttgttttcacctcagacccaagtctgcccttccagggacttcaactccagtgatggtttcttctgtgtccagggcgctgaagcgcaggatcttctcccgcagggaaggaggttcctgaggcagaacctcccttctttggaggcttggggttctttggtttcagaagtagatggagggacttggtctgttcaaggaactgggataaaaattgggctgatggccgggtgctcacgcctgtaatcccagcactttgggaggctgaggcgggcggatcacttgaggtcatgagttccagaccagcttggccaacatggggaaaccccatctctactaaaaatacaaacattagcaggcgtggtggtgcatgtctgtagcttcttgggaggctgaggtaggaaaatcgcttgaaccctgaaggcagaggtggcagtgagccgagagtgtaccactgcactccagcctgggcgacagagcgagactccatctcaaaaaaaaaaaagttgggctgaggttggagcagtccaaatgggcctttaggggtcctcctatttgatagatggagaaactgaggtacatagtaggaaaagttgctaaaattacacgcgaaggcttaaagccagggtgccttgatgccagaggccaatggccaaaggctactgccccgtgagggggactaggaggcacctggggcattacagggtgagagggtgtcagatggcagtctctggtctcaaccagctcttgcctttctttctcagttcatctcaaagaaggacccagaggatgtcaaagaggtgaggctcctgggaggaagagggactgttctgcagttccagatctggaaactgtcaaggggcagctggtaactctgcttggacatcggccctccttcctccctgtccctgggtgaggggctgctgcagctgcttcctgatcctcacgccccctgggggcaggctaggcatgggggcggctgcctcccaccattgctggttctgggcaagtctcatgtccctcataggtggtggtctggaagcggtacagcgacttccgcaagctgcatggagacctggcctacacccaccgcaacctcttccgccgcctcgaggagttccctgctttcccccgggcccaggtgtttggtgagtgttagattggggcactcgggccaaagatggagggagcattgggcaaaaggggacctccgccagtgggggctggatagagagggcctgaaaccctgggcagagtcatgtttggaagggcccttagagatgacctcatttgacagatggggaaactgaggctcagagtagcctaacccttactgtgtatttcaccttttaacattcctgttgggccaggcgtgtggctcacgcctgtaatcctagcactttgggaggccaaggcaaaactccatctcaaaggaaaaaaaatcctgtctttatcagctccattttattttcctttttcttttttgttgttgttgacagcctcactttgtcacccaggctggagtacagtggcgctgtcttggctcactgcaacctccaccttccaggttcaagggattctcttgcatcagtctccccagtagctgggataacaggtgtgcaccaccacgcctggctaatttttgtatttttagtagagacagagtttcatcatattggccaggctggtcttgaactcctgacctcagctgacctgcccgccttggcttcccaaagtgctgggattacaggcgtgagacactgcacccggcccatctcaatacttagtatattgattacatgttgcaatgagaatatttgggatatattgggttaaataaaatattaaaattaacttgtggctaggtgtgatggctcacacctgtaatcccagcactttgggaggccgaggcaagcgaatcacgagatcaggagtttgagaccagcctggccaacgtggtgaaaccccgtccctactaaaaatacaaataattagctgagtgtagtggcaagtgcttgtaatctcagctactcaggaagctgaggaaggagaatcgcttgaacctgggaggcagaggttgcagtgagccaagagtgtgccattgcactccagcccaggcgacagagtgagactccgtctcaaaaaaaaaaaaaaaaaaaaaattgtttcttttttcctattatttaatctagctgctagaaaatttaaaattgcatatgtagctcatatctgtattagacagtgctgaccagttgcttgggtctgcatactcatgtgagatgttcttttttgttattggtttttgtttttgttttttgagacagagtctcactctgtcacccaggctggagtccagtggcatgatatcagctcactgcaaactctgcctcccaggtttgagcgattctcctgcctcagcctcccaaatagccaagtagccacccaagtagtgtgcgccaccacacctaatttttttttatttttagtagagacagggtttcaccatgttggccaggctggtctcgaactcctaacctcaagtgatccacctgcctcggcctcctaaaacgctgggattataggtgtgagccaccgcacctggccgagatgttcttttgaagcaaggtaaaggattgctgctgtcaggttatgccaggccagtggggaagtaccacagactggccgcacagtaactggaccagagttagcctgctctgcaaaatacctaggacagagcagtgaaactgtggctcgcacctgtaatctcagtgctttgggaagccaaggcaaggtaatcacttgagctcaggagttcaagaccagcctgggcaacatggtaaaaccccatctctacaaaaaatacaaaaattagccaggcatgattgtgtgcacctatagtcccagctacttgggaggctgaggcgggagggcggcttgatcccaggaggcagaggttgcagtgagctgagatcgtgccactgcacaccagcctgggtaacacagccagtccttttctcaaaaaataaacgggggctccttgctttgtgaccttgggcaagtcactttccctctctgagccttacttttctcattagatcaaagccatcagaaatgcttttgtttcttgttaactgcctagctccccctgggtaggatatgatattcacaagggcagagactggttcctcccctgttcaccttctgagtctagcatatagtaggtgctcagtaaacatctggcaaatgaatgaatagggaaattgatccctcctggaagcccctacctcaccccaggaggaaccagggcagattgctgggagaatgggtaggagggcagtgagttgctcagagcatctcaggcaggaccaggaaaagtggccttggggcagaaacccctgtgggtcaccgccactctcccctgttccttgtcctgggggccgtaggccggtttgaagcctcagtgatcgaggagcggcgaaagggggcagaggacctgcttcgcttcactgtgcacatacctgcgctcaacaacagcccccagctcaaggagttcttccgggtatgtgcaccttccaccttcccagaacttgggccacttacccacccaccagattgcaccccatgactccccatgtctgatctttctgtcctgcagggtggggaggtgacccgacccttggaggtgtccagggacctacacatcctgccaccccctctgatccccaccccgccccctgatgacccccggctatcccaactgctccctgcagaaaggaggggcctcgaggaattggaggtgccaggtacatcggggtgggaggagggaaccagggctggagggtgcagagtggggagggcggccacactccctcctcagtgatcttactgagaaatgtgtgtgtgtcccaggtctatcacttaactggctgaggaactttgggcaggtccttttccttctctgtgctacagtttcttgatctgtaaaatgagcacaaaccctaataacaggcttgtctatgcccatggttgctgcaagggtttaaggagagagtaattctattttgaaagctgagaaataaacgcaggtattcatgaccccacttatctcttcctcagtggaccccccaccatccagccctgcccaggaggccctggatctcctctttaactgtgagagcaccgaggaggcatctggttcccctgcccgaggccccctcaccgaggctgagcttgccctcttcgaccccttctccaaggaaggtaatgagctgggacagccgggaaggagccagggcaggacgtccttgggacagggaggagggcagagccccactagcctgctcagtgcctgcgcagatcagggagagacgtctcctcagcagtgctgccctgtgggccaatagcagcttcaatgagaattagaagccctgtgccagggcacgtggtgtggtgtgctggatgcacctgtgcaacaagtagccacgaggaaggaaaggaggcacttcccatgttggggccatctcactgagaaggctttggaaagagccgggtcacactgctctgggacattttagttccttccctgcaagctcttggtgggatttcctgactggccagggtctggctgcagatcctgaaggcaagaggcctgctggtcaatgggagtgagttctcagctcaaagggcagctgcaaagggaaatccctctgggggcctggagccactggcatttggggatgctggaggtagaagggcccccccaatggaggtcagggtcctgggcaccttcttgctgtgagatcctgggactcgacagtcccaagctctgagacactggagtttttcattctaaaatttgccaacgcctggcacattggctcacacctgtaatctcgacactttgggaggctgaggcaggaagattgcttgagcccaggaattcaagaccagcctgggcaatatagcaagagtccatgtctgttattctttttctttttttgagacagagtctcactttgtcgcccagtctggagtacagtggcgcaatctctgctcactgcaacctcccaggtccaagcgattctcctgcctcagcctcctgagtagctgcgactacaggcgcgcaccacggtgcctgctaattttgtatttttagtcgagatgggatttttccatgttggtcaggctggtctcaaactcccgacctcaggtggtgcgcccgcctcagcctctgaaagtgctgggattacggatgtgagccaccgcgcttggcccgtttttttttttgagatcgagtcttgctctggattgccgaggctggagtgcagtggcgcgatctcagctcactcccacctccgcctcccggattcaagcgattctcctgcctcagcctcctgagtggctgggactacaggcgcgcgccaccacgcctggctaatttttgtattttgagtagagacagggtcgcaccattttggtcaggctggtctcaaactcctgacactcaagtgatccacctgcctccgcctcccagagtgctgagattacgggcgtgagccaaaatgccctgcctctttcacttttcttgttctgcctcctcccgttcctgctcctgcctctccagggttggggagtgggaagaaggaatgggagggaaaggcaatgttggtgtcacagggctgttatgcctggcctctgggtggcaggcatccaagtgctctgtccttgtgccagctgagtccctgctgggcagctagctgcctgggcaggagcttttctattttttttcctctcctttttaatttttttatttttttttatttattttttgagacagagtctggctctgtcaccaggctagagggcagtggtgcgatcacggctcactgcagcctccaactcctaggcttaagcgatcctcccacctcagcctcccaaatagctgggacaggaccacaggcatgcaccatcatgcccagctaagtttttgattttttgtagagatgagatctcactatgttgcccaggctggtctcaagctcctggactcaagtagtcctcccacctcagcctcccaaagtgctggatcataggcatgagtgactgtgtccagccaggatcttttcaagacccttcacagacagctccaatgagacattcactcagcccatgggaaaagtccccaaagcctggaactgcagtgtgctcagacactgccttatttccctaccctgccatggtgggcacctccaacaagcctctcaccaccagaattctcgaggcaaggagtgggcacctgtgtctcccttcttcacagcaaactccttaactcgagtgtgcaggtgtcccaggtactcttctgctctctgctccctgagcaatacatggagggctgtaggcccagccaggaggtgccttctccctcctgcaggaggcccggacttctcagggctctcatggaactcacagggatggggttagagaggcacccactttttccctctccaggatgatagggtatcatgatgcttcctgcccccgcaccttcccctcagaggccttttcaccaaaggtgcaccagatttccagtcgcctcgtgtgtaagctgcaggtaggatgtccgacccccttttagccagtccagggggatataatgagcctttacctgggaaatgtgaggacacctgtcactcactgtctttacatttgggggcctcagctgaaactgcaaggcttcagaaaacccctgagattctctaagtctcctattctaagattattccaagtcttggagcatttctaccctcagcctggtggtggtggcctagcatccttcagggaaactttctggaggggatttttggatttctaggtcaactggagtcaagagggaaataggaccagtgacccagagcttacaaactagagtgtgtacctaaagacataattaggaaggtaaggctgtttttacagaagcacatgaaccctatcgatcaaatagctcatggctagtttttgatccacagacgacttctggattgctctggcattggtcccctctactggggacaggctgataccctgatggacaaaagaagtcttggggttgggcagagggcctgggaaaggaagggccagtctggtccgagtcctccctttctaactgcagaaggcgcagcccccagccccacccatgtggctgagctggcaacgatggaggtggagtctgcaaggctggaccaggaaccctgggagccaggagggcaggaggaggaagaggatggggaaggagggcccacccctgcctacctaagccaggccacagagctcatcacccaggccctgcgggatgagaaggcaggcgcttacgctgctgcactccagggctatcgagacggcgtgcacgtcttgcttcagggagtccccagtgagtagggactgagggtggagggtcaggcctgggtcccaggtggggcagtgatgaagggagcaaaaaaacaagcaaatcacggatcaggagcccttttactcctcactgaccagctgtgtaacctgggcagatttttgtttctgtttttttgttgttgttgtttttaacctcttgtggcctcagttttcttcttcctctttttttttttttttttttgagacagagtcttgctcttgttgcaggctggagtgcacaatctcggctcactgcaacctccgccccccaggttcaagtgattctactgcctcagcctcccgactagctgggattacaggcgcccaccaccatgcctggctaatttttgaatttttattttttatttatttttatttatttttttttattttttgagacagagtctcgctctgtcgcccaggctggagtgcagtggcacaatcttggctcactgcaacctccacctcccaggttcaagccattctcctgcctcagcctcctgagtagctgggattacaggcacgtgccaccacgcccagcgaatttttgtagttttagtagagatgggctttcaccatgttggtcaggctggtctcgaacccctgacctcgtgatccacccacctcggcctcccaaagtgctgggattacaggcgtgagccaccgcgcccagcatggcctcagttttcttatttgtagactgaggagaatggatgctgggccccagagaggagggaaaagcacatggtgatgctctgcgaattgtaaaggacccgaccaggggttctgaccaggccagtggtgcccaggtgcctcagctgagcattctctctccacaggtgacccgttgcctgcccgccaggaaggtgtgaagaagaaggcagctgagtacctgaagcgggcagaggagatcctgcgcctgcacctgtctcaactcccaccctaacagggagtgggccattccctgggactctcgctcctgcactgccagccccttctcctctccccagggcctggccctacctcctggtcttgtaattacaggagccatttctgtaggtaactggaccaagaatgagaaaaataatgaattcttagctccctgattacacctgccaccttggaatccaggactcacacttctgaccctgcctgtctttttggggtttttttgagttggagtctcgctgtgtcgcccagactggagtgcagtggtgggatcgcggctcactgcaacctccacctcccaggttcaagcagttctcctgtctcagcctccccagtagctgagattgcaggcacatgccaccacgcccagctaatattttgtattttcagtagggacggggttacaccatgttggccaggctggtctcgaactcctgacctcaagtgatccacccgcctcagtctcccaaagtgctgagattacaggcatgagtcactacgcccggcccatgtctgtctgtcttgatgtgtgagcagcagctgtggtcattaaaccattagtttacccctctagaactggggtctgcaaactcccacctgcagccaaatctggcccacctcctttttaatgtaagggctgtgagagtggtttttactttttttaatgattaaaaaaatcaaaataatattctgtgacaatgacaggtgaaatttatatgtgacaagtgaaaattatatgaaatttaagagtccataaataaaatttgttggaacacaaccaggctaattcatttagtattgtgatagctgctttcgcgctacactggcagttgaaacagttgcagagttgagtctttgccgcctgcaaatcccaaaacatttacaacctggccctttgcagaaaacatttgctggcccctgagctagaaaatagggagcatagtctccagggaaatagaggacaagccgatggagccggtttattgggtggaagggacgaaggagaggaacccaaagcccgggtacttgtctcagaggccccaaagccaaatcctgattgctcagcgggctggaaggcgtggcctcagccccgccccgccccgcctcaccacaaagcggttggttgcggcagggactacaccggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagccaggttcagccccgccccgacccgccgctccccacccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggtgagtcgggatcctggcggctgggcagagcgtggggacaggagcccaccatgacagtggaggtagggaaaggaaggattagctttaacatctcaccattagccccctcccaggacagcacaagatccaccgagccccgacgtgggacctcgggcccatctctgggtcttagttgtctcaggaataaaagtggagggggcaagggtggaaagggagaattggtctaaatagtgattttcaaacttttttttttttgagtctcgctctgtcgcccaggctggagtgcagtggcgcgatctcggctcactgcaacctccgcctccctgggtcaagcgattcttctgcctcagcctcctgagtagctgggatcacaggcgcgcgccaccacacccagctaatttttgtatttagtagagacgggggtttcaccatgttggtcaggctggtctcgaactcctgacctcgtgatccgcccaccttggcctcacaaagtgctgggattacaggcgtgagccaccgcgcccggctgattttcaaactcttttaacctccccgcccagtcagggttaccaagcaaacaagaacacatatgcccacgaatatacctgagacagaagtttaaggcattagagatactttctatgggcgatgcattccaataaactcttattatttgtttctttctttgtttttgagacagagtctagct

SEQ ID NO: 13685 - DNA, 87562 bp, Human
  misc_feature (1)...(87562): n = A,T,C or G
gtttgatttccttccactcattctgatcattctttcttttctatggacctaagtaacaagagaaaagcatgggctggagaaagagggtcttaggcagtctcatcaccctcaccttgctactgtgggaggcccccatccatgacgagaagggaaatgggagtagaggtgtagggtctctccgtttccacagtgtgcgctcccaaccccctgcccacccgcacgccttcacccttgtatcttttgaatgtctcttaaccctgtttgacagatgacgacgttgaggaccagagagatgaaatgacttgttagtgattccacaacccttattggtggtatggttgggactagccatttaattttagcactcctttgactaagtgcctaccatctttgagagccctggtgttaagcaaacctggagacagaactcaggagtcctgtctgagctcctccagctctggcctcctctagccctctgctgtcactgattctctctgagctcagggttttggcctttcagaccctttggcactgttggacctgcccaattcagccctctgtgggggggtcatcttacagaggaacagagtggggtccttagccggtaggcaggaccaagattgggctgcagggagaaactcatatagatatgaaatttgggatggatttaggtctggggaggtagaggccttggagtcttgcagggatgtggaattatggcaagaagtgtggggaaagaggaagtcccaaatggagagctaggagtaggaaccctggttggttcactcacatccttcttgcctctcagtgcctggttctatgggtgctggctgtggctcccctttgtcataagtgaaggccctcccaaaggatctcagaaagcccccctggaaagttccacagctcaagtattattctagttcaagtttggggatttgcaactggggttgaagtaagagcccatttagagacttttccccttcatcactgagttttctcatcctgaagccatcctgtggatctggcagtagggctgggtacctggaagccaggtgctgagtatataggttcactggagcggggagaggtggggtgaagattcgagctggcctggaacccagacatggtaacatgtgcccaccggggcatttggactgaggcctaagtgctgctgatgagtggggtggtagggagtgagaaataactcctgagaaagggcttgcccacatccaggctgagctccagggaggatctcctttgacttgcacagcccttttgtaggcacaatggtgggatgaagaacagacaggaattacaggaagcccctggaaatctctgggaagctccagggtctaactggcaaagaagtgggcaagggtgagcttccgagcactcactgtggtgaatgaagcaggtgtggatggcctcaaggtgtagtgagagcctcaaggacaggaaagaacagaagaggagcttgggatataaatctggagaagtttctggaggagggggtgtctgcgtcaggcttttgaacgagttgggaagtgtgaacttaacccagcataaagggtgtgagcaaaggtgcagagtggtggggagaatgtgcctcatggaggaggcaaggagaatgagcgagcagttgaaagggggaactgggggcctccagtgctgagggctggcctgtttgcctgctgtggggaaggagggatcctgcactcatggtgaggcctctgttcctctgcccagtctccccaccccaggcaaagagtggaagtcggtgatcatgaatctgatggggtctgtggggctgatcgccctcggtttgtcaagcggctccttccttagaggtcttgaaggcaagggagtccccagaaaagcctctcctcccctgtccgtgcaagcagcacctccaccctggagagggcccttcatcccctcaaggctggggagggactggctcggtaccccctgtgcctgactccccaattctgcttctccagtagggtccttactgttctccgaggggggggccgggagaggaggagccggcgatgtgcaccagccaacaaaaggtcagtgacccccatggtccccagagagcccagccctcatcctgctgcaggctaactgtgcttcctggggggaagccaagtcaacgcaggcacatccccttgtcctctctgaggcctgtgggaagtgatgggtctgctccccgagtgccattccaaaggccccattagctgccctgatgtgaagggccacaaacctccatttctttcgcaaagcccagttgttctgatgacttctttctagaacacaggtatctttttatgtggcagttgttcaggctgatccctaggaagtatctgtttctttgttaaggcaaccaggcagcacggcaaccccaatttaaccatcaaattctggaagcctgctaggtgcccagtccagggaaattctgattgggagctgtggccagcacagggcctttaagcctgcttgggggctctagctcctttttctgtactgaggctgcctttcttaagacaatctctttcctaagaagtttacaagccactataacaagtcctcaaggaactccagtgggtgccaagcactggggctatggagtcccatttccattctttagtctgctcttctgtttgcctggatttccgccatccttgtcctctccccaatgacttggtgtgtctctttcgtctgactcttgaaaaagcagccaggccatgcacactggaagtctccttgaacaccccaggtgaacctggtcacttccacactttgtccacacttccactagaaggctcatcacactgtatcataactgtcactttacctgtttgcttccccaactagaccaagctccttgaggccagggattggatatttttgttcctatgcccccggtgcttcacacagctcttggcacataagtagctgtgtgctcagcaaatttattttatatgagccaatgggctctgttactaaggggctgattgatgttctaacacctacaataaagtgtggtccatgcaaagtacatgaaaagtgcagactcttttcagaggagttaatttattcattgaggccaggcacggtggctcatgcctgtaatcccagcactatgagaggccgaggtgggaggatcacttgaggccaggagttcaaaaccagcctggcaacatggtgagactccattaaaaaaaaaaaaatcattgagaaagagagggagacacagagagaggcaggacactagcagaaagttaccaactggcatgagtcgtttatttgtgggatgctttatggttgaggaagctggaccccaccctttctctttctgaggtgcccacagcagcctgtgcagttcctgatgatcagctccattttccagacggggaagctgggacttagagcccagctttgtgaccagcgaaggtcacaaagctggtggtggagccagcactagcgcccaggtcttctttctcacatcacatttcctctccagggagcagtacaagatgttattaggcagtaagtgccaagtgagcagaacagacagctgtagagctcgagagtagggagggcggaggggggcgctggagaccttcccagaggaggtctgggagctgggcctggaaagaaggcagctgctttgtccctcatgcatggttctcagaaatgcaggaccacaacaactagtctctagccacattcactggggacacttgtagggctacagactccccaactgtgggagataaacgagcatcagctattatcttcctttctcggtccggagcaattaggggcggtaattgtgcaagcgctactgggagttgtagttcccagtcgcgccagaccggcgagataggggagagcgccccctggtgcttcagggcttgttcagcccagatcttgtttgtgctctgctgagcccctccgccgcccctacaggctcaccccagtagaatccctccaccagtcccttgaagtcatgctccgacctcccctactcaggttctctctctctctcctcaccatcttcgggttttctttccacacttgctcatctctttttctgtccctcttctcgaaggctttcaggttctctttggctgctcctcaggcctcttggcgtctctgggctgacccaggtctccggtggtaaagggactggagcccgtggaggcgcaggctccagagtagctagctttgccacccaccccaggagactggaggcagggctgaggagtcgagaaatggcctcgtttctccacttggccttggcagccactgtccagccccagacccgcctctttcctttttgctggcctcttgttctgtcccaatcacttactcacatggttgccttattcttttctttctttctgtttgactctctttaatgatactttctttgactgcagtgaaggtgagggagtgggaggaatggcttctgggtgggactagtacatgtggcaaaaccaaggtcaaacattcctttttctggtccttgagccccctggttctcctagtgcctgggcagcaggcttcgttgctatggaaacagcaaggccccagaaagccttggcttctgttccctagaggtccctgtccactttcgttgctggctctcttcccatctcctgtacctgttcccgcagggcttgctccttttctttatccagatagccgcgctcatcccttcttgctccctcacagccctgagccgtcttcatttcttgtctgtctctgcgatggttctccttttcctggctctgccccacctccctccttccctcctccttgccactcttccccgccttaccctcttgtctctgctggggtcctcacttttgctttctggccctccccgctggtaccataagtagacagaggaagggattcagactgtcccgatgttgcccaggcccccaccagccttgctgccctgtggcctcaggaaaccgggccttgccagctgcagtgagtgctgtgccaggctctggggcagcagctggtgccttggcatccggaggcagtgaggacagaggctgtgggcagcctgcctagagagagagaagcaggctgtgtgtggaggggaggggatctgcagaatctgcactccgaaactccccccccgccaccaccccactgcctcaacacatagcactgctgctgagccctgcctccaccaggggaaggcaagtgcttcctggtggccctggatgcaccctggcattgtgcctgttcttgcttgggcattgggagcatctattgagaattcctgcatttggttagctcggcctcttcataaagaccctcacggccagtgttgtttgccctgcacctgtccagtgaggtaggcagggccagctgtgtgccactgcttaatggccagaagtgagccactggtagagcccaggtcctctggtttgtcctgacttcatatccggttctcttctctctgcttgcactctggcttgtgctggtgttggacagaaacctcaacttcttggtactactgagtcattgtcttctcacttgttaccaacttacagaatgctgacaatccctcagcctctcccagtagtttttgcttctgcttaaaaagtgccagtggaagggccctgtgccgggtgcctatggacatacatgcacacacacagacatgcacacacacaaggcccaggcctgctcttgccctgttactctctgggcacacacaggtcacatccaggcactctttgccctccatcttgggcctgtctgcgccgtccttggcttggagtagggagctgggggtggagatgatagctggggctgtggccacccatgtgagctctgcctggtggcctgttgctatccggtgcatatccctgtcacctgcatcgccttcgtgtgtgtcttcctggccctccccacattcccccacctcccattctcctcatctgctccttgctgcacaacaggcctattggtcccatcccatatggtgaggctgaaactgtctccaggcactgagattggccatcgctggaggaggggcaggaagggaggtgggctgtgcgtaggagacccttgaggaccctgccatacgggaggagcacccagggagaagtaaggcagagcctcttatttcccttctatgtccctttgttaaggggagtggccgatgggaaggttggtggggaggagacagtgagcaccctccgctctgctgggtcctgtggcagagtaattgtcagctgtcagtgtgggagccacttagcagcctcctggtttggaaatggacacaggggacattgacttttgacagcagagacggcagggtcctgagaggatggttgacaggccgagggagggaaaggggcctaaagctacaggttgggacctctgggctcctggtgcccaggaccagtgcctgcgttgctggaggggagagggaagcactggtgtaccctgccccattcagccttctcccgtttccccacaccacggcatccaggcaaggaggagtttgtggcgaccttcaaaggcaatgagttcttctgctacgacctgtcacacaaccccatccagagcagcactgatgagatcacactggccttccgcaccctgcaacgcaacggcctgatgctgcatacaggcaagtcggccgactacgtcaacctgtccctcaagtctggggctgtctggctggtcatcaacctaggctcaggtgccttcgaggcccttgtggaacccgtcaatggcaagttcaacgacaacgcctggcacgacgtccgggtcacccgaaacctgcgccaggtaggaggagtgagaagaaggccagggattagctatacctggggtagaatgggggttgggagagggggctgccgggagcttgtggtggagggatcagggctgggcagtgaggtgtggttctggagaagaacaggagttggggctgtgagggtcccgacataaggctgcagtggctggcaggcttcagagaccagggagctgagctgaggaggctccagaactgtccctgggcaggaacctgagggcaggggaaggactgggctcagattgttgggagcagctgggctctcgagggatggggctaagaaatcaggtgatttagcaggagggcaattcaggagatgggaggagtgagccagtgcctgaatgggtgctcctgggtgccagggggtggggaggggttcctgtggagtgggcaggctttggcctggtggagcagatgagggtgtcccaacactagggcagcaaggcacgaaggcaagcctgagttaatgtgtgcgggcaggatgtgttctgcccccagccgaggcttttttagggcagaggcagagatggagccagtgaggtggtggcatagtaggtaggtgacagagagcaggagcagagagggggcttggcccttcatctcctctgggcaggacatgcccttcttttccttctctttctttcaaaggagccaggccctcccagcatccatggcttgctttctgcctccccttggctcctgggcaagcccacgcaggtgctcagagtccttcctgcattggctcctgcagacaggagctcctgttcccagatgctcccactggacaggtcctcttagaagtggtcctcttcacctttcccaaggcccaggatggctagtgcaggtgaagctgtctctgaccagtctcttcctagttatcttctctgaacttcctggttctagcggtgtggtggctaactttccttgtctctcctcctgtcatcctccttctcctccccttcctcccactgaaagcctcgtcagcaggctcaggatcttggctggcctcccactcttcctacctgttctcatttcacaccatcgatgatgatctagtggggatacctctcattaatgccactcctccttgccaggagaacgcagtgactaatcctgctgcttttcctcaggcctgccactacctgttgcagccgggctcctactaatgtgcctattcttagggacccctgcgtttcacagagtgacgtgcttggtggagtcactccttaatgcggggctcctcttcttgtcaaatcatccctttacccaatcagagggctgtcccgcgttgtcattaccgagcacatctgagtgtgtcatgtgcatttgtgacagtttcagatgccacacacattttattggggggtatagaggagttgcctctagtgcttcctgctcactttgctctctctaggaccagcgctgtcacctggtaccgacttcggcaagatgctccaagttcagagttcctatccatgcatcatatgaccaaaaaatacatggcacatccatactgggaacagagggggaaaaaaagacatggtccctgcccttccaggacttcagctcttgaggagacaggatgagtctgttaaaagtgaatagagcaaagccatgccagtgccaagtgagcagcagaaaccttaaacaccctaggactcaagtgatacccaagacgagggagaggtctgtggctaggggaggtgggaaagccacacagaggaggagacactcggcctcagcagtgctgagtgtagacagtgaccctcggctgcttcttcctggggttcccggagtcgagagtccaagctggtaactgatggaaacttcttcccctggattgttctaccagaagtctcagagcagagaggcaggtcatattgaccctaaagcaggtcctgaggtccacagagggtgtctgcttaaagactttggttgagtgctctctttaaaaagggattctgggggaatttcttttcttttctttttttttttttttttgagacggagtctcactctgttgcccaagctggagtgcagcggcgtgatctcggctcactccaacctctgtctcccaggttatagtgattctcctacctcagcctcccgcgtagctgggattacaggtgcccgctaccacacccagctaatttctgtatttttagtagagatggggtttcaccatattggccaggctggtcttgaactcctgacctcaaatgatcctcctgccttggcctcccaaaatgctgggattacaggtgttagccaccacacctggcctcaatcaagtttctgtagtgtctgggtgacatcctgggattggaacaacacttacatgataaaaagggtgatgatgggtggagtggtttgaatcaatattctgtcttccccaggttttgtgggccaggagcaaggacagggagaaatgacatctgtcttcagctttacaggatagagtgccaggatctgagaacactgtggcttccaggttatttttctcatttgattagaatggccagggagatggccttctggggaggacctctctgagaaccagcactgaggggtctccattccctttgcttctgcagccatgggagtgggtcaaaggccagctccaaagactggaaggaggcagaatttccctttttcccttggacttggtaattatccctggaatcatctagaggctctcagaacatagcagttaggaccaggggcacctgatgagacagtgtctccttctctcctctctctcctttcaaatccagcccttgaggtcactgtgaccggaggtgtctcttggaggatcttggcaggaattattacctctgaggattccccgaggtctattttaaatcctgggcccactctcctcccatacccagtatgcttcccaactgcctcccaccaccatgcaagcagtgtgcaaacccatttcctcattagccagcaccaaatttggaagacaagctggctatcgaaatatcacatggtgcttcctcctgcccagcttggataactgctctcattggtgcagaggctttcaggagctcctccaggtcccaaaaatggagtccccaaggatgcagtcctcaaggatggagtccctcaaagatgcggtccgcaaggatggagtccctcaaagatgtggtccccgaggatggagtccccaaggatggagtctcctaaggatgcattctcctagggatggagtccccaaggatggagtcccctaaagatgcagtccccaagaatagagtctgccaaggatggagtcccctaaagatgcagtccccaagaatagagtctgccaaggatggagtccccaagaatggagtcccccaatgatggagtccccagagatggagtccccaataatgggggactgccccaggggcagagtcctctaaagatgcagtcctcaaggatggaatctgccaaggatggagtccccaaggatggaatacccaaagatggaatccccaagaatggagtccccaaggttggagtccaccaaggatgcagtcctcaaggatggagtccagcaagagtgtagccccccaaagatggagttcccaagcatgcagtccccaaggatggagtcattaaggatggggagacccctgggagtcttgggatgcattccttaggaacgcattcccctaaggatggagtccccaggggtggagtccatcaggcaattagattcctttcctctccttcctgcccaggcctctctccctctctggcatggtgtacaccctgtctcagggtctgctatgctgttctccatactcatccgtgccaattttcttagtttttccctttgttttcacagttctcctacagataccacttagttgccctcctttctttctggtgatatcctagatctgaggtttgagtcagaaagaccaggttcaaatcccagctctgccaatagtttgagtgcttttaggcaagttatacaacctctgtgagcttcagctcctcatcagtaaagtgagaatgagtcttttgatgactaactggggtattgccttaaaacactcaacacagtgcctggcacgaattagttgtatttttttcaatccttcaggcccagcttaaatgccaccttcttcaaaaagccttccttgatcccttcctccagccagccttccttctttgctatgttctttgagcccttggaaacgtgtatttgagccgtctcatcacattctgcctgtgttgtcaatatttgtattcattccttatctgtacttctaggtggtaagcaaattggttgcttaatacctgcaactattgagtgtttgtagttgttttcctagtagtttttttctgatccatttggtctctttcctgaaggcagctggtaaggttttggacacgaggacccatgtccaaaagtagcagatctaactacttcatgtgagcactgaactacttcttgtcctcttggaaaaaaaaccctccaattcacaattcactttttttttttttactttttttttttttttttggagatagagtctcactttgtctctcaggttggagtgcagtggcgcagtctcagctcactgcaatctctgcctcccaggttcaagtgattctcctgcctcagcctcctgagtagctgggattacaggttcctgccaccatgcccggctaatttttgtatttttagtagagacggggtttcaccatgttggccaggctggtcttgaactgttgacctcaagtgatccacctacctcagcctcccaaagtgctgggattacaggcgtgagccactgtgcctgagcctaattcactttacaagaccagaagaacacctctcctggtccttcctctaaatttcctcaggactttatctttctgtcacagcgtttctcagattgcactgtaacgtctctccccactagcccctggcctcaaggatctcatttctctttactatctcacctaatttttatgacaactctgtgaggtggagatattattcccattttactgatgagaaaaacaagatgcagaaggttaaagaacttgctcaaggttatccagttaggaagtggtagagttgaaagtctgattttgaaaccactctgttcctctgcctccaagtgagggcctggttgttgtcattggtgcaaaatgcaaaggaggctggggtttgtcctgtgcttctgtcgttcttggatgttctcaaattttgaagccatttcaatgttctgcttgtatgtctgaaaaatgggtccctcttatgtgcaagtggagtgggttcctcttctctttgtcctgagcttctcttactcaaggtccacagattgtcttcaccccagatttttatgatttgtgtaaatattccctctcttggctttcttgagcagggctggagctacactcatatttcaaggtggagatggggtatagttttgtcccgaggctctcctttctgcctggtgaattcctacagttggtgtttgagtcagaaagacttggtaaaaatgaccacatgatatgatgtgtgacttctcccctctgtgactctgatgcccttctcattcatcatgtgttgtcatgcttgtgctcccaggctccaggagctctctagctctttctatgagtgggataaagcctttgttgctcatctgttagtctgaagcctcagttctccagatcctggccatagggaaggcctgggctgctgtgtaccccttccctgtgctgtgtcccaggccaccaggaatgggttccagtggaagctgcattctagtatttcacaacaattgcccccataaacatgatctccattggactgggtctggatccttaatccctaggtctagaggggccccatctcatctactccaaccctgctatttttaagaggtagcctggatctcttgtcaaattagtggaaggcccaagggttagaactcacatctgtttcttctcaatcctgattctttttttttttgagacagagtctcgctctgtcacccaggctggagtgcagtggtgtgatcttggctcactgcaagctccgcctcctgggttcacgccattctcctgcctcagcctcccaagtagctgggactacgggcgcccgccaccacgcctggctaattttttgtatttttagtagagatggggtttcaccgtgttagccaggatggtctcaatctcctgacctcatgatccgcctgcctcggcctcccaaagtgctgggattacaggtgtgacccaccacgcctggccctcaatcctgattcttaatttgctgttctacttcttaaaaatggaatcttgttcataaagttgaaaacttttgaatcttattttattctccataaccagttctaactcaaagagtagtaattggatttttacctccaatgcctttttcttcctgccttgttcgactagtgcagtgataccagacaacacttaccgttctgggcctggttgtttagctggcctgaagctaattgttccttgttctgactagttggcctcttcatttcatgacagtcctaccagccaccagtactaatcctcttaccacacgctatcccctgactcccatcactgcacctgcaattagactcttctcttgctatgtaaactgcttctgcatcactaataattaatattggttattcagcacttcttccggctgctaaatattgaattctgttatttttaattatatgaggcccttattcatcatcttactgaattagtcctgtgcccactggttataacagctctctaactaatggatctgtccctagaatacctctccttctcacaatcacactctcgggggtgcagtttagtatttaacaggcatcaagcaataatgtccctccatctctaatactcttaattaaagctgcctcagtgcctctgacatgtcctccccaaagacaggggtaatttggaaggtggttgttgctgctgtctgtggcaatgagaagagaaaatgaacttagaaccacatgagagtggggacactagagattggagtagaaagattgggcttatagcttagggaaaagtcagggattttagaggttcctttttatgggtgtaggggagtgaatttctggtgctggctgtgggaagtggagactcaggggtttatgggtgtacatgaaaggaggctgtgctgctgggatggccttaccaattctagagactggtaggggtggtggtggtgggcacttgattctgggagggacagcagcccagagagtgagagaatggggttggggtgattgaagagcctggagaacttttggggaaagttctgaaaattcaaggtggacacgtgggaggagtcagctatgggtgggagatggggaggagagggaagagggtctggaataatttgatataatgtgtgagccatctgccagtccgtggagggcaacatttccttttccctgttctggtggcgactcactctctcttcctttcttaaggatgagaagaaaacaaaaacaaaaacaaaaacagaggagctgcccctctcctcagtgactccctggatcgatttgcgtgttctccatccccaggaaaagcaggcatccatgacccctcctatgctccttgggaaccccttccttttgcctccaaatgaaattggctctcattcttgccagtcctttgattctctaggggttatgcccactcttctcccagcctgatagccagctggcccatcaccaactggttaatccattaacccggcatggccactggtcagccagttggccagcaccaacttgctctttagccagttctctggaaagccatctggttgatcagttagccaacaaacccataagtccatggctccaaccaatagcccatccctcctcacagcccttgttccctcccttccttcccctccactctctaacatttcagctgataggacttactaatactgcataattgggtctgcttcttaatcccctgccttccctctctcaccctctgttggaaaaccccgttgccgactctgtgtgtgttactaacacgcttataacccaggggaccaagggatgggcagggacaggtggggcaaggtatgagtgaaaaaccgaactaacctttctgtctcatctgcggaatgtcagccatctttaagtctttggtttcttggtccagttcttttgttgttttcttctctactaaccaaggtctctaactgttccccttctctgcagacggctcttcttcggggaggggatggtggggaagaggaatccagaggaggggcggggtagggatggggagaagaaaggacttaatttttctgtgtgttttatttctcctccccccattataatttaattttctttaaacaaatacttttgctgaacctaaggtgggagggttggaacaaacaaccaaatatatatggatatatattttttcctcgttccttgagtttcacagttggtcattttatttttcttttcttttcattctgttcttttgttgttgtgtttgttgttgttttttgacacccccctcctccccatccccccatatctccggtgaagcacgcagggattggacacgctatggtaaacaaactgcattatctggtagatatcactctaattgtcttaccgtttggtttgccgtgggtttttttaactgttcgattctccctcttttgtttcctctccctgtttggttttttggttgttttgctcttccaattgttttttgcgtcctggacaatctttagattttgcttctcttttagtttccctctttcccttttctttcttttttggtccaaactgaaatacaaaagacaaatggaaatcgaggaatttggcttgtccctgctgtaatccctaactcctgaattcagattcctggccagagagacctgggggcaggccccatgttcatcggctctggttagaccagccccgatgccaggctgcttatttctattgctttattttgttcttttccctcccctcccttgttttttctctttgatttagtttcttggtctcctgaaaatccatggaaaacaccatcccatgacatgctatgctctgctcactgtcagctccctggacagggccgctcaagtttgaggaggggtctgggggtgagacctccagtggcagccagtggggtgggttcccaggggtggagggcatggccttgggagatgcggagctgcctgagatcagtccagacctcatgcaaatcatcagttcatagcagtttgggggctgccccatgctggctgctctgggaaaggtgccatcccctccctcacttctcagccttgagggttcctggttccatgtcccccacattttgcatggcatgaatggtcttttcccctgaccagggatagcgtccagttcccccaactgctccgctgctctgactaacactgtgtttcacactgtcttccttcccgtcaccccctgccctctctgcccgctgcctgccccgcatggcctctgacaggggctggtttccttccctgttgaggggagcgagaggaggaggcctgcaggggtgggaaggggcagcattggttgtccttgtcaccgagctcctctgtttgggttaggctcagtcctggtgagtgttggtgtgggtgtctgtgtaaatgcagctggtgtgtgttggtgtgtgggtgtgactgtgtgtaaatgttggcgtgacatttcggggtgttagtgggaagctgtactgtgtgtgcgaggctctgctggtgactctccacgtgtgagctggtgtgagctgggggctgcgtgactatgtgggtttttgagcctggtgaggactctgtgtggaggtggactgtggagactggcccttcagttgcagtgccatggcagtcaggaacagggaaggagctggggctagccctttgctccttgccttgcctcagagtgtgtgtgcgcaggccctgctgcgtgtgatcccctgggattccctcgtgcctgcccagtcctggctctgcagcagcagccggttagtcatcgcctattaataatgcagagtgactgaacaccaggctggggaccctgcagatggacgtgtctgctcccgtggggcagctgcctggcctgcccagcctcccaggtttgtatggctggctggtgaggagggaagcgtgacagttggggctcccaatctgagtgtctctcccacttccctaggaggctctacctctgaggctacatctggcttttcctgatacttttgcagatccatgttttcctgcacccatatagactagtgcccatggccaaagccattccagccctccccaatttaagacctcaggtggccactcccagtggtcttggtgttccaatggggcatacagtgccaggtttcttgttcctccagctgctgcttctaggagttagctgctacctgcccggctcaggccaagccattgagtacctgtcaggagctggccaattggaactttctttacggtgcttcactagataaccaacctgtgactttagggacagaagggaggcaagatcaagccatgtggtacaccccaagcctctggggaataccatcctagaattaggacccagcagactttccatctagcctcaatttggttaaaaattgaccacatgggctgagtctactaaagctcagttcccttatctaccaaatgggctaatagtggtaatatacctgcattgcctactacatggggtcagtgtgaagatcaggtagagtaatagaagtgaaaacatttgtactctgtaaaggaaattgtaatgttactaagctttataaaatgttaactggttatctcagtgtttccagggcagggatgttttgtaaagaaatgattctcttccctagcaaaccctggagaacacagcatctctggcccactggagatcctattaccatctcttcttaagaatcagtcccaaaataactgtatgaaaccctagaatgcttcaggaattgggctggagaagaggaagaaaaatgaatgacttgattaaattggttaagaagcaacaaccagctaggcacctgtaatcccagctacttgaggctgaggtggttaagctggttaagaagcaaacaacctgctgggctcatgcctgtaatcccagcactttgggaggctgaagtgggtggatcacctgagtccaggagttcaaggccagcctggccaacatggtgaaaccctgtctctactaaaaatacaaaaaaatagctgggtgtggtggtggccatctgtaatcccagctactcgggaggctaaggcaggaggattgcttgaacctgggaagcggaggttgcagtgagctgagattacgcctctgcactccagcctgggcaacaagagtgaaactccatctccaaacaaaacaaaacaaacaaaaaaaggaagaagccaacaaccagctatgcaccagtaatttcagctactcaaggctgagatgggaagagtgcatgagcccaggagttcaagactagcctgggtgacatggcaagacctccccaccgcctgctttttttttttttttttggagacagagtcttgctgtgttgcctaggctggagtgaagtggcgcgatctcggctcactgcaacctctgcctccagggttaaagcaattcttatgcctcagcctcctgagtagcttagactacaggtgcatgccaccactcctggctaattttttgtattttagtagagacagggtttcaccgtgttgccaggctggtctcgaactgctgagctcaggcattccacccaccttggcttcccaaagtgttaggattacaggcatgagccatcgtgccccagcaaggcaccatctctaaaacaaacaaacaaacaaacaccctatctctaaaacaaacacacacacacacacaaacaaaacaaaaaaaagtaaacaatactgtcttgtttcagtcctggaaaggaaagtatctgctaaattctgagtctctaaagtctgcactttcctgcatgagcaatactgactgataaacagacctggttgccttttggtggcctcatagaccttcataaatctgtactaggaatcagctctttcagccaagaccagagtcagaggccttgtaacagggttcaatgtgttctgattcccagggcatcccccagacaggttttggttagtttccaatttatttttactaactcatttatatggactattttcatgttgtttgagcacttcttcttgggggagagggtggatataaagcaaaaaggccaaccttgagaaggttgagaagttcggattaggtgtgatcaggctgatggagtttgcttgtacaaataatgatagttctttgtacacacactgggactctttgaatagctttccccttttgaatatcatttaaacttgaatgcctggactgcaagtagcaggcagagattgtttccagttaacagatggggaaagctgaagcccagagaaagcaccttgcctagggtcagatagccagatatcgaggagtttcacttcagttttctcatttggtgctcagagtaagcctggaagaaatgggagcgacagttgttaaactcctgtcacagatgagagtcagaggtaaaatgggattgttctggaaaaggataaaggctgaatgagagcccaggatttctgacctctttcctctctattcccaaactatcaaatccagacctcaggattcatgacagggctgtgcctgctggttcagtccatcttcatggtgtgtctttccaacccgagtctctggttagcttctgccctctcattgaacaggtagctaacccaaacccttagcaggacttgcagtaccttactcagcctggagaccctttcttcctctttgtctttgtcccttatttccacccactcaatcctaaggggatgccaggacctttcccctagactagttgctcttaaccacctttggctcatggatacctttgagaatttgatgacagcaatggactctcacaggaaaaaaacccacggaggcagttttgcacacaatatcaaggggcttggaatctcccaagctcagccagcttgcccacaagttaaaaatacccgccctccgtcttgttctccccagattaagtccccctcccaaggaggttagtgaccctgtgatcatcacaggcaactgataaaggctccagaagatggcagaaggatacttcccctcttcctcagcctttcttcctaaggcatgtggacatggagtgcccaccaatgtggagttatttatggccaggacttagtttcatatcctgcacagcctgccacaggggaggtgcatggagcagaaagagaggtggggtcagcagggagggctgagagcccacccaagtcacaggctgccccttgtgtccacctccagccagcctctctgctcctggggagtacagtgggggctgggcagtgggctcctgctgcctctgcaccctctcccttctctggctggacacaactcttccagggcagaagctctggctcattccccttggccagctcagtacccactcggcctgcttgtctgtgttgagtgggttggcatgggttgggtgcagacactctgctgtgtctcagtgatgctgtttggaaggagagagctggaaggtcccactgccctgggtaggatgtggtatgtacgcaggtgtgtctcggggttggtgatcggtggcgaatgggtggtggaatgagtgttgggtcgcctgctgttgaggaaggtagagtcaaatgtcttttctctttatttttcaacccataagtgtctctgtcctagtggtcactcctctctctttacccccatcatcggaaggaagctctccctacctgcaccccacagctctgttgcctccatctctgctcctcccagtgcccctgccccgcacgccttcttacctggctgcctttctctggcctgtcctgctgggtctagccctcactctgctcctctaacctgcatgtgtccagctgcagtggctgttctgtgtcgcacggccccctcccttccctcctcccccaccggccccaccccttccagaagatgcgtgggggggaggttggggggcaggggcatcatgaacccctggggtggagggggaccgggggaattattcccctgtttcctgcttttactaacgaacctgccatttttgtgtctggactttgattcgtctgagggaacagtcgggttttactaatctaagtcatctccctccttgccttccccagagaccttcctccattccctctacccttggcttcctttccacccagaacccgtccccactatctccctctactccccacctctggctgatccctttcctcagggcacttccttatgttgtccttcctcctgctactccacccctgggtcataagagggtgattaaggcagccctttccgggtagggagcacatgggagtgatctgcaaaaagcccaagggggtaaggtgagattgtgcccagtcaggagggaaactgaggagggtgtttcctcttctctaccccacactgtcacctcttctaagtctgagagtgcaaagggagggtgactttggcaaagggagtgggatagagagagcccatagggtgagggagatggccagtggctggtgccctggcttctgaggccagtgagggaggacacagctgaggggctcaggtgggctgaaggccaaaagaggagattctcttcctggggagctttgggaccagaagagccctttccctgcgctgaagcaggagtgcacttgagtttctgtcaccaaagtcacaggctccttaggtattaggttcatagatggggatgcaggcagtgtggccctgggtcataaggcgatctttaatgactgtgtgctgtatcccctggattatgttcagattagtggggttacagggacatgtcaggctggtgcctgcccctcaggagctgaccagttggggtgaccagacttaggcacaggaagtaatcagcagcccagttcctggtccctcagtgcagcatcaggcagagtggaggtggagggctggatggagctgaatttgccccagggaggcccattcagcctattacccactccctgtcttatccctgacctttcatcccagttccttcttccctttctccagcccttctctgccaggtctaatctcgtttgcatgtttttgtgactaatactttgacccttccctcttctacccagacccctacttcccagccttagggtggggtggagggaagaagaaataaacgataatgaccagccctcccctcaaataagactcaaaagctttcagactgcccctttccacaaagacacccccttaccttctgctcttgaacctagttaccccagcacaaggtttgatggttcccaggaggtggagagtggggcttagctctaccctattcactgcgaggctccagccaagcacaagggggacttggggtcctgggagggcaggaagctcccttaccccagttctgctcatgtccctttggagttcctccacctcacccaccgagaccatggacccctggagaccagtcgctggaagatggctggtggcatgtgcatatagactggtgtgggtgaggagggcataggatgtgactggaaggccccaatctctagactgttcccgaaagagaaatggggtgagctgtggcctgcagaagcacagtgttgggctaaccctgagccagcttcctgttgaccctgcagagctctgccttctttcccagctgacccttccaaaccactgccttcctagagtaggggctcgtggtctcatagcccttggcccttctcccacaacctttctgggtgtcttgaaccttgtgggctgcttgtagagttagattttttggagaaggtgggcatttgcctggggagactgggagagttggagagtttcctgtccttgtcatgccccgccccatctaagattacttctgcattctccaggccaccgctgagcccccctgcctcctggaataccaagtactcccccattcctgctcatcctgctttcttactgaactttcagcccaggggcaaggtattcattaagttagccctgtccccgtctgttccctaagctggccctgactccctggagtaactctagtggtgtcagtagacaaggcaattagacaggaagaaggaagagtgggttgatgtagctaaagggctcccctctcctttggaggcaagagagtgacctgaatataaggagacctgaggagtgaagagacagactcaggaaagggctagaagtgcaaacctggagattgggctgcaggggtggaaatcaaccccaataggcaaccccagaaagtttcaagacttcccaggaatatttgagttcctgctcctcacactgctatcttccatctccctactgggtccagactgaaagactttccagcacccagcagagagggctgcaggtgagtctaagccaccaaggtctggggaacaccattctctggcacacttttgaaagaagttctggagttacgtgtgtgtccagagagtaccttcaggagaagaaaagtgaggatgccatttgcacccatcctgtgccccagaatgggggatccgtcctggagcccccattcctgttcagagtgccctccaggaactacttcttgggggacctcatggggagctctccaagtacccttcaggctcctgcctgctgagttgggggccagagggcaggtcttagcccaccctgaaaccatcaaatcttgtgctgcctccttttcctcatttcctctcttcccccactgttcctcctccaagacaagcagacataaaaatgggggtccccctcccctgctgccctctggcccctcctttgcctagccgtagctcttcctagggatttgatgttggttgtctcctgtctttctccctccctcctgggctggacaggtgaccatctcggtggacgggatcctgaccaccacaggctacacgcaggaggattacaccatgctgggctctgatgacttcttctacattgggggcagccccaacacagctgacctgccgggctcgcccgtcagcaacaacttcatgggctgcctcaaggacgtgagtagggctagggaggggctgcaggctgttcaggagccctttgtctcctgtcttcagcgtgacttagtctgacctggctagttgtctgggtcatctgttccttccaagtccatggtgggagacaccccctctttaaaacctaaggcccactgactccatcaagaggcttctcccctttgatttccttgagccttggaaacccctatcctcatagaggaccctcaaaggcagctgtggtacagaggaaagaatgctgggtatgaagactaaagaccttgcttgagtcccaactcttccactcattggttctgtgactgtggtcaagtcacttgactgtctgatgctgagtttcctcctctgtggatgggtagtcagtgcctacttcataaggttgtgaggggcacatgagagtgtaagtgaacatacttcattgagtggaaaacagctaccacacgtcagtggccttgtcattattatgaactgcaatttagtgggcactgagaacccacaggcaagccaccatgctcctgctgggccagaagacaggacagaggacgggcaagggaggtgcttgttcacagcctctgtgtctgaagctgtagaacagaggcctaagcgggtggtctggtggaactgagcaggggctacaggggtgggtggctgggtcccctggtgctcgctgctgggtgggagtggccaggccctaagctgctttcggattctttatccctgaccccacccctccctgcaggtggtctataagaacaatgacttcaaattggaactatcccgcctggcaaaggaaggggaccccaagatgaagctgcagggggacttgtcattccgctgtgaggatgtggctgccctggaccctgtgacctttgagagtcccgaggcctttgtggcgctgccccgctggagcgctaagcgcactggctccatctccctagacttccgcaccaccgagcccaatgggctgctgctcttcagccagggccggcgggctgggggtggagctggcagccacagctctgctcagcgggccgactactttgccatggagctattggacggccacctctatcttctgctggacatgggatctgggggcatcaagctgcgggcatccagccgcaaggtcaatgatggcgagtggtgtcacgtggacttccagagggatgggcgaaaaggtcaggaggcctctggacccttccccttccatgggccacccctttccatctgccctgacatcctctccgtctctcttcagcgggtctcttctacaccatttcctatattcttccctgccgcttctcctccacccccctcacgtcttcccaattgtcctttctgtcatcggacattggcagaaagagcacagcatttggcatcagtcagacctggattacacctcagctcccctacttgctgcatgtgagactctgtttccttatctgtagaaggaataaccccacaagggccatcgagaggagaaaataagagcacatctgtggaagcattagcacagtggccaacatagagtagataccccattcacctttaagaatatatcttccggccgggtgcgatgcctcatgcctgtaatcccagcactttgggaggcggaggtgggcagatcaggaggtcaggagatcgagaccatcctggctaacacggcgaaaccccatctctactaaaaatacaaaaaattagctgggtgtggtggcgggcacctgtagtcccagctacttggaaggctgaggcaggagaatggcgtgaacctgggaggcggagcttgcagtgagcctagattgtgccacttcactccagcttgagcgacagagcgagactctgtctcagagaaaaaagaatatatcttcccagccatgcctcccttctgtctagagccattcaacttaaaaaaaaattaactcactaggccgggcgctgtggctcacgcctgtaattccagcactttgggaggccgaagtgggtggatcatttgaggtcaggagtttgagaccagactggccaacatggtgaaacccagtctctactaaaaatacaaaaattagctgggcatggtggtgcactcctgtagtcccagctacttgggaggctgaggcaggagaatcgcttgaacccaggaggcagaggttgcagtgagctgagatcctgccattgcactccagcctgggcgacagaggaagactgtcaaaaaaaaaaaaaaaaaaaattaactcactcagcagttactgagcacccactgtgtgccagatggtgtccaaggttctgtagatatggacagcagggaaactaaagagacgatcttggctgtcacagaacccctgttctggtgtggggtgggagaccatggagtgaaaaagacagtaaacagccccacacccctacctagcagtgagggctctagaacaataaagtgtcagggcagagggttctggggtcagacagatgcctgttcttgaatcttctgttgcttctagccactctcttctttacccttcatttcagtcttttgcattctcttcttgttttctgtctgctaattctctctcctttactcttctccatcttgttgaacatgagagaattatccaagaaagggaaattgatataaatgagaactgacacattatccaatttaagcacttatcaacgtcagctaaatttttgtgctcctccgcctgtcactgagctgggcctgtgagtttgggtggagtgaccgctcctccccatgcaggaaggaggggcccctgtggctctgggagagtgacagtttctaatgggcttgctatttctttagcttccatccttgaagtgttgcctcccccgggctttacattaaatggtttcatccccggggtgtgtctcaggacagcaccaggaattcttcccagagccctctgccccacagggtttctaccaggtggtcagtaacactctaggttggacgtctgcccaagccttgcagggcactgcagggcttccacttctctgtgctttcaggaagtgctcctgttagctcaacaccgatctctggagccagagtctggaccaggtgtggccagtctttggattcctgtcttgaccaattctggacatttctgacggcccatttctttctttctttttttttttttgagatggagtcttgctctgtcgccaggctggagtgcagtggcgcgatctcggctcactgcaacctttgcctcccgggttcaagcaattctcctgcctcagcctcccgagtagctgggactacaggcgagtgccaccacgcccagctaagttttgtacttttagtagagatgggggtttaccatgttggccagaatggtctcgaactcttgacctcatgatccgcccgccttggcctcccaaagtgttgggattacaggcgtgagccaccgcgcccggcctttttttttttgagacgaagtctctctctgtcgcccaggctggagtgcagtggcgtgatctcagctcactgcaacctccgcctcctgggttcaagcgattctcctgcctcagcctcccgagtagctgggattataggggcatgccaccacacctggctaatttttgtatttttagtggagacggggtttcactgtgttgaccaggctggtctcgaactcctgaccttgtgattcacccgcctcggcctcccaaagtgatgggattacaggcgtgagccacggcgcccggcctctgatgacccatttcctatgtgcacacaaacacagacttggggcagctattccgagaaaactctcttagatcttttccatttttttttctatttttgtttttgcaattgtggtaaatgatacataataaaatttactaccctttcctgcagatcacatgggacagagaaagaaatgaaaaataaaacagcaaaaaaaatttaccatagtaacctttttttttttttttttgacacggagtttcgctctcgttgcctaggctggagcgcagtggcgcaatctcggctcactgcaacctctgcctcctgggttcaagtgattttcctgcctcagccttccaagttctgggattataggcatgtgccaccatgcccagctaattttttttttttttaactagagacagggtttcaccatgttgatcaggctggtcttgaactcctgacctcaagtgatccatttgccttggcctcccaaagtgctgggattacaggcgtgagccaccatgcccagcccatcataaccatttttaagtatgcagttcagtgatgttaagtacacttatattgttgtgtaaatatcactggtaactattgtttatctccagaacttttctcatcttcccaaaatgaaactctggcccattaaacactaactccctattccctctcctcttagcccttggcactcaccattctactttctgtgtaagaatctggctactctcggtacctccgttaagtggaatcatataatatttgtccctttgtatctggctttatttcattttgcataatgtcttctaggttcgttcatgttgtagcatgtgtcaggatgtccttcctttttagggctgaataatattccattgcctggatatacacgttgcatttatccatctatctgttggtggatgcttgggttgttcttttccatgtgttgagtgatcttggtgtagaggcctgtactcactatggcttcctcttgttgaccctccattatacaccccttccccatctctttccttctctctctcttccttctccaacatttggttcatttgtagagagtctggttgagtcgtgtaaagcccaggaggtcctgcagtgggtgggcagagcaggcatgggggaatctggctataaatagaggtgtgggtaatcaggcaggccatgtttggtggcctgttaggggagtgggcccccagccctgggaagtgggtttagagtcaggaccatgggtcatctgacaccttgtatggagagaaaagctagggaccatgttactaaaagagggcacagctctggttcaggtgaggttttttttttttttttgagtcagagttttgctcttgtcgcccaggctgccaggctggagtgtagtggcatgatctcagctcactgcaacctctgcctcccaggtttaagcgattcttttgcctcagcctcttgagtagctgggattgcagatgcccaccatgcccggctaatttttgtatttttagtagagatggggtttcaccatgttggccaggctggtctcaaactcctgacctcaggcgatcctcctgcctcagcctcccaaagtgctgggattacacgtgtgagccattgcgcccggcctcaggtgaggttttgagcagagaggaacacgtcctgaatgaggggatgtgtctgtagaggaggtcccagttcttccctcttgggttcccaccctgtgctcacattgattctcctcccaaagctccctgccaaattcaggcctcatgcagacccaaaccctccttaacctctctttaaccccatgaagttaggcagagtcttttttttttctaactaggatgtctgcaatggggtcttgcgtgaggagagagattgaactcaactcccaccctgaccccttttatttatttatttatttttttttttgagacagaatctcgctctgtcgcccagactggagtgcagtggcacgatcttggctcactgcaagctctgcctcccgggttcacaccattctcctgccttagcctcctgagtatctgggactacaggcgcccgccaccacgcccagctaattttttgtctttgttagtagagacagggtttcaccgtgttagccaggatggtctcgatctcctgaccttgtgatccacccgcctcggcctcccaaagtgctgggattacaggcgtgggccactgtgcccggccccgaccccttttaaacagttcttccaaacttgaaaaaggacagaggaaggaatttaaaaatacaagtagaataaaatttctaaggtataggtttctgcagcttaaggtctcagtaaaggctatggaactcctaccagatcccaagtcttttttctaagataatcacctcctcctccttcctcctcctcctcctcttccttttcttcttctccttcttctcccttcttctcttcttcttttttgagatggagtctcgctgtgtctcccaggctggagtgcagtggcatgatcttggctcactgcagcctctgcctcccgggttcaagtgattctcctgccttagtctcccgagtagctgggactacaggtttgtgccaacacacccggctaatttttttttttttttttttagtagagatggagtttcaccatgttggccagactggtcttgaactcctgacctcaagtgatccatccgcctcggcctcccaaagtgctgggattacaggcgtgaaccaccatgcccggccaagcaccctctacttctgaagaactcttctacctaaaaattctgtgcctacctcctttctcctcactgctgtcctgccccgcaggccctggagccaatctgcttgtgcaccttgctggccgcagagtgggctcttggctgaggggtggagagtgcaggctctgagttcttgctgctgggaccatactttggctgtgttccttccccactgtggcgctttggcactgttccccagtctctgcaagcctcgtctaccatttcaaaatgggatcataaaggactgatttcgtagagttattatgagacttaagtgatataatatatttaaagtgctaggtgcctggcatctagtcataaaagctcaataaatgtttgtggggggaagaaactcctttggattaaagatctttcagccccttctgttccttgaggttctctgcttccggttcccagtctaaggaactggctggcaggaatgacccagtgaatgatccaaccctttccgagctcaagatttcggcatgcccacttcctgcctatcctctgaggacttgctgaggtggggaggaggggtatggacagaggcccacagcattctgcagctgggctggggctgcgtcacagaagcctctgagcctgggggcctttgtcaagcagtttttgcagtgagtgaggccgagcttccagcccaggactgctgctcgtcctcctgagcctgctgcagggcacaaggtggaggggcccacacaaggtggggggccttcttggcagagtcaggatgtccctttctggcctgtggcttttctccatcctgccttcccttgattcccaggctccatctcagtgaatagtcgcagcacgccgttcttggccactggagacagcgagattctggacctggagagtgagctgtacctgggcggtctccctgaggggggccgggtggacctgcccctgcccccagaggtgtggacagcagcactccgggcaggctacgtgggctgtgtgcgggacctcttcatagatgggcgtagccgagacctccggggcctggctgaggctcagggggctgtgggcgttgcccccttttgctcccgggagacgctgaagcagtgtgcatctgccccctgtcgcaatgggggcgtctgtcgagaaggctggaaccgcttcatctgtgactgcatcgggaccggctttcttgggcgggtctgtgagagaggtgaggctggtcttcatcctaggtgtccctgctccctatccctgtgctcctccttctcagggtgactcctactttccatccctgtgccacctcctcctaggggaacccctcatagacctgccctaggcttttcgcccttgtaatgattctctggtcttctccctcccctggcctctgcctgtcttctccttccctcttccccaactcctgtgggcagaggccacggtcctgagctacgatggctccatgtacatgaagatcatgctgcctaacgccatgcacacggaggcagaggatgtgtccctgcgtttcatgtcccagcgggcctacggactcatgatggccaccacttccagggagtctgccgacaccctacgcctggagctggatggggggcagatgaagctcactgtcaacctcggtaaccaccctgccctgtgcttcctgacccctcacctggccttgtctctgacccacacctgcctctgtctggagaagctggtggtggcaccagcaagaggtgccctcagcagagtttggaggtggggaggtgccagcctgggtcagagaccctgagagctctgtccctggtgaggacgcacagtgtagggcgacattccatgctcgacgacactgtgaggggcaagacccagagtatctggggtatgctaactgtcctccctggtgactcatgtggatcttggtagcatctgtcctgcacacacacagatgacacagctcatttttggtcaatggctcatccacttgctcattcattggttcattcatttgagaagcacttgctgacgcctagtgggtgctaagcctgagctcagtgtggtggcagatacagagatgaggaaggcctggtccatgcacgcagctgccccccactgctctgctcagtctaaacagcagtctgtgtgttggtgtgtggaggtgcatgtgtgtacactggacacacagacgtgccatcttcccgtttctagtgccatgagctttcacatttgagcctcatggctgtcctgtgaagacactagatcaccaaacaagcattactgtccctgttttatagattatgaaattcatgtattgacttgttcaacattacaaaactagtgaaggcagagggaggagccaggactcaacctgggccatttgccttaaaattcagtgcttttcccattgcctcggacagggctgctgaccctccccctcaggccactcatgctgactcatgtctccacccatgcccagggttgagagcaggccttgactccacttcacctggtggtccccggggtgtccatgagggccagaccatgagcctgttaggttcttctcacgggcttcagctctcctagtcagggcaaaaagaaaacagcaggttcactcattcagctatttatgggacaccatataaatgctaggtatgttcaagccaggggctacagcagtgaataagcagtccccacccctttggagctttcagagcaggggaaccctgggaatgagaggtcctaagctgttcaggctgaggtcaaatctgtccatttcagactggcctctagaagcttataaaggtgtagcaccagccgtataggaagcttgcaggtcatcagggtcacttgttgtatcctggacctagaggggaagcagggctcttctgagcaggttagaatcctcgactggagagaatacagagctttgaccattttttttgttttttgagatggagtctcgctctttcacccaggtgggagtgcagtggcgtgatctgggctcactgcaacctctgcctcccgggttcatgtgattctctgcctcagcctcccgagtagctgggattacaggcacccgccaccacgcctggctaatttttgtatttttagtagagatggggtttcaccatcttggccacgctggtcttgatctcctggcctcgtgatccacccgcctcggcctcccaaagtgctgggattacaggcatgagccactgtgcctggctgaactttgaacttttaaatactcatctggagtctcatcctaacattggtctccggggcatttgtgggacagactgtggcctttgggggacccattgccttgtaaatgtatttatactatgttctttccttttccccttttggccacctggcctttgtattcctaggacaaagatttgctgagagaggtggggactggaggtggggagatatgcaggtggccagggcctcagagttgtttgaagggttcccctcagctctgtttctaaccacgatcacagcctgtagagcgggtggtgtgcagcagctctgcaggggaaagcaggctgggagacactctagtcaatgctccacaagtctgcacaatgctcccttgcatccctgaaactgtcacaagaggatagccccagccaaggaccccataagtggctctgtacttccaagtctgcccagatttgtgtatccagtgtgagttcccccctactttgcctgggcatatgtgtgttgtctgcatctaaacacatgtctctgtgcttgctggggacacagcaggaaaaatctggggccttggatctgcagggaaggcagatgcattttgcttatttggactgtcctaggcccctgggaagaagattgtgtctcttaagattagacaggaaacaatgtccttggtcaggaaaacctatcctgtgggcccttgggacccaccctctcctctccatgggcacacttttctgtctgtgccacataagtgctcagaagtcagataacaaggtggcctcttggaagacacatcatgttaagaataggcttcccagactgacagataacaggactctcctcccacccatttcttactcctggctgtgcccctgcccccatctgtagacatgtgtgtgctgagatgccatctctagcatgactcctgacaatctgtgaccaaaggcttggtgcaaatgcatccgtctacagattcctcctctgtaggcactgtggacacgcaggtggcccctacccagccaccaagccttgggttgggatgggaagagttctgggctccgggccagaagacctggggcctaactttggtatcttttactgttgggtaagtcatttcccatctctgagtctctctctcttttttttaatctttaaaatggagataagaatcttcactctgcctacgtctgtggtggttttgaggctcagatggaagaatgggaatgaaaccattgaaaccattgtgtagatgcaagacccatagtagagacccacccagccttcttgaaggaaaacaaaaccatattggaatagagacttgagtttggagccaggcctgggggccacttccacatagcatggacagactggagttgtcctctactaggtgtgcccatggggtcccagctgtcagtgcagctgatgggaaaagtgcagtgtaaagaatctctgaaccacaaggcgtcacctccttcagcctcctggcccacgtgaatcacttcaagagccccattcctgtcccccatttcttgctccccaggacttgcagggcctcacagaccggcagcaacaccaaggccccaggcctgggctggactcactactggggaagagagagaagcctggtgaggcttggtctctggcctcatgatcttatcctgtagagggaagctattgctccaggaggcagctctgcagctccacaggcactcagtggattgaaacaggccccaggctgggcctgaagagggagcggaggctgcgggtgaccactaggtgggatcgcttagtgctagcctcaagagatgggatatttgctagataagagagggacaaaaaggcactgctgcctctttccaggcagaggatcctaaggaacttatcgtgcctcctgctgcagcttcccagcccccactatgtttgcaaacactgagcaagttccttgagctctgctgtctgcagcccctgagttggggagttgatctctgtccctagaggatggtagagtcccctggattctttgccctatcccagcatggcctgggcccctccctggaggggaggagaggacaggccaggctgggcactgtcctctactaggtgtgcccctggggtcccagctgtcagtgcagctgacctgaagggtgtggtgtaattaaagaatctctgagctgcaagggggttacctccttcagcatccctccccaccccatgaatcacccatacactccctaccagtgggaggccttctacctcccacctccaagatccattctgatcattgagtggttctttcttagtgtcaccctgcccttctgaaattcccacttattgtgaaattcccacttattgtgaaattcccgttagttctgccccctggaatcaaacggagaaatctaactcccgtttgtgttttaaatcaggctaaatacacattgtatcccaaagccctttaatccctggggccatgggagggtacattgcctttccacctgaggctgatcagtaattatcaggggggctgctgggagccagctctgaaggagggctatgacagagtgcatgctgccactctgtgatgtcacttctgagacagatgcctgggagccttgggcccactgtctccaacccacagggcctgggcggggaaggaacccaggtgaggcagggctgggaagccagtgttctttcccctgagttcctttccatgcagactgctttgtcttacctccccaacacgtgttcatactacgaccctgctctctctgtccagccagggccttcgtgggtctgtgccacgaagaccactcacttctgcctattccctgcacttgaggcacaggtcactagttaacaggttactagttagtgccccctgaactttggtgaatgtgtatgttgaagaggctgggtttctcctgctcactctcagtctctggctttcttctggatggggctggcttccctctgggtgcccatcttcaagtcgtttgctcttgcaaaccctactggagcctgtgtttctgagggtggagtctctgcaggggtgggcctggagctgacacctcttctctggacagatggaccccccattcctggtgctcccttgctggggaaggagaagaatcaagctccttctttgggtcttttccccagtaggggacctgcttgcccatccagcctccccttttttctttttttggacccttcattggtgaagactctgctggccccgagagagcccccgtgacctgactccagggcctggcacccttctaccctcaccctaacagtcctccccttcctcttctgtccagcctcccctgtcccctctgtgcagccgctccttcctctgctccgttttcttcctcttttctctctgcactctctctacctcattcctctcactgagacttctcacttccctctgtgtctgccttttgacctttttctgctcctctgctcctcccttggtgccaggctgtggcccagggtcctggctgctcgcctccactcttctgctgcggttgacaacgcgtgtggagctcagctgtactgccgaagggccgtggccctcaaagccacaggggcatcagtttacctccactgcaggaaccttcaggggcccaggggatgcagctgcccaccccctttgcttcctgggctgtggggtaggcagagcctatttggggtggagcgacaggaggccagggtattgggcctgtcaatcgagggccgggagactgcccctctctgaaaggcaaagccaacccagtgtctacctgctgcctacttcctgctcaggatcctactgttatccattccctcagctcacatggagggaagctgaggcatggagagaagtgctttgcccagggtcacacagtgagttagtgagtgttagggtggagatgaggacccagctcccttgcttcccagtaaaggatttctgcagctccagccagtcccctcccttgggctgcgtcaggcttggcgtttgatggagtggtgcagacatcctaaaggccttaaatctggacttcataggaccctggtccactgttccctctgcaagacctgactggctcccacctttgggtggtgtgtctaaccagagggatggccagaggcttcagggccctgggctgctggctctgtgtagccacacggggccttcccagtcctgaaatcagaggatagcaatgccaggaccggactggggcaggggcaggaaactttgcttatggtggctgcttgtccccaactgctttgtgttctcagagaaatcatattttgggggctgcactgtctctatctgtgaggccttggctcctctgactaggaaagcaggttaatactaggtcctcttcagggtgaaggactcccatgatctatccccagtagcagcctggcatttcccaggattggaaagggtggaaggaaggttcctgtaggggtggtactagccactggggctttgggaggtgtatggcctcgggaagggggccctggggcagacccctccatttagctcagagcccagaggggaacagggagtgacaagtcacacctgggctctgaggagggagtcgtcccagagcaggggatgcagggattctggctctccccacccatctccctcccagagacaggggagatgtggggttggtcaagccctcggcccccattgatcccctgtacgactgggattcccaaggtgcccgtctccctcagacactagaggcctggtaccctctaagaagggggccacaagccctcttcccatcatctgactgccctgccttccagctctggggagggttggagccctcttgggggcaggagggacaggggtccaactgaggaagggaagagggcacctgggcacgcgtggtccccggaaagtggccctggggggaaccccgcccgcagacacccctccctgtgaaggatgtaaaaaaaaaaaaaacttgttttacctttttgtctccccttcccctctgcccgccccatggcccccccagactgcctgcgcgtcggctgcgcacccagtaagtggcttccctcttcttctgcagagacccaaggggactgggatgctggacgctgggatttagggagggaggctgggaggaagagaagccgtgattgctggctcgaatgggggttgggccttgagtgtggggaggggtgcaggcaggagggtgaggttgggtggttgtggaaggcaggagggaccaaatgaagcagagccaaggagagctgggggagggcctgcagtcaggatgttcactgggtctaggaagggagagacaaggacaccctttacccaagtcagcaggagggtggggaggaggtagaaatcaagggctggggcagagtcttgggtagcacctgtggtcctatggactggcagggaggagcctgagaggggctggaatacgctgctgcatctccagaattggccacaagggggaaggcgagggatgcgggaaagaggatgagggtgggaagggagccctcttcagctcctgtgttagctggggtgagtttctgccaaatgggggctccttctatggtgacagtgagggctctcagcaggggtgagatggagagtgagcaggtggacatctccagacatcccagtgcgcctgggctcaatgctgtgtctcagggtgtttctgcatggtgtggcttggggtcacatgggggagcacatgcacgtggtaggcccaggcagagagactgtgtgtgctgggcgccctgctcttcatgtgtgtgtggcatgctgtgtgcgtgctggagccctcggggtgggggggcagggatgaccagggagtgctgcaaagtccagcagcatttgaaagataagtatgttttgttttagactctggaagctgataatcctggtcttgagtaaatggccatagttcctaagaaacagaaccttcccctctctggccatcctgcatatttatgggcagtacgtgtggtggcgtgacttggtgtgtgacgttaaccaggcatgtgtatgtagaaaggtcccatcgggtcccattgtagatggaggagctggtgtctgtgtaacagaggccgaagctgtgggctcgcatttacatttgggtactgtgtgaagttttgaaagttttaggtctgtgtttacaccctgggaatatagcttctggccacactcactgaaggcccttaggaatctgggggaagagtatgttggtcataggtgtgggtgtctgtgtgcagggcctcagggtacaactccagaggcaccattcacttaatattctatgtgcatggcacctcctaaagtcacacaaagggcagtcctgagagtggatgtatgactggggtataaaagctctgcgtgtgcatggactccaggtgtgatgggaggctataagtgtgtgtacttgtattcatgggtgtgttgcgtggccaaatatgagccactggtcatgtatgtgttcatgtgtggcatgtgcggggatggggaggctgtctgtgtatccaaggtgatataggaagtcacctatgagcatgtataggtgccctcctcattccccccttggtgccgcaggtaaaggccccgaaacgctgtttgcggggcacaagctcaatgacaatgagtggcacacggtgagggtggtccggcgtggcaagagcctgcagctgtctgtggacaacgtgactgtggagggtaggtggtctgggcccagggaggtggacacatctccagtgacctatgcttggccctgttctacttggtgactactgcctgggctgccattcctagggcagtgttctggcaagctgcctctgccatttctccttcaggggtggaatgttatgggcatctggaccccaggaacgatttcaactccctgtaggcagcattcccctggcagcctgttggctcttgactggcgagtcctgccactcctcttggagctgtgctggctgctagtgcctagccgaggacatctctaaagatgtcactcatgggtggccctcctgtggaggggaggctcctgggaacccaagccccagccctgccccaaagccatccccctcatcttggtctcctgtcctgagcaggacagatggcaggagcccatatgcggctggagttccacaacattgagacgggcatcatgacggagcggcggtttatctccgtggtgccctccaacttcatcgggcatctgagtgggctcgtgttcaatggccagccctacatggaccagtgcaaggatggtgacatcacctactgtgagctcaatgctcgctttggcctgcgtgccattgtggccgatcccgtcaccttcaagagtcgcagcagctacctggcactcgccacgctccaagcctatgcttccatgcacctcttcttccagttcaagaccacggcccctgatgggcttcttctgttcaactcgggcaacggcaatgacttcattgtcatcgagctggtcaaggggtgaggggctggggattgcactgctgtcaaggaggtggccccctccccctgctgaaccacatacagctctcctggctactggccgaggtgtccaatccccccagatcacaagtcaagattcaggtccccgaccgtaagtcgagaggctccctcttcagccaagatggagaagcacaccctcttccactgctgactccccagctgcttccttgccagagttccctgttatatctgttctctgtccactgtcaccttctctacaggcagaagtcagtcttgcccctccgttgccttaggggaccccactccagagcagcccagtccctgcctccagaggaccctgctgacccacaaacctctcccctctagctcctcttctgaggttgtgtcacaagagccggctccttggtggccctccttccttacattctccccgtgacaggacctcacaccatagccctcttgccgttggttttggtcgctctcctctggggtctccctttcaatccctcttcccatggcacctaggacccctgccagccatagctcctcctcaccccaccttcccagcatcacccccgccctgacccagtgtctcctccctactgtggggcaggtacatccactacgtgtttgacctggggaatggcccgtccttgatgaaggggaactcagacaaaccagtcaatgacaaccagtggcacaacgtggtggtgtccagggacccaggcaacgtgcacacgctcaagattgactcccgcactgtcacgcagcactccaatggcgcccgaaacctcgatctcaaaggtggggctggggcctctggagaaggcctggccctagcccagatacccctcaccccagcgagatcaccccattcctgcgacgctgcttccctcggttccctgcccccagtttccacctctctttccctgtctccactatgtccagcctgacatcttcctgtccaagttctgcttggctctcttgtgagtctgcatgtcaccactgaaagcctggttgcaggatgcgtctcacagggtgcttggtggcctcattccagagctaggagtaggtaacccaggccctccaaggacctcctgggcctccaaggttgagaagcctatgttggttgagggctggagtgagaatagggagcttagcatcctcctgggtgaggtagacgctatggggcagaggacgtagcaggagctagagtccccgagtcacctgtcttgggcatcggctgggctagcttggggacattttggacctaggcttccctggtgtgctcagggtcacatcagggtgccacattccccagggcctcttcagtggtcattgaagcagtcattgcctgcccccagaatgggtgactgagagatcagggaggaggagggtgagctaaggcctgagcattgggacaggaaagatgcagcttctccagagcctactgagggcaatgtgatctactttcttgcacatgcccaaagcagccctcagccccataggaacccctgggcatcagcctgcctcatactgtcagagcttggggagggtcctcagagaccatggaattaactgccccactccctcagatctgagatctgtcagatctcttgacatagtgctgtgaattccccttgttctcagaagggggcgatgtgtcacagagaatccaaagtggccccaaaccccgggggttatcttggcgggtcttgtgttgtactgagcccgtggccagggcagcagactgaccagtgtcttgactgaagctcggctgtgggctggctagggcttccagggattccagggagttaggctctgtggcaggggatcaggtgttgcggaggagaacttcccagagtcccaaggccaagccctagttgttgggggaagggagctgggctttgaactccctaggagagagcccaagagttgggaaaggcttgaaggagttctgggaatgggaaactttgggagggagggaatgggggtggacgggattgggctgcgcatctatgaaaggccctgattacgggccggaactggaatcaaatgtgtgggagagagcacagagcaggttcctccagctgtcccccagcccccactctcccaggcatctgggcttctctgggaggggagcaggcagatggcaaagtggagaaggaagaagtgtgttgggggggtgcgggttgtgcaggtctctggatctctgttagggacctggaatctgggatggaacgcagagaacctgagaaggctgggaggacctgacagccagatgccattgtcttgggatgggaatggggacctggatgccttggttgacccactccctttgcaggggagttgtacattggcggtctgagcaagaatatgttcagcaacctgcccaagctggtggcctcccgggatggctttcagggctgcctggcctcagtggacctcaacggacgtctcccagacctcatcgccgacgccctgcaccgcattgggcaggtggagaggggctgtgatggtgagtggagggtggaggagtgaggtgtggccctactggctacaggatggccagctgcagaggcagaccggggcaggtagcctttgctctgccaaggggccttccttctcaggccttatgggagcttgcccccacagttctggggcagggatacaggtgtgtgaagggtcacttgccctccctgttgtctcacaccctggccccttgtcacagtccaaggccaagcctagcagacctgaccctcctgccccaatccctgtcatcagtacttggccctttcagccaggcagagctcagagtaggacctctctgcctggctctgaagcttccacacctcctggggaaagagggggcttggctgagccaggggtgttcctttctcctgccccttccaggccccagcaccacctgcactgaagagtcctgtgccaaccagggcgtctgcttgcagcagtgggatggcttcacctgcgactgcaccatgacttcctatggaggccctgtctgcaatgatcgtgagtgcctgggagggctgggggcagtttggggagaccagggtccattcccagccataggggctgccagggaggaaacagggcctctgagcattcaggagctgtgctgcttcttccttctcatcccttgtctgcagagtcccaggggagctgtggcctgctgtcccctcatagggtctttctcctggggctgtgcaggattgctgctgcctgaagctctggggggacccactgatagatggcctctcctccttgttctcagctggtgggaccctgctcccttcacccaaaaccaaaggtgttggccttagtggggtgaacttgctgctgtcctgtgtagttttggtgatggccttacatgtacttgtacctcacacagacacactattgcacagggaggggggctgttaacaatctgcaccccctttggtgccctcagggcatgaagtgggaatctgttatttcctgctgagagcaggaccacaccccagaggacaggctctggaggcttccaggaggccaggctgctggacagctggtttccctggaatgggctcctctttcttccccaataatcccggctgcagtttgtccccttgagccacaaggtcactccctactgtcttcgcttggttcttttcctcctaggctggacatctgattgccaacttgcattctgtttgaggcccctccccagagagggcagggtcagcagcagctcccagtccctagtggttggtggcctgcagctggttagagccctgcagagggagggcagctgaggcaggaatggcggggaggcaaccttctactctgtggggtagctttggcatttcccttggatgatggggctggagtgggtgggcagagtgcagcctcctcagcattgcttgaatcatcttccctggggtcctgctgagagaccaagcagaaaagtcaactgcctgggaagaaacacacacaggcacgcacacacacatgcacacacacacacacacacacacacacacaacgaagcgtctccattttacagacatggaatacggctggagagggacagtcgatttctggaggtagttcatagcagatttggggtgagactccagtcagtgcctttgcctccataccacactgcgggaccttcatcacctgggcatgagtcctgagtttcttacaggagaaacctactgggtccaggagctcttgggtggtgttagtttttctttcccctttgaaaaaaatgtctaccccatctccctcagtgctttcctcgtgttcttaggcatgtccagcccttgggtaccaccacatctccactctgtctcccaagattttccttacttgacctgctgctgtctgtgccttccaaagcctccagacaatggccagctgagggtgttccagccctgactgccaaggcatggagacctggctgtggctggacctcttcccctccagctaactcagttttgcacagatctggagatgatggtaacttcgttgcttaatagtaacactccccactaatagtttcatgttttgctgctacaaggcccttttaatttgatcctcagagaaggcagtggcctttgtgtttaactgatacggaaacccaggcctcagtaagaggcagttactcaccccaagtcatagagtgtcgatggtagagcttggctggaacttaggtgcacctgactgtttgtcactccctgctgctcatttagtcctcgggggaggggtggtggtggtacccatggtgggcacttcttgcctggggtggaagaaatcaggatcacgaagcgctgctgcccgtcgccactgcttcactcccacacagtggagccttctggaaagggggcatgagatggatgggaagtgagggttgtgctacctttcagcagggataggaagagcaacttctttgggtaccaggctggtgggagggagggagagttggggctggggagcagggtgcatcttgggaggcgtcaccatccccaagcactggtctctgcaaagctgtggagctaagacaaggtgggtgcaacctgggggccacacagggctcagtgtgctgctgctctgagctctggctctggggtaatgctgagatctccgcccctggagggcagggcaggaatcttgggagtgggacccaatcctctcttctcccagggctactcctccttcctagcttgtctctggtttttcatgctctgtttctatggcacgtcttcttggggccctgtgatgtacaaggtcaggcaggaacccagcagagagacccgttcagttagctctgccttcacccgtgggaggccctgggggcgcaggcaggccctggtttcaagagaggaaagagggtagaaatggcaaaggtggaaggagcagggcctgtcctctgaagggtggggctgggggttggagctgtctggtgggggagagactagggtgaggagaggtcacaccttcagaacaacttttccccacttaccacctcaatttctccatctgtgacatggggactactcctgggggtggaggggactttgtgttcctttaaggcttatgagtgtctgctctgggaagacaggagagaaaagatgagatggaggaaagtggacagcaaatgaaaaagagaatatgaaatgagaaagggtagctaaaagagacacttcccagggctgagatttgggaccgaggtgttcccatcaggcctgcttactcctctgtctttcagagcctgtctcctgcctctcccaggcggtcaattccttaccatctctgcctccctgtctccgttcatctctgcagtctctattgatctcttacatacctctgtctttcccttcttttttaccctctatatctccccctcccttctcagccttggcccccccatctctctccagttcccactcactggtattgattggcctctaggcggtttcccttcctttcctctcgccaccggctcctccctccctccctgtggaaccataaattttctgcctgctcagagctgtgtcagtctatattccagatccaggggcccaagaacgtgatagagagggcaggaggacgtggcctctgggggccccagccctgctcctggcatgcagtctctcctccagcactgcatggctcggggccctgcaccaccggaagcctcctctgggtgcctctgaggaccgctttcttcacttctaaagacctgggggccaaatccagctctggcatgtagtagggatggaggactggcagcagcattggggagatgtcctgggtcctgactgcatcctggagctgggggtggcacatggggctcgtggtgacagtttttgctcccaaatggagtttagaatcaataaataggagccagctctctccagcccctcccagcctcctctctcccagccctcccctttctcacttcacccgcccctgcctcctgtcctttccttacccagccctcctcctcactccgctgcactgtttcttcagctcccccaggtgccctctccacctctctcctcctttccctcctcctctaccctctgccttcccaccctctcccctgtccgagcaggttggtgcatacgacccggtgacgggaaaggagtctctctgtgcttacctctggggccacaggtgctttccagagcgtccaaaagtttgggggacagaacccaattggagggcatcctgaaggagaagtggtttcctcagcttgacatacgtggcccaggaagggttttgtcctaaatgggacactcagtgggcaggtgtcctctagaccccccatggagggagaggttggggctgggggaggggcagtggtagtggagaggaaggattggaggagtccaggagaggcttgtgcagggggctgggggagcagctttttggggaggtggtggggagttgtacgtgtgtggcatgtcttattcctgagtacctcgaaggctctgggtgcactgtatgctgtggaccctattttggagggtgagcttggggagcaggggtgtctgtgtgtatgttggccattcatgtcctgtgatcaaacgtgtgtgtgcacggatgtatgccctgtgagcatgtgtatatgctcccctgagagtaagttggtgtgccagtgtctgtgagcacatgcatgcatgtatgtgtctgagcctgtgtgcctacccgcacactgtgcccatatgggcacgtggatgtttccatacccaagccgatacacatctcagtgtgcacgtgcgttgcgaggggtggtgcagaggtggccgccgcggcatctcagcaggctgtgccagagagcattattggggttcatccgggtggggtgggcggggaggaagaaagtggcctctcttgctagcctcaatcccgttccattattcagcagggtcccttctccaggaggggggtgcaggaggagcgcgcgcgtccaggcgcgggggaggggcgggcgcgcgcagaggagaggagagcgccgagcgggctagccaggtgccgcgcggctgagctgcccagcgccgcccgnnnnnnnnnnnnnnnnnnnntctccgctctcctccttccctccctccctccctctctccctctctccctctctccctccctccctctcccttccagccctctcaccctctgcagcaacacttcgctgcctccatctctccgccggaatctcgcaggctcgcgcctttcctcggctcagccccgctcccctcctctcctatccgctgctctcctatcccttcattcccccctcacccggatttgcttcccttcccccttcttccggcccccttccttccccgggcggttccttcctttcccccggcctccgcttgtgcgccaacggtagcagcggcgcggccggccccagtcgccgtcggtctcccgccttcgggggaaccaggtctccgtccctcttctctcctccagcccgcacggccctgctccccagctcggtttttccgcaggatttccctcgctctcccctccctgcttggcccccgcgctcccctccctctccactcggcaccatgccccttcccccggcgctccccattcccctctgacggccctctgcgccgctccgaccccgccgggatgcagagagacccctagctcctcgcgatggacccaggcatcctggaccttggcgttgccgctccgcggacccccgatttcccggcgggatccagttgattttgttggctccggaccgaggcttgggccctggtttacctccgcttcatccctaccccgctcccggagctcggagccggaggggggcttcgcggggtgcgcagccccgcgtccccgcccccggccatggggctgtgaggcggtcgcccccgggccgaaatgccccccggggggagcgggccgggggggtgcccgcgccgccccccggccctggctgggcccctgccgccgcctccaccgccgccgccgccacctctgctgccgctgttgccgctgttgctgctgttgctgctgggggcggccgagggggcccgggtctcctccagcctcagcaccacccaccacgtccaccacttccacagcaagcacggcaccgtgcccatcgccatcaaccgcatgcccttcctcacccgcggcggccacggtaagtggcactgtagatgccggccacccggttggcccgggggcggggggcgcttcccgtgtgcgcagctgggcccccgcgggccccaccccagctgtgcacgccgagcctggcccctctgctttgcgtcccggagccccttcacctccaatctccagctcccatcatctcagccccacccttgcctccatctctcctctcccccatcaccctcatctctgtcttcagcactttgcttcctggcctcacctaaacctgcttacccctaggtctggttcattatctccttctacttccttaccctccccgccctgtctgtcctttcatcctctccgtgcagctctgccttccatttctcttgcgcatcaccttctccatctcggccccttatcatctctccatctgtcttgcctccacctctgcctcaccctcacccttccatcgctggtctgtcatctctcccccttcacctctctcccacctctgtcacatctgtcatttctgcctctgacatgtctcttcctccttgacctcttcatgtatgtctctgttttacctccatccctctagcaaccttcctttcttttcccatgactggccttccatcacctcccaactcactccactgtcccgccattctcccatccttgttcccctaatctctagtgtctcccttccatgtcccctcatctctgctctgtctctacctctgacccccagcatctcacctctgtaggtccagcacttcccgtttccaggcttcccctcctgtgtcagtcctctatcgctgtccacttacaatcacctcctatctctgcccctcataaccatctatggaaaaacttaaccttccttctcagaccccatcaccttctcatttccgtccttcctcagccccatctcaggccccccatcacttcatatcttagacccctaagattctctgcatgccatctcttctcacccctgtacctgtcaccttccatctctgtcctccatactctgtgcccccatcactcccaagctctgtcctccccattaccttctacatctggccctcttcacattttatttcatctcatgtcagccccatcactttccacctcagtccctccacgttccatctcaggacttctgtcacttgcatcccagggacctcctcacctcccattttagtctattcatcacttcccatctctgcaccttgtcattacctttcagagggtagccccattacctctatctctgtacctctctcacctcccatttctgtgcctccatcccatcccatcctgtcccatctcatcccatccctgtgctctcaacacctcacatacctgtcctcctattcatgtcctctcctctctgtgcccctctctcttcaccttccatgtccgtcgcctcccatcagggttctctgacacctccatgctcccattccctctcatcgctgtgccttcatcagttctcgctttgtacccaggtggcctcccatgtctgcacttctctcccttcctatccttgtaccctcatcacttcctgtttctgtctctccatcccctcttattctttactccatttttgctcctccatcatcttccattcctgtattttcacccttcccatctgtgcccctgggtgcctccccattcttgctccatgccagtccctctttgcttcccaatcctgcccctgtatcacctccaatctttctgctcatttgctggtcttcttccttttctcctactttatctttatctcccttttcatgcttccgttttctcttcatccagtttccctggagcacttccttcaaactctttcctccattcttttattctctcatcccgaatacagtttgcctcatcttatctctgtcccacctggctcctctcaggcaacactcttcagtttccttctcttcttccatgaccccacccaaccccttgctcctggaccttaactccctccccctccccaggaactctctggctctttgttaccttcctccccctttcattgtctccttctggctcccttgaggcccagtgttgcccccaaaggtgcccagataggccatggtctttctgggcagtgaggcaaagcatgaaggagtcagatagataaaggaagtcagggatactggggagctttgcaggatgaagagagtgtggaagaggaaggtgtaggagagaggaactggctgagggaccctgagcaggtaggaaggagggcctgggagccagagtgcccaaggaagattccgtgaaggagcaaaagctggacagagggattgaaagtggccagaagagtatggaggacagggtatggaatgttggccttaggatcacctcagagatggccacccctttgctgtgcagaggagaaagaggaccagtgcctggtggaaacaggaagagccatctggagggtgctccaggatggcgatagaagggggtgggaggtgtgggggaggagcctgtgaagggtggggcagctgagaggaaggacgagggcccaaggaaaggaggagaagggatgaggccacctgtcctggctgaaccccacctttgctcccgttaaccattaactatggtgggagaggtgaaaagacaggctcttcttgggaccctacacttggctggaggaccaggccagctcaggaggcctttccaggccaggcttcctctctgcccagtgtctccctagcatccccagtgggaggcagcctctctcctttctgcaccagcttctccacttgccttcttttggggtctcactgtgtttctacttgccttctctcctctcttctcttcacaccatcccccatttaccctgccatcccccccaactcttcctgttacataatgtccttacctgccagacacccattgccactcctgtacctgatgtctgtctggggcatgggaggactggcacacctgggtcctaaaaatgagctgagcccaggggtgacactctcctggtcctggatccccaattctggtttcagagtccttgaggttcctcccaccccaccgtgttcatttctggtactgtcgggccaggaatggagtggtcaatccctgctaatttctgagtcagtagcttccatgggttccaggtttatcactccagcttataaagggggctagcatttattttgtttctgaacagggtgtgttaacttggatttctgactggatggtttatggccaagcagggggttaggaattgaaaggctgtgttctgggatcctagatcaagagacagctgagcacagggatctagaccattagagatctctctatctgggatgtaaaggttcatgtacaaagcgctggtgtgggctgcgagcactagggccatggcttttctgggttgtgcaggatgttttatcctctcacaagtctagatattccagaaggttttctttcatggcttcagatgctgcaggcacacaggcaggcagaggttctgcacatgtagttttaaccacaggggcatcactgcatgggtggttttctacatggatgattatgttgtttgggtctgggttagctaaccattattaatggttggttggtttttttctagaatgcaggtgtgtgtgggactgcatggaatattcttgaacatttagagtatttcactggatgagtgaatttctgggtctaggaggtattgaggagactatattggacatgggcagaaggtgccgaacctgggcctatggcatcttgtgtttggccagaggctttcttgccttaggcttcaggtgtgtagttctctctgaaatgttatgcacaattcagctcactggtggtttcctagagaggtcaaaaacaattggtctacaccacccttgggcaacatttttgggccttggcttaggcccctcttgcctttcagaccctttctggagcctgtcaggttctagatgtggtgccctattttgcgctccgtgtctcctagaagacagctgtgccttccctgggggagtccgtgggcagggccgaggacagcttgccggggtgagaggctgaaggcgcctccggagcgcggctggggaggggcctggcggaagccacgcctcccagccccgcggtctcccgaaccccagccttctgcgctccggaggcagccgcggtgctggggagagaaatgtctccccagggtaattactgccgccccagtccaataaaccattcatccttcacctcttctgcccaagaagtgtctctccgcccagtccccccacagtgtaataaacgcccttaggctttaacagacccgcccagcgtaataaactggcagcagtgtgagaacggctgggtgataaatcccaggggaggtctgggcttgggcagcctgtgcgccgcgggcctcgggggcggggacgcgtgcgccctgtcccacgcttggccagtccctgtcctggggccgccttccctggtctgtctttgtgccttcaccgccatgtttcctggctgcttcgcctcctgtcgggggtctgcctctctacgctgggtctttgtgtgcagctgggtgcgtcgccgcctgtgtgtgggtgtggggcctggggcttgggcgctgggcaccgcctctgatccctcctgcctcactgcctgcccagtggggcatttggccggctttttcctcccgccctctctgggcacagacagggctctgtccatggtgatgtgcttgctgtctggaatctggggtgggaagtgaagagaaagggcctcttttctcctagacctgggggatttggaggcagcctgcaggtagacttggtttccttccctggtctgagggatcaagaaacccaataaagccttctctgaatgggaggccctggagcccaggggtgaagaggctgcagcctctgatcaggaaggtgagggtaggaatgtgtgtggaggaaggtcagcatctctgctcccctggcccgccccaccccccaaattcagatgtgcatcttgtgtggagtggggaggaggaccctgggtattacagttgtcatggaaacagccgattttccggagtgctgcagtgctgggagtggagagaccgttaccggctgaggcctactgggctccccacctccaggcgctgcccttccaggcaggtgaccacatggggtgggggtgggggtcactgcataccccactgtcagccaactctccgccctcgacttggggccccatcctgagggttcagtgctcaccactgtgctccagggccctcaggtagaaaggacacctgggtctggggagggcagagccaagccccctctgtctgctgggggtggtttcttggccacaggcagaggtgagatgtcagttattagccatccaggtggttctttccctcctgcccttcctcccagggtcacctctcactctggggggatggaaggtgttgatggtgggtgctctggggaacagcaaggggacccatggctcctgcttcccccaaccccctgctggcctcactacctctttgggaaccaggcaacaatcttcccttctctcctcagcacctccctgggcctgcagatggtggctccccccaaagcactcaggcagcccctcccctttggggtcctaggagctccctgggatggagcctcctcacccctgattgccccaactacaagggggttcaagtccctgaggcgagagaccccgaggtacctgagggaacccggcctagtgttaccaactgggccacctccttggctgctggcaaggcctgctccttagaagtgctgcaggccctcctgccccccactgcaggctcctagttcctgactccagagttctcccacccccagactgacattttctccctgtctaggcttttgcccttaggcctcatctgtttctctccttctttaagtcctcccttgaacccctctcctcacaagaagtgctttgtgaggagtcattagtggctaattatttaattaagcattttatgaatctcatctgctccatttatgttctaaagaatgcaagattgttctcttcccttcccttctctgcaggccatggagtactagtcctccaggcctcccagacaaggctcctttccgggaaactgggtgaccagccccccacccccacccccacccccagagagctcagtcagccgcaggagggaacatggcgactaatggggtttattttggggctgagatcgttagggacctcacacccgcccccagcagccggctggcgaagaagagaaggagaaggggagagagggtggggtaggggagggctgggagagggagccttcatctccggctcccactctcctgtttctctcacttacannnnnnnnnnnnnnnnnnnncccacccccacctcatggctgtctcttcctttctgggcagggctccaggaccttcctgctttgggacccaggcagccccctgggtgagggcggaagcagggagtcctgggcaagccaggagaggggttgggatgggagatgttggagggcgccagctctggccgtgagtcagagctgcacacagctctgctcatcttcctgccatcacctggggttccttggtgcctgcttagctctggccccaaagaagcacacaccttggatctgtcacctctgccaggcctgggagaagtggagctagtcaggactgggccccctgggtctttcctgcccacagcactcttgtcttctcagtctccttacagcttctctctgggctctctctctgtgtcactctattacctctctattttgctgtaattaaagctagcattcttgatgaggcagctacatctgtctgtgcgcgtgcacaggctctcacccaggcacccgcctgccaacttctccctggggtggcagggctggtggctgctgtgggtatcacagctgaagtcccacatctagacctggggttccatccctctggtcacaaccctgaggacctgctgacctcgtcctcctgatgtcatttcttcttgtctccctttccttctctctgcagccgggaccacatacatctttgggaaggggggagcgctcatcacctacacgtggccccccaatgacaggcccagcacgaggatggatcgcctggccgtgggcttcagcacccaccagcggagcgctgtgctggtgcgggtggacagcgcctccggccttggagactacctgcagctgcacatcgtaaggaccctgggccccaacccttcaacctcaagcttcctgctcccaaatcagttcagcccctcattgccatgggatcagcacctcaagtcttccctcatggggaaccctcagaacctctgttccctcattgctggagcttcctgctaagaagttctgcttctgagacccttccctctctcagttattcaccaagactcccagatccaccctcccatctgattcgaatttctccagctccccactccctgagaccacctgtgttttctgaccttcctaaaagtagtcaagggcctctttgggacttccaggccattctcctgtagccttcggaggtgtcccacatttgtgacttcccctgggctgctgcctgctcactcctagaccagctaggccagcctactgtgtcctgcacctattcctgcccctccttcatacctacctgccccagggcagcccacccttgcagcttcatcttgcctctggattctgcccctgcctctatgctgcccttgacttctgcttccgtgacctttgccctcccagcagcccccttaccctgtctcctttactgcctctctagccaggttcactcctcactgacctcttggcccagccccacatcctcaccctgacctcagctcccacctggctctgcctttctctgctcagctccacagggagaagccctagcccctccctgtgcctgctacccaccttgaccttggttccttcccagggtctccctctgggcctcctaccatatctgcagctccttgactcaccgttttgagtcctgttgaactctagtctgcaagtggccccttttctttccctgccctttcccccatctctggctctgccctacacccttccctacgacctctggtattgctccatttcatttctggtctcaacctctcccctgacccctccccacagtcctcaatcccgagcctttgccctcagtcttcatctgtacatttctggcccctaacagccaccttgtttccctgcctgtatttcacatgctcaccctggccaggacccctgtgctgtggggatcaggcaggctggccaggctttgtgggctggaaagctctgggtgaggggcccctggctttcaggagggcatagttagttggaaggggagagaggaagccaggggagaggcttgtttgggctctgatctctccccatctgcttgggaacgcagccactggccttcattacacagtagcttttaagcatcccaggtctgcaccccaccccaacaccagggtgtgaaggaaggagcatgaggggagacttcctgtgggcagagcagagctggggtggaagtggcagcggatgaggaaggggtgcagaaggaggactagcaagcagaacagtagtcaggcccaagaagaggcctggaagttctgtacctgtgtcagcgggacaggcagttatctagaatggtgagaggcagctggcaagcgaaagacagtgtggctgtagacgacagtgtgggactggatgcatggtgatgtgtgtcaggagtgacggctgtgacagtgggggatgaagacagagactggatctcatgatttctgatggagtgtatctatagatgtgtatttccccatgtagtggtgtttgcagttgtttcaattgcctttctgggtggcggggtgtgactgggtttccctgtgtcctctgtgagtgagggctgctccttctctctcttctccctcatgcgaagctctgcatggcttgcagtagatggtctgggtttgaatcccaactttgccacttccttgctgtctttgtgcaagtcaccgcagctgtctgagcctcagttagcccatctatggagtggcataggaagaggacagagggatgtttggaggttgaaggagatcacttatgtgaagcacgtagggagcatgctgtgttagctagtatcccgaccatctctgatcagctacctaggcaggactgtgggcctctgtgcctgttaggttagggcgtagggctcccctagtactgaggagaaagggtagggggatcaggatgcgaggagaagggatttcctccttttctctcccaacagttgtgaacaggccttaaaggtgcaaggctatggaggaacaagtactggtgccgggtacggcagagggcagggaagacgggggtctgcctgagggtggagaggcctggcaagggtgggggtccatgagaggagccagccatgaggtgggaggtgggcaccagatgggctgaggccccctgggggcagcccccaaaccccttcctcccctggtgacacatcagctcccaccacagcgtcagtagcagctctcagagagtggggaggcggcagcaaaataagagaaaagcaatttgacgtttctaataaagcgtcgctccactttgccaaattaattttgactcccataattatttgctgtaggagcggcttcgttctccccaccgccgcctaatgaggtaattggggaattaggaattaatgactttaacagaagtgacaactgacttcacactgggagaggctctggggagctgcctctcccccggagtgcagggccctgagcttgactgcctcctaggaaacccaggtgtcctgcctcccagctccctggccggcactctgccagcctggctctcagactgcatgtgctccttgaccaccatcactgcctgggctgagcctgtggggagaaatcctcagaggaatccagggagctgatactattctgggtggtattattactaacaatagtaccgaggaggatcgactgttccttcccgtgtgtggggagcagatgatcagcccgtctccctggggatgttgtcagtctgtgggtggtgaatgggtggggcttgctaatactctttgttaggcaagcccagcctcagtttccctgctttactgcatctgaggagagaggctgcatgcatgtatgactgtgtgcatgcatctgtgtgttagcgtgcatgcatgcatatatgtatgtggttttcccaggttctgagaaggagacaactggaccccacaagtgggaagggataggacatgggtctcctgagccacagctgcaaaccttgtcccccaactctctctgccaaaccccaacccttgccccatctgtgagccacccctgccaacacccccagtgccaccaagcctctcggctctgctagatgcaggaaggaggtggcagctgaatgttccacatgtccaggccagactggggcagtctttcaagaagaccccaggagtgtagtgtgtttctatgatgggttgggtgcctgagagtgtgtgagccagggggtttgagtgaacctgtgtgagtgtctgttccgtgtgggaggagggctgagaccgcgttcaggagtgctgctgggaggtgcagggaagtgaaacaggggctcaggcttagtacctaatgggccttcgttggcttggttagatgcctttggtgttgaaggtaggcctcagcagcctcttggatcatcccacacccccacctccttgagtcagggtcttcctagactggtgggcaaagggagagaacactggctttgaagtcagactagctggggttcaaatctggggcttccttctcatgagctgcaagattttgagatgttatttaactatgctgagcctcagtctctttcttgatgaaatggggagctatgagcttcttcagcgggttggtgtagggaagagagcatgcgtgtacagtacccactcagggcctggcatgatttagggtttggtgaagccctccctcccactctagcaccacaagcagaactcttcctgggctgatcctgggttgcctctgcagagtgtcccgtgggcctgggtcccagagattgcttaggctctttgctccccttctccaggcctccgtccctgtctgtcctctgcctgtccttccccagcccctagctccaccccctaccccgaaacccccacgatcccctttcttggtcagtctagcatagtttgaccctcagctcttctggtgtccatcccaccatacacacagtccacaccccccacctccacccccatggctgcagagggtccacccccacactcagagcctgacctactttgggcctgagaggctgccaggagaggcatgctaatgccctggtgtgggtggaagccccctgggggcctgcttggtacagagcataccagggaggagaggctggagactggggactggggaggggctgggggtcagaccttcctctggcagaggccggcttctgtggacttctctgctgatcttgccttagagaggcctctgccctccatgccccgagctggtccccagcttggcccgatcacccctgtctgggcccagtggcccttgcacagagtaggtgctctgtgaatacttgtgaatatccaggacaaaccaaaaggcaagagacaggtgtggttagtggaaggcgctctgggcccaggctctgcacgcacctccggcctcaagttactcccttgcatgtggggaaggggagcgagcctgcccacctcctccagcggttgagacctgggaaaggtgccttaagtgctgcggagctgggctagtggtggtcacaggagtagccactagaagggatgaatggttgctccctctggtcgctgacctccacctccatgtccccaggaccagggcaccgtgggggtgatctttaacgtgggcacggacgacattaccatcgacgagcccaacgccatagtaagcgacggcaaataccacgtggtgcgcttcactcgaagcggcggcaacgccaccctgcaggtggacagctggccggtcaacgagcggtacccggcaggtaggcggcgcgggcccgcggaggaggcgcggtggcggggcgggtggcggcctctgataggagtgcggccgcaccggggcggggctaagcggctctggggcggggctaagcggctctggggcggggctactggagagacgaagcttgcgaggcgggactagggcaggggcgtggctaggaaaagtcgggatttgtggcggcggggcgagaccgtggtggtgcgaatgcgccccctatgggggagggtgcagggctgagctgggaaggttgcaaggccagggtccagtttgggggtggggggagaagtggagggagggtagaggtgaggagaatctgatgcgattgcggaaaggttgagttcagaaatgagggagacagatgcagaaacaggagagaaaatccagaagtaatataaaacgtgtcttggcaaggagacagggctgttaccacgggcagagccaaggaaagaaccgaggtccttataaagagcaagtcagagatccatattaggagatctaacgaaggaagaggagtagccacggagactcagagaaaaggacccccagtgtccaaggcggtgagggacatggtgaaagggaggaagagacaagtgacaacaaaaatgaaacacagggtcatgtgcgttcaataacctttgttgacaacctacttagatatcagggcttgtgctaggtccggggcactcagtccctgcttgcagggagccttgagaatgcagacagaccaagttcaacagggtgacagctgtggcggccaaggacaaaccaaggtctgaggagcacaggagagggatggagatgaggacatggaagaaatgaggaggcagagactctgaaagatattgagggaggcagagacagagccttagaatgagaggaaaccagaggggaagcaatggaaagatatggaaatagcactgaactatatgcaaagatgaggagagatgtggagaggtagatggagatgctgacatgcaggcccagggagagaagaggtggacagagccttgggagggaacggaggagagccccagcatgggagataaagagggaggggaaacaggaacgctgcagggagaactgcagaaacacagagatggtgagatacagtctgagcgacattgcagtcacacacagggcctgactgagaagcagagtgagcatctgcgacctccatcactctcccaggcggagagatagccaggctgaggcagagaagctgccccatgctgactgcgaggggcaggggcaaaaggccaatgtgtaaactttcatgggctcaccagtgctggagtaaagatgccagtacaggcttatgacaccaattacgcaggcttgtacccagacatttctggaaagtccctggagataaagaggcctgcgtggccccctaatacatacagaggttcatgtacacacaggtcaaccttagacatatggacaactgcagacatttgtatggtcagacagacacatgaaaaaacagctctgcagagggatgccagcctacatcaagtccctgggtacatgtagggacactcaacacacaccaaccctcctacactaaattccacctatcccccacgccccccaacaagccaacactgacagctctggctgtgtaggcatgattcctgtgggcagcagacttctctcattctccgatgcacacatactagggcaacctttgtagcagtgatgacattggcctgtgctggacagggctgggcttggaagcatgaaggcctcaccatgtcaagccaggacttggatctagagcttctccccttggggcccaggaggccagcagtcagggtggaagaattattcctgctctcctctcctcagggacccctgactaggggtgaggaaaggctgctgggtgcccccgcctgtaaaggggagtaacatgagggtctggtggttgcctgtatatactgagggcagatcctgagcaataccagcaggtcagaccatcagtatgcatgggcccagagtggggggggaccctctgattctttgggagcacagagacacagcccatggattctgagtcagaagaacctgggttttaatcctggatctcccactgacaagcgtgtaaccttggacaagtcatctagcctctctgaatctcagtttccacttcggaaaggtgatgatacctacctcatagcaatactgtgagaatgtcattaaacactagaatggcatggcatagcaaaggtgctcaataaataggacttttattagaatttttgtatactcagcctccctccaggcagatgtacatttttctcttcctcttggagacacacacacaggattgaatgatctgtttttaatttaaacacaaatatcctgaatctatagggaaagcagaatctccttgcctcataagcacccaaggaggcaccatccatacccacatgaacacatcgtgtgtaccttcatgggaggtgtacataggcaggcccaggcccgggtctctgggcaggtgagcacagctgtgcagtgagagatgagaggaaaagcctcctggccccaccagcgtgcactgaatagtatgtcagtggcttaaatgggaggagtggccagattctcaaaggaaatcagttctctttccactgctgcagaccaggatcacccacagctcacagaggtgtacagatcctctcaggtgcactgacaaacctctttccacataggcgtctgtgcacacacacacattcacacacattccctttcccagtctccaggggctggagattggtgagcgcagagaggaacaggtgggtatccagatgggcagccaagcttgcagaagagatgggggctggaactggggggaggagcctggaaaagaaaggctgagggcctggcagggtgagcaagatgaggtcctgagacagcaaggagaagaaactgggctctgagtagaaaatggtcaaggtgcattcggggcagaggagggtgcagaggaaggcggggggtgtctgcaggggaggagaaaggggccgaagaggaggtgagaaggggaagggggctgctggatgatgatccagctcccacaccaggcgccacacctgtagtggctgcccagtagaaagagagccctgaccagggtgaggaggccttgcaaagggagtgcagtggtggggttgggaacaggaggggcttaaggggggtcatgggtgtggtatgaggtggcggggtcataggtgtggtatgaggtggaaattgaggggaagctgggagtggagcacgaaggcaaagggagttgaggtggcctggagaagtggtttaaatctcactgttcaatgtgcgtgctgggtggccccctaaatgccgcataaaccccgcttaacccatccttcccacttctaaaccgccctctaaacgcagaaaccagttgggccactgatgcctcccgcccccaacttaaacctgctaaatgcccctcccctgcccgccccccactttgggatggggaaggaagggggccacagcagcttaaccacagataaacctgtttaacctctgacctttgaccttccagctccctttcttttgtgtccctttccttttcttcttttctcatctcttttgctttgggttgctcctgcccccagggtggggctggctctgaaccggagcctagggagggggtcaagggaaaagaggggcccagcgtttcttttcctcccttcccctctttccgtggatgttgctgcttactctgagtctcctgaggattgcataattacttttctaactcctttggacttcgctgcctgagaaacctactgtctttctaaacttttccaaggaaactttgataacgagcgcctggcgattgctagacagagaatcccctaccggcttggtcgagtagtagatgagtggctgctcgacaaaggtaattaaccagaattaattaattaattaattaactttaaaaacactatcttaaaggtgcagagctctctctttccccctccgtgccttcaccaatgcccacccccaagtgaagggacaattggccagccagaatgctcccttcccctttggagtcaagggtctgtctgtgcatttcagagtggtggtttttggggtaggagtggggttttttcttagaagtagggagagtcttgttctctttttaaacctgggatcaactagggtaatccacaagatccctaccatgggagctccccactgtgagcccggcagtaaatcacaagcaggctgggaatgcagcttggaggtaggttccctctgcccagaatcatctcggaggcttggtaaagggctagctgagggccacagagcatgcagaggcaggaagcctttgggaagcaggaaggctgacctgaggaggtttaggaaggcttcaccagagccatgtgaggagaagagagaagagtggggacctcagatcttactggaaagacccccaaagagagtgctgtggggctgctatctctggaacaagcccaggttagtccagaaggcctctgagaagttgaggagagactaagggaagtggggcaggaggtggtgggcccatagggatttctgctcctgcttggctgatgaggaagaccaagcaagccccttgtgaggccccagtgtggtgaggtgtcgctgggtgtgagagagaaggcttcttgttaccaagggaagctggggactaaggacatatccatcccattccctttggggaggcggggcgagctctgtacctctaaggctaaactctaggggggaagtagaactgttaaatctccacttaaccagctgataactgtgcttttaaatgtccactggggccttccccaactaaaacccccaaatgtaacttctagccccccatgcctgtggggcctaaacctgctgataaccagatgtgataaacccataacaggacaaaaagttaaagggactgtaacagacatcgctaaaacctacagcccccagccacactgggctgctctctccagcggggtgaactttaaccctttgaggagttcatggcggatggggccaggggccacagggaccaagtttgctaacactgtggcttcctcttcattacccacctccctcttccagaatcagagaggccaagggagcagcctgggctgaggctgggacaacttgtgaccccaagagcagggagagctggacaggccctgttggggggtgggggaggaattgtggtttagatgaaggagagccagggccctccttcctttttgccttagatctgactttcctcttctagaaaataaccaattggattagagaggtagtgcccgaagtgtgaaagaaggaactcacttttctgtggccttagccaagtacttcccctttctgaggctcagctctctcctgatggggcagtgatggttactcagcccacctcacaggcatgttgtgagggtgagaggaaagaaacagcaggaaagtatcccagaacaagttctggggatgcttggagggaatattttattgttagcgcctgactatggtaggtgctcaataaatatttattggatgaatccattttccagttccaaagcatgtcctgtgaaacagtcccatgagatgcttcacaatagagagatttgtggtagaatgagtttgggaagtgctgaatcctgtttcttcctcttggagatgcatatgtgcattagtttaataaaggctctgagaagcccttggagaaagaaacctgttcgattgtgaaatgtttccttccccaactcatttgaccactgtgatccttctctcctttgttttcctcatgattcttatgtctgggaaaaaactttgatgcagaggtcttcctgggcctctctgggtctggtattccaggacttgtaccagagctgctaccactggccctctgcctcttggcctcttggccattagtaatgggcgttgctggtccaggggctatccttgcctgagtgggcagtgggagggtgctggaggaagaaggaaggctgagtggggggctggggagacaccccagtggccatcattggctagaggctggatggatgtttggatgtcccagaggcctgggtgtcccagagaacctgtttccaaagaggttgtgggcttcacaagttggactgtcctcagcccgggttttgggggcaaggcttacaggcaccgaactctaaaccagatctttaacgaggcactaaccagaggctaacaagggctaagccaggtctaaaacccccagtgccagcagctgaaggttccgggggagatggggcaatgtggtaggccctctgcccaccccctccctcccacaaaataagcagcaccaaaaccaaagttaaatctaaacttaaacataataaacatcttttctaaaaaccaaaccaaaacaacaaactcagagggttaaaccgacccccagatccactaaaaacaaacagaacagcccaaccccacccagctgggaattctgaggtgtcatactggagtgtggggtgagattggagctggagcgggttttattggctgtcagtgagcgaagcaaggtccctttaacattttccacttctgtgcttgcatgtccaggtggggaggaagggctcggcttaacagggcctggtcccaggcagtgctgggccttggcagtccgggagaagagaggggatcctggccaggggtcagaaggcctggttgtaggtgggaggtcagcctgggcaggttgctgcttccacacaccatcactctgtctcacctccttctctgctctcacacgcaccgactccaccttggcctggcagctacctcctctgtctctgcctctttgtctcctctatctgcctcttccaggggctccatggcttcagggcttggggctggacactggggcaggatgtttggggaagcagagggagaagatggggatggactgagggaagaggatgaagaggggagatgaccttggagctggagaggagagggaatggggaaggtgggaaggcttgcacatggtggggaggagggactgggctccccttccccagcccatgtgtaccctgggtgccctccccttctggggtccccacctggctgggctaggggctgtggctgacaaggactttccctttggctttctgccccttcctcatttctccccgtcccctcctcccttactggctttctcctccattcctctttcctctccttggcttccttcttttcttccttcccttcctggtctcccctcactgcctgccccttctctgtcacccccttccactcctgcaaggccgccagctgaccatcttcaacagccaggctgccatcaagatcgggggccgggatcagggccgccccttccagggccaggtgtccggcctctactacaatgggctcaaggtgctggcgctggccgccgagagcgaccccaatgtgcggactgagggtcacctgcgcctggtgggggaggggccgtccgtgctgctcagtgcggagaccacggccaccaccctgctggctgacatggccaccaccatcatggagactaccaccaccatggccactaccaccacgcgccggggccgctcccccacactgagggacagcaccacccaggtgaggccccactctggctggtggattagggcagggataggtggggatggggttgatatctgcatagccacagtagtggtgcctagagtgagggtccaaggggtctgttgggatcctgaaggctgctgtcgctgactttgttgccatggcgatgggcaaggtcacctttcaggaagtggccttcaccctaatgaccagggatcttgtgatgtgggggtgaccactatttctagagggaccattcccagaattggggaggagtttgatggcccagttatatgagagaagaccaccctacctaagagagatgaagtctggacttggggtgagagtaggatggctccttctgcttccccagtgaaggccatgcctagcgttctgtgtgggcagagagtgggagatggatggtaccaggctggccctgctgtgggcaggggtgacagcatgggagggctggatgcagtcacctggcatgggcagcccctctccagaggctggtggaagctaggaggagcctctccttgtttgctggggtccctgcagtgggaaagccctggctgcaagtccattgccttcacaagccctctccatgtgactatgagcaggcaccacaactcaggcagcttcagtgtcctctccgtctgtgcgtctgagggggtctcagtgcagacagttccctggtgctcaccccacctgctgatctggatggccccagctagcctagtcccaggcttcctgcagcacagactggtagggaggaggggccttgaagcacatggagcccaccccacctgctcaggtgtttcctgggtcaggtcaagccctagcgatagggcaggactggaggggcctgcacctggggaatggggctctgctggagcaggacaggcctgtgtgacttcctgaggcagcccaggctgggctgttttctagttgttgcctcctgtgcgtgttttgaccgttagcacagggagggctcactcctggcattaaggcctttgttggccaccccttctcttcccatcgccctgtctggcagcctatggctgttaggcaccctctgtccttctagggtgagggcaggatctgggggtggccatgaggatgtgctcctccctctgtcaccagtctgtcttcagcttctccctctgaggggtgggctccatgtgctttaagacccctcctccctgccagtctgtgctgcaggaagcctgggactaggctagctggggccatccagatcagagagacaagcctgtacccacttcctctctgcaaagaaagctgaggagacctgaagactttgccccgagggagcagggagcccttggggaaaaggtctgggctctacccaaggctgggtacccaccatgcccaataccctccaaatcataggggacgaggggctgtctggtctcagtgggagggtgatgggcagatcatcctggtggaagagagaggtgggagtcccaggagtcactgctgtggtggggaagcccaagatggaggctggtgccgagggggcaagaatgcagaagggagctgggtcctccaggcactgccttgcccttgggtgagtgagggctgttgagtctgaagatcatgggctgggaagaggcaggttatgaccctttcaaccctgctcgtccttgtccttcagcctagctctctcctcaccttcccgcagtttctcgcgctcccttcttgcctggacttttgatttccctccttgggtctcctccttcatgcccctgagcgcccccctcctccttacactcactcatcttggggattctctttctttgcaataagtaagagagaaaatgctgacaaagtctactcttgtcgtcatggcaaccacagccctaattactgtgtgcagcccggctctctcaggctccaggaaagggggttgggagagagatgaggggtgatgggtggtgaagctggagccaggaaaccctccagggcctggccctattctgcctgcgctggcctctgcaggctccgccccatagggccttgcctccctggcaccttccctgaggcatcctagatcctcttgccctggcgctgcaggtcaaagtctggcgtccactctcctcacttccgagaaataaaaagcaccatgtgtgctgtttcactgaccttcggaagccatgaaaacctgcagggctgttgctggggagttccctgtgcatagcaggaaatggaggcccgaggtcagccagcaagagatgggagggctgggactcagaccagtctggtccgtctcagcccaggggcatcccctgtgccaccgtgcacctcaagtggcagctgtgggatctgctgacctgcctggaacctctctttccccaccccttctctcgcccctcagaacacagatgacctgctggtggcctctgctgagtgtccaagcgatgatgaggacctggaggagtgtgagcccagtactggtgagtgcctttcccccctcccctgccccgggtccctctgcgatgctgctgggaggggggcgactgtccctgccacctggcccaagccccagggcctgctgccaggccttagctttccctgatagttcccccttgcctaacatcctcccagtccctcagctgctctctggcaagatgccttttggttcccagcccctcagaggtagtgaggtccttagcctggggtcctggggttgagagccaagaggtgctgggagagaaggagggaggcgtttccctaggaggatgagtaactgcagctcccatgagtccctggggtgggggagggtgaacatggcttaggaactacaactcccatcagttcttgggtccagaaccacaactcccacctgcccctgaggcctggtgctctctaggccactagtagaggagatctctgctggatcctgggccctcctcttctcctgggtgttgggaggtgtcctgtgctctgtctgaagtgttcccagagtggacactgccaggactgccaggccaaggtgaggcagttacaacacagtgactgctctgaatccgatagtgtgctgggtgggaggttccccctagaccagacttgtggtctcctggggaatattagggcctgaggtctggcccagattctagtgggggagctgctgtaggaggagagcagggctgggagggaaggctctccagggcctggggcaatggggccagggagtgctttctaggcctctgcttgatacttcttgctggagccaagggtgcagccacagagagagaccaggctggcaaagcgggggtggccttgagtgctgcttgagaagtgtgggatgtggagtggtgcagtgagtgccaaggctgctcatttgagcaggttgggggtggccaagagcagctgggggagggtgggatacttgaggctggcagagggagcagagaaaggactggatgtggccagatttcccagtggaggagtgtgggcctcggtggctgccagatgagtctgtgggagtggagggccacccacgtttctcgcttgggctgctggagacttctccccattaccttgcaatgggtggcacctgggttgttggtaccagaaggctggaggttggggccggtgcttgcggggttgggggagattatgtggtcaggaggtgggcagtgagccctggatacatcctgtgaatctggcctgggggcctcccagctccagaaaagacattcaggctgagggtgggccacgaccttggaaggggtgtggatagagcaggaccatagcatggcctgtggagccttggggcagaggctcagcttcaaaaaccaagggcagaggggtttctggggcacaggcgcccagacccagaggctaaagcccagttgccctccatgtcccccaagtaggctagagctgagaggggtcattcccatgggcctgggcccagggaccttcaggggagctgccagctgctgggccagaaaggccttcctttccatagcccagggcctgtgctttctgggtcagatgccttcctctctaggaggcccctctgctgagtgctgttacttcttcccctggggcgatcttggctcaaggatgtacactccaatgcctccattgctttggggggctctgggcatctggtgacttcaacacacagtaccccctgccctgctttactgctctgagctctaggcgtttattggtggctcctgtggccaacacagcactgctagcccaggcctgctggaagtggctgtgatgagcggccccataaaagctctgggacggggctctggggacaacggtctttgagggtcctgaagaaagggcactgagtggcaccacatgtgtttacacacaggtgcccatgttcacacactctgggacaggaattcctgggtaacaggaggagtctctgctttccctgcaccctgcagaggggtatctggggccagatggtcaccacgtaggggcatgcagtgcacactggatcccacctgggccatactctgcccaccgaagttctagcctcccagccctgtcttggagtctagtcaggggcctgggtctgatgctgaatgggtgcattggtggtctgagcccttttaggctgcattagggcagagggtgaggaggcgctgaagcaggcgggtcagctggttcccagtcagggatctgtgaggtcactgaccactgagccaccctcttgggaaaagggccaagtagaggatgaagggtggaggaggtctagaagcctgggatagagaggggctgatagccattccagcacccagctttaaaagtaaggccaggagggagggcagagtacactctggagcccccagaggaaactgccagaagccacagcctctcccctaagcctgcatcgcacatgcttacacgtccacatttgcaccactgtgaaaggtttaacgatggatcctcatcatcccaatgggaggccaggcaaggaccaaaatgactccagggtctcccagtctcgtgtagaccatgccatgccgcccagagcctctcccaggcccaaatgcaaggaggcttttctccagcagacggccaggactcccttggctccagtgtcagaggtgggggcagcctcgctggagaccccatggggttttacctctcccaccttgcagatcctcatccctgggtctgggatcatttctgctcaccttttcacccttttccctaacctgggctcctccacagaccctggcccatactttctcccttgtttagtgagaccatcatctacacggttattttagctgaggttggcttttgaatgggagtgcctttagcagggcatgcaccatcggtaatgtacccactcatagttgtctcagctggcccaacccacatattgtgtcctgggcctggcccctgaggggatctgactttgcacaacccgagacgtgcaggaagagaagagcacacacaggctcagacccacagaggcagggtctgtatgcacatgtatgaccagaggcatgcacacatacagccctacacatacatacatttacatacccaccagcaagctcacatgggcccacttccacacacacacatacacacacacacacgttcaaacctagaggagcacacactatttgtacctagaccaacagaggcacacacatgcttagactccaagagacatgtgtgtgcttatacccccctgaagtccataaacacagatacacacctgttgagactcacagaagcataaactcatgcacacatgcatagcctaatgaaagcacatgcatgcactcagagctaccaactcttgcatgtgtgtgcttagagctccagaaatagccgcagaggcactcagatgcacacgtgtgcacctactcagctcccagaggttcacacttgtgtgtgtgttcagttgcaccaaggcacacatattgtgtgtctcacaccaaggcacttggctgtgttctgagctatgtgtgcatgcatgttcagacccactgaggcacacccacacactcatatctactgacacccatgctgaatgttcagaatcacacacacatgctcagacccagagacagacttgcatattgcaggcactcaggacaggacacacacatctgtgttcagacctgagtgtgtgtgaatatgtgcttaggctcagtgagacatataccttgtgacacgccctcggactcacagattatacatctgtgctcagctcagaggcacacatatgtgcacagatccacctgtgtaacacacacaggtgctcagaccacagagtcctacatgcatgttcagacaggcagatgctcacatgtgtttcagaaccgcagagacctgtatgcatgttcagatcaggcaagtaagcagtgtgcttagacccaccacagtgcacatgtgtgcccacatgtacttacagaaatgcacatctatgaccaggctcacagaggtacatgtgtgtataagtatactcaccacaatgcacacatacatatctgcagagaggtgtactcatgcaccaacatgtgtgtccaacccccagaggcatgcccacatgtacacaaatgtgcacctgggtaagactcacaggggttcagatgtgcacattctcagaggcaggctgtgtgctcaaccccaggggcctcatacacacacaatttgttcagcttcacagacctgcacctctcccaccaagcccgcccctatagaagctcatacttccatgcacagtcaatgtgctgagtgccacagcagtgtacacacacacacacacgcttacctgctgaaacatgcatactggttcacactcacagaagaatacatatgtacacacatatgcatagacatgcaagttcatgtgcttagacctgtacagaggtatacacatacacacacacacacacacacacacacacacacacacacgcttgggcctacattagcccacacaggtgcaagtgcacttctgtgctccaaggtacccatgcagtggcacacagaagggcacacacatatcctcagacttgtagggcatgcacacatgttcagacacagtacaaggcatgcctgtatgcctgtgtgctcccactcaggtaagtacacacagttgtttagacccacaggagcacacacatacacacatgtgtattcagattcacccaggcccatgtatgctcagacccacagaagcagcctcctgcacttactccatgcaagcatccctcctgaagcattgccctcatgcacacatgaatgagaccctcagaggcacatgcaggcttaactccacagagtcacagacacatttgccgagacccgtagaaccacagtgtgttcagattccaagagggtctcaaggtagcactagttgctataatagacaacatctattggtttaacacatagaaatgtatttctcattcatgtaagttataaacaagtgttcctgattggtgggccactcttctccaagtgatgactcaaggcttggaccctctccatcttgtggctgcaccatcttcaacaggtgacttcctgagttgtggtggaaggggacccggcatggagttgtgaagtggaagattttatgggccagccgtgggagaggcgtgcaggctcctgcccacattctgttgcctggagctcagtcatggggcccagcctagctttaaggaaggctgtgaggtatggccttgctgtgccctgaggaggaagcagaaacaggtctggggcccagctagtgaattatttgtcaccggcttgcctgtggtcatcaaggatccgtttcactctttctcacctccaggacacacccacccctccccaagggagaccacccaaagtcccaaccagctagggcattcatctcaaagctcatgatgtctgggagatggtggcccaccgcatccagtcaagacctggctcctctggaatggggacccatatgtgatctggatacccaggaactaaatggatcatttatctcactgctcccacagcccgatacacacccagcatactgtggtgtggggcagagggaaaaatggaagacacacagcagcctagattcacacaggccaatgtgtgctgctagcgctgaggaaatccagcaggcaggcaggccaggctctctgcccctgcagtgggggaaatttcttcattaaaccctgggagagattctgctctctgggggagactcccctctcctttgtctggggtccctggctgtcccctctgggaagttcctcccagtcctccttctccatggccatgtctgaagtgggtgttgggaacaatgtcctccttgggggtgctgtagcatgatagcccacccctgctcatgcagatttggggcccaagggtggtttaaggttcaaagtaaccccacctagacacagttctcaagcctcatttatttccttgttgctctgcccccatgcctctttctcttaatacagtggtgattgtcttgaggacatttgaaacaataggtgggaggttgcgggggcggggggcaacccctaaatctgatccttgagcaaggctgagtgctcttattcaggtgagaagttttactgcgccattgtcctcaaagcctttttcacttttctctcttactgtttggaagcagtggcctcttctgactcttgtgggatgcagatttctgggctctctgtattcttttcacttctgcttgcaaaccagccagttcttgcctcctcatactccttgcctccttggtctcttccttgtactatgttactaaaagtagaaagtagaagcctcatggtcagtggcctttcccagccctttccctcagtgcccagactccacaggcagtgcctaccctccaggttctcatgagcaacggtgtgcaccacatgctttgccactgcattatgtgggttttatcttcccagcctccacgccttggattgtcacgagtgccttctcaggtttgtgttatcgtgacatccatttctggtgccagtgtctatattagttaaagtaacatttgtttctgtaacagataagccccggatctccgtagttaattcaagagaagtttctcactcaggtgcaccctacctgggtatgcctgatcagcaggtggctctgctgccaagggtgctttaggaatccacactccttccatctgtggtgcctccattttcaacttgtggtttccaaggtcactgcaggagaaggagcatggaaagtggcaccaggaggctgctggggcactggtacgggcagtgcccactactcagtcatacaccaggcctactcacaggggatgtcaggaaatgtagtcttgcttcccaggagaaggggaaaatgagtttggtgaaggacgcgttccctggggtgcaccgctggtgctcagatgcctgtggtgcactcacatgttctggggcatgttcacatatggacatgtgcacacggaactcagacccaggctcagtggccggcaggcacatgccagagccagaggtccactcactgacatgcacacgctcatgctcagatccatctaggttcacatacatgcatgcacacatgtgcttggggcacagaaacacagatcctcagtgtgtgtgtgtgcatgtgcatatgccacaatgtaccgtttttttcttaccttgaaataccctggcctctgcccttgcagtactggtgcttgtgggtggcgaggggcactgtccttcagggcaccatacacagtggcacaggttgctctctgctcgcacaggtgagtaggggctgatatctgcccagggctctgcttgcccagccatgtgtcctgagcaccagaacaggaccgtgtccactgagaggagagaatggtttttccaatattgcatgaaggtactgtttgtgaaatcatgcaccacagggtcacgtccgcatagaactgtgttttctaacccccatgaaatgccctgtaggctggtggctttcttgcccctcacagcctgggcagggcctccagctcactgcttagtcttgaatatgctcaacctcaattctagactcccctttgggggtgggcacaccttgcttgggtgagaatggggttcttgggtagttccagtcaggggccttctgtgccctaagggcagaagggggctaactttgttgggccagcagtccccagaggaaggagagttggggaggaaggggagatcaggaatggctggtggtccccctggtcagggatggcattctctagtaagtggggcccacatgcactgaaattcagtttttcttaggatgcagaggagtgttgggtgggcgggtggcgtctgtgctaagtgtgcacctgtgagtattttccaaatgctgcagctgcctgaagttggggagaggcgggaggctgcctggggtcctatcagactcctctggctcctaggagcaccccattccaggatgcatccttagtgtagagctggaccatgagtcattgtgagtctgcacccacaaaacccagcagcacgggcagcggttgggcttttggcagggaggagtctttgaggagcccggtcctcccctcctccaggtcctgccaactcctcaccaggacagcctcttctgatccttcctgaactggtgtgtgatccgggaaagcccagcaccctacgttaggtgacttgattgccccagagcctaggccgggttgagtgagcccagggaaggaagtcctcatgcgttctcatgggttctccagagccttttatcttgtggagaggaagtggggtgtgggacactgggaggaaacggagaggaagccatgtgggagacagaggctaccatgagaagggggcaccgagggggagtcatggcagtgtgggggggtgtgggtgaggggaggacacctcaggagatcgtacagtcaaagccttgggcagagaagggcccagggaagccccagaggagctgcagatgcaggggacagggctgggacccagatatggagaccaggaagcagctggggttggaggggcaagaggtcaatgtgagcaggcctgggaggagtctgggggcagaggaaggctgcagaagggtgacccgaggagcctgtgtgtcccaagggcttagctagggaaaatggttgtagggggcttaggctgggtaagacttgtttgtggtccaaggcctgaagcccccatgccctagcctggctggggacagcaggttggtagagagccaagctctgtgccctgatcagcctgtcagcccctctagggcaggatgtggcctcagcaagggcctcctggtctggtcctgtgccctgggcctggcactttgctggggccccagctatgaccagccagcttaggccaagccttgacgctggggtttccagcagcagctggtggcccagtctaagatggaaggtggtgagctggggtgggagctggtttgtagagaaaggctgctgccaaggtaagctctccatagtgcctgctgcctaagagggtggagggggtggggtgtttagaactcagctgctctggcctgtgagagagacgcccactcccttccctagatacctagcctggcctggctcagaggaaatgcctgaggaatattactccccttcccctggaaaagcataacgagccccaattctgtgccaggcccactgctggaggttagggagacagataggacccgggccgttggcccttccctggcagtgagtacaaagccatgcctccaggacagaattgggatatggtgtcagagacactcaaggcagggagcatcctcttcctggaagaggaggtgtttggccagactctgagatgtcagcagggaagggtgttctgaatagaaggcaaaggtcaggtagagggctggtggtatggaccagcaggaaggaccccagaggcactcagggttcatgcagggaggggaaccctgccatgattgggcccaggttacgaccgctcgagaggctgccaaccctcctgagagctgacagctgagtttgccccttacctggagaccagggtgctggctttccttgtctggatcccaggtgggtacaggaagacatatttgttcatccaaaggctagaggtcccacaagagccaagccttggcctcatcctgggcctggagcctaataccccagttttatagatgaggaaactgaggcctagagactggaagaaacttgcccacagtcacacaggaactcagtgacagaacaggtgttctgtcatccaagttagcatccaagccaagagtcaagcagccccaacagattcctggaggcattgggaggatgacttaggttttcttgggctcctcatgagatctagcccttccccggcctcactcaccttgctgggcacctacacctggtgatcttgggaagtcctgcccacccaggcctcagcattcttatccataacgagctgggatcagatagtcccagctccacaaaacatgctactttgctcgtagctcaaagtttttcactgtgactgagcctttggagggccaggagccctggggtttcaaaatctagggtgtaggtgagcccctggccaggggagattggagtcgggtgggaagagcagcctggggagctcagcaagccttcaagttcaatggaaaggtcttggccacaggctggctggcgtggccaaggacagctctgtaacattgctggagcttgtgatctgaaggttggcaacagtgtttgaactcagggcagaggcagagggctgtgggtgggtggggagcaggagaagagcgccaagatgtgaaggtggaatgtggctggcctggctgcagtggggctgcagtggggcaggcgggacctggcagtggaggccctggggtgctttaccaccaagaggctgaggggcttctgggcgtgatctatgaagaccacaccctgcagagaccagcgagaggcactcagatgtgggcagggcttaggctgtgctgaagagagagccagagaggaaacctccaaccctcgtcaggcccagaggtgcccctgcaagaggagcaagtcctcccaccagccacctagagctgagccccagctcccttctaccccaaaccaggaggttgcacaattttggtttgagaggaggaccaggaggctgatgggagtcacagttgttgactcagtggctgatgggaattgtgttctacactcctccaaggactgatgggagttatagttctcaccttttgggggctgatgggaattgcagtttctgcccaagggactccagttatcagacctagagatggggagacccattctcccctcacaaagccctcccctctcattcccatgggccctatttagcaggtgcttccctcccagatggctgtgtatgtattttcttttctttttttgctttcttcttctttccgttgttttgttattgttttaactataataagagggccagaggcagtcaagccctggccaggtcctggcggcccatgggggttctggggagggggaggggggaagtcagtgggggtcagaggtggagggtgaagaatgagaaagttggggagttaggcttagctcaggaaccatgtgtccctgcccactcccctccttcctttgccctccctaactcctgcctctacatggttctctccaccctcccagagtcctacgggacaggaccctgctccagtggtatccaactcctccctgcccactcttcctcatgggccacctcacctcccactttcgatgtctcgcctcccgtggccaccctgcaattagctttccaagccccctcccgtggccgtcccctcccaagacctctcacccatgtagcaatccctacatggctgcctgtcatgtccctactctctaagccctcctgcccactgttcctccctccccgacatgctgacaccaagtggtggaaaccacccctcagccccagcctgccctgtgcagagttcagctttgtgttgaatgagggggagagggacaagtgagggcggagagagagttcaggaggaggcaggatgcgcagggagcagagagtgagggagggagataccgaacagatagacagaaaacgttgtacggaaaagttgttttttcttattttttttccgggagaacccgcttacacagctctgtttgtaatttttttcttcatgctaaaatcacacggcctatttgttgatgtaagttgcctgaattccgtggtatgctatcttcttttttaaaaacaaaagcaaaaaaaaaaaaaaaaagcaaaaaaagagaaaaatctagaaaaaaaaccctaaaagatattgttgttaggtttgtttaaatgctgctgttgtatctgtttttaaagccttaaaccagtagagtttttttttctgtttcttttcaatttcctttcctttctgttccttttgatttcttaagacaaacaaaagaccaaaacccagagagtcacagagcccgtgcgtggggtgcccagggcatctgagccgctgcccgcttaaagcgcagtgctcggccggctggcgggcgggcccagcccgctctagtctccgccaaagccaattggaaccgatttgggtgtgtgaggctgttgtttctctctctgtgccggccgcctgcgccctggccctcgctgacgccctctcttttctcttctctctcttgttctaggaggagagttaatattgcccattatcacggaggactccttagacccccctcccgtggccacccgatcccccttcgtgcccccgccccctaccttctaccccttcctcacgggagtgggcgccacccaagacacgctgcccccgcccgccgcgcgccgcccgccctctgggggcccgtgccaggccgagcgggacgacagcgactgcgaggagcccatcgaggcctcgggcttcgcctccggggaggtctttgactccagcctcccccccacggacgacgaggacttttacaccacctttcccctggtcacggaccgcaccaccctcctgtcaccccgcaaacccgctccccggcccaacctcaggacagatggggccacgggcgcccctggggtgctgtttgccccctccgccccggcccccaacctgccggcgggcaaaatgaaccaccgagacccgcttcagcccttgctggagaacccgcccttggggcccggggcccccacgtcctttgagccgcggaggccccctcccctgcgccccggcgtgacctcagcccccggcttcccccatctgcccacagccaaccccacagggcctggggagcggggcccgccgggcgcagtggaggtgatccgggagtccagcagcaccacgggcatggtggtgggcattgtggcggcggcggcgctctgcatcctcatcctcctctacgccatgtataagtaccgcaatcgtgatgagggctcctaccaggtggaccagagccgaaactacatcagtaactcggcccagagcaatggggcggtggtgaaagagaaggccccggctgcccccaagacgcccagcaaggccaagaagaacaaagacaaggagtattatgtctgagcccccggcactgcgccccactgccagctgcccctcctgggagggcccgggaggagggtgccaccctctccctgccaggggcctggggaccctctccctggctgcctcaggcttctcttacgaagaggaaacgcaaaaaaagaaaaggaaaaaccccgtgctcgcccccttcctcctgccgtccactgcgcggcctcgtcagtcccggggctgactgtccctctcagctctgcgcctgccaggcagggcacgtgctcacagccctgggttgatttatttttttaagggggtagttttattttggtggggttgggtgggaaggaaggctgggggttttgtaaagtgtccactgctcgtcctgttaattttcctcaatttttcttcttcttccttctgtccctcctgccttccttctcttcccaagccctccaatccccatcccaggcttgctgtgtctcactgtccccaccctccttccctacttctttttttgtgtgtctggtttctcccttcctttcctccctttgggtttccagagtcggtgggagaagggcgggagggtgggcccgagtggcccagtgggtgggtggggtggggtggggcaagtgccccaactcccctcaccaggagaggcacctgcttggtgccgcccagggaaggggctcaggcctgacggaaggcctgttctgtgtgtgccgccgggcgacgtgcattgatggggaagctgctggaggagcaggggtggggggtgggagggaggggaaaggcaaatgcagatatatattacagacaaatactctagattccacgagcagcagcctgtggcacccgctgggcgcgggcagcagggaagagggagcaaggcattgtccacagactgctggggtcacttctttgcccacgggctccctgctcccccagttttttttctctctttgttaacaaatgtgtctgagtcttggaaaacaccccaaccccggaaatgtgtgggaaaaagaaaacaaaaactttccaaattccaacggtcctgtgcagtttttttgggggtgggtgctgttagatcctggcttttggctggggtctgggcccacatgggggcccacaagagctggtaagttgctcccgaacttttgggttgagtgtggctttgggttcctgggataacttgtctttgtctcacagtgtcctgtatccctgctgggctgaggaacgggcgggaaacatggctggtctctggccggttcacagaccttagcttctcagaaaggcagacagatccctggagaccttgtgttgccccctgatggctactggatccacacctcggggcatgtgtgcccgggcacagacctgggtgcgggacagatgctgcctcatccttcagcagcccttggagggaggaggtcattcctgggcttggagaccttcagtggctgctcccaggtctcgaggtgaatgagtgactgagtcccagtggtctcctgctctgcctgactctagagtctgtgctccttccccttcctctctagggatttggaccctggtaccctaccttcccccaagtccactctgcttgactgggcagctgctgggactgaaggtggaaccagggccagccacctcgtccaccgttgtttactcctctgtggagaccctaacaggtccatggtccggagatgctaagagatggatctgtatttgttaagcctctcagtcgcaagggacagataaccacgtgtacagcattgtcaggagaggagagcgaggagggttgcggacctcaaggatggcagtggtggggcgttgcaccacctggctcatgagacatgactcagccatgctgtgtcactcagggtccccccctcgatcggcttctcagccctcccctccgccaggcttcctcacacccttggcttgccatcccctccactgcccgattctgcatcttgattttctgtctgcagggggctctggctgttggccagctcatcctcgaggcattttgctgttcaaaagcctggtccatctttaggcctggctgcctccatgcctgcaggagccccacccttcagctggggaacatcccttagtgggagtggcaggtcctgacctgagcagcctccagctatctccagaggccaaggtcagcctcatctccttctcttccttctctccatccctgaaggaggcttttgtcttgggaccctccccaccatggtgcctctcaggacctcttgagattcctcctgcaaaatcctaacaagggtgagagagcagagctccaggtgtggatttctatggactcagcctctccttgcccttctgatccagctcctgaggggtgaggctccggccctgcttgtcccccaactgct

SEQ ID NO: 13686 - DNA, 18235 bp, Human
tggggagtgatggcatgacaaagacggaaagaagccacagaaaaggtagttggagaaagttaaaaatttcccagtaaaaatgttcctgagagcaagcgccctgggtgcaagaggggagagtagctgggaaaggatggaatgaacttggccttccctgcctgtaagatgtggatggtctatggggatcgggtcctcagtggcaggaacataaagtcttgcaggaaataggggtcaatgcaaagaaggtgtgtgtggccaaagcaggctgccacgattgggctgtgaggtgacggcatggttaacaagctactgcctgcctggcagtggactgccaagaagtctcagctctactcacagcaaccctccaagggacaagtgcgggctgtgaagaaccttggatgccaggccaagctggagtccaagctgtgcttagtggaggatggggatgaggcccaggagctgaggctggggtgcaaactgtgaaaggggaagagaccagacagctgccagcattgtttttttgtttgtttttgagacagagtctcgctgtgtcgcccaggctggtgtgcagtggcgtgatctcggctcactgcaacctctgcctcccgggctcaagtgattctcctgcctcagcctcccgagtagctaggattacaggcatgtgccaccatgcttggctaatatttgtatttttagtagagacggggtttcgccatgttgatcaggctggtctcgaactcctgacctcaggtgatccacccacctcggcctcaaagtgctaggattacaggcgtgagccaccgcgcccggccagcattgttttttaatggtttatgaaacacttcttaagagaaattggaaattaacagaaaaatgtaaggaaaagttgtttgcatccccgtgtctgtggaggtgtattttggtgtttttttcccgatcttttttctctacttggaaatgtggcaggcaccacagaagacagtgtgcccgtgccttttgggggcaggggtagagcagggcttgggagcctggagacctctgtaggacttgaagtttggcccacatactaagccggtgattccagggctgggtctgccatggctcagaaagtgatcggaggccgggcgctgtggctcatgcctgtaatcccagcattttgggaggccaaggtgggcggatcacctcaggtcaggagttccagaccagcctggtccaacatggtgaaaccccgtctctactaaaaatacaaaacttagctgggcatggtggtgggtgcctgtaatcccagctactcaggaggctgaggcagaattgcttgagcccaggaggcggaggttgcagtgagctgagatcatgccattgcactctagcctgggcgacaagaatgaaactctacctcaaaaaaaaaaaaaaaaaagttctcagaaacagcttggctttctccgaaccaggctctcaatagtatcctgcagctgtccaggcttttgacctgcttccttggccttcagaacagaacacccagctcttcccctccaccggcccaccacccgggaggcccaaacagcctttgaactagcacaaggtcctggttcctttctcttaaagaacagcaggatccgaagcctgccctcacaagatgaggaggcagcagctgagaggcagggatttttttttttctcattggagagtctaaatttggtgaaggaatccaaagctcagaaaggtaaagcaaccagcttgaggtcacacagcaagtcagtgctggggccagaacacagcagtgaatgggaggatagccaaagcctccagggaagggctcaaagctgtggggctatgcacacaaatggggtgaggtcctcgaggtacagattaggcacccattttataggccaggtcacagagctggtttacaaaatcctgctcagagtgtggccccaggtggcaggaagaagtgaaagaaggcctctaatcacttcctaagcagtggaatcacagggagaacttactgtcattaaaccagtatgatgatggagtggggaatgcctcagtttctcccaccgccgagggcctataggactacagttcccagggccccgtgctgcaggctagcggcctcccgccaatgctggccagtaacctgagcatccctctccaaaaggtcacttcagggctccttgagggacagcaacagggggagcctagagctgctcagcttcggtgggggtggagtgagggctgtggccctgcctcacacaacctccctcacaccacccctgcaatgcagggtcgtgggcccctttctcaaagacatccagtggcctctgctagttgcacctcttccgtcaggggacactgacttggctcctgcaccacagcctgcagggggtcctggttccttttgccacaacacatggcctcccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaaggtgctgctggggagcctggggtgggggtatgggctgaaggcgctgccagggagctggcgatcttgacttaagtggctgcccctcgtcactctaggttcttgggggtggagaatccaggggtgccaggcacaaggggtgctgggacaatctgagggagaaacctggggcaggagtgggggtcagggagctcagagcaggtgggctggctgcaaagggtcagtgcccactcggagaaggttggagtgggtgctggtgggcaggacggcgcctgtggcctggctgggcccaggtggaaggacacatcagttgctgcatgtatgcgcggtgtgcctgtgcagcaggcggggctggggcagctggggcggcagagatcaagtgtccggtggggtcactggtaaatgtcagcaacctgacacgcctcggtggggagtgggggaggggcgggcagacggcccaggaggggacccaggaaactgggagaccaggcactggcagcatcctagtttctggtgcctctgggtctccttgggattgaggcttgagggccaaggggaactggacagtgcaaggatgggaggtgacagtctctagcccagtctctagccactgtgtgaccttgagcaaatgacttttttctctgggccttggccttgccctcctggggagctcttggaggcgcttccacatgtcctggcatcctgctgggctgtgcgggggggtgtgtgcagggggaaggggtgcccattctcccgagtacctcagtccctgaagtgggtatggccagcgctatttcccagatgaggagactgaggccaaagagagtgatttgtccaaagtcagaggaatgctgggaccagaaccttaaccgctgggccccaaagcctgagacagggagaaacaaattggggacagggatgggactgctgagcagggcaggcgggccagaggtccaggcgtggctgggcctggctgagtgttggtgtgtggccctgaccccattccctgcccatccgtctctctgggcagaggatctactacctgtctttagagttctatatgggacggacgctacagaacaccatggtgaacctggccttagagaatgcctgtgacgaggccacctaccaggtgtgtgtggggtggggcaagccgtggggactgggggattccactgctgacacttgaccctgaccactgtcaccctcactcctccagctgggcctggacatggaggagctggaggaaattgaggaggatgcggggctgggcaacgggggcctgggccggctggcaggtaagaagacagggccgtgagggtggagtgggccgatggggtcctccttgctgggtccctgacagccacctccctgcacacccccagcctgctttcttgactccatggcaacactgggcctggccgcctatggctacgggattcgctatgagtttgggatttttaaccagaagatctccgggggctggcaggtgagcagccttggctctaacttgtggggtctagtcaggatggggaagacccccacttgtttatcatctctggaaaggtccgaaacagccccgcaagctctgtggaaagcatccttgctgctccccaccccccgacccaaagccagctggtgcccctgaaacaggtggtccgtgtcccactcgatagcccagcagaccaggggcccacctcagagctcctgacttatacttggtgtagggtacaccggcccacagcccccaccctgccccaccgtgcactgtgagtgcctgtactgatactgctggcctttctccctgacctgccttgggtgcagatggaggaggccgatgactggcttcgctacggcaacccctgggagaaggcccggcccgagttcacgctacctgtgcacttctacggccatgtggagcacaccagccagggtgccaagtgggtggacacacaggtgaggatgaagctgggggtcaggggagcccagagaaggggagggaagagaaggaagcccagagaggaagcaggacccagtgtattttacacctgaggatgctgaggctcagagaggttaagtgacttactcaaagtcacacagctgaagccaggagagactggagacagggacacaggggagccagcctaagtgcagagtctggaaggggagagaggctgccctgctcccccagtgtctccccatgacctggctccactccacaccatgagatttatcaaaggaccatcttggcgacttgagtctgccctgaacatctcgacagcagcagcccagaaacggggacaggagaaaactggagccttccgaaaggaattcactcatcacacagcaagttagagggatcctaaaaccaaaccaaatctagacacagtggctcatgcccgtaatcccagcactttagaaggccgaggtgacagtatggcttgagttcaggatttcaagaccagcctgggcaacatagagagaccctgtctctacaaaaaataaaaaaaatagactggggcagtgggtcatacctgtaatcccagcactttgggaggccaaggtgagcagattgcttgagctcaggagttcgagaccagcctggacaagagggcgaaaccccgtctacaaaaaatacaaaaattagccaggcgtgatggtgtgcgcctgtagtcccagctactcgggtggctgaagtgggagaactgcttgagcccaggagcctgggtgacagagccagacctcgtctcaaaaaaaaaatttaaaaaattagccagggtgctggtgcatgcctgtagtcccagctactctgaggcttcagtgggaggatcacttgagtccaggatttaaaggctgcagtgagctatgattgtacaactgcactccagccagcctgtgtgacagagtgagactgtttcaaaaagcaaaaagaccaaaaactgaaaaccttaaaaccaaaccaggtgtacaaatcccagtttaggccgggcgtggtgacttacacctgtaatctcagcactttgggaggccaaggcaggtggatcacctgaggtcaggagttcaagactagcctgaccaatatggtgaaacccagtctctactaaaaacacaaaaacattagccgggcatggtggcacgtgcctgtaatcccagccactcaggaggctgaagccagagaatcgcttgaatccaggaggtggaggttacagtgagccaagatagtgccactgcactccagcctgggtaacagagtgaggtcccatctcaaaaacaaacaaacaaaaaacaaatcccagttcaggcaatcttcctgctgaagcttcaggtcatcagcccccagatgggctgcagataaaccactaggctttcagaactgagcatttgtttgttgtcctccaggttaagatgcagtgggggctgctggcagtccatgccaggtgcacgtggcaactggcacaagtggctgtggctggaaggcaggagacctggctccctctggtgctgccagcctggctgtgtgctcggggatgggtcccttccctctctctgtgtcaactcccaccctgcaccaatcagggtgactgaatgtggggagggagggcgatgccccttaaaagggctcgcttagaggagtgaatgtacccctggcaccgtggtagcagacaattattgatgtttgctagttatggaaggcggggcagaattagtcaccgtgaattagccctgtggtcaaccagagatgagacctttggatggacttgacctctgtgaccccttcagcctggccctgggttcccccagccctctcatgagtccacagtgtcctctagcttttgctcaggccaggctggccagcccagcccccattgctgcagagtggtcgccaacagagcccctcctgggttccgggcttatcacctgcctccttccattttcctcaccaccgtctgcccaggcagggcttatgggtgtcggggaggtgttgagggtgtctttgctctagatgcggtccagagagactatggggtttgctcatggttacccagctcatcgatgctagacaaggacaagagcctgggtctgcagagtgcagggataaagccttgagtcccagccctgaggggagggaggcaattgccagggctggccagctcctgacaggattgccccccgcaggtggtactggccatgccctacgatacgcccgtgcctggctatcgcaacaatgttgtcaacaccatgcgcctctggtctgccaaggctcccaatgacttcaacctcaaggactgtgagttcatccactggtagccagcaaccccagcttgcccgccggccacgcccagcgcaggccttaccctgtccccacttttgtccctcagtcaatgtcggtggctacatccaggctgtgttggaccgaaacctggcggagaacatctctcgtgtcctgtaccccaatgataatgtgcgtcaccccctgggctgggggctggaagcctgagtccttggcagcaggggtcagggagagctggggaaggacacttgctggtgccctagtcacacccagggcatattgctggccttgtgcatcctgtgcccccacctcaagtcttttgagtgcaaggacacctgagtcctgaggaaactgggttagcgaagggcactttggaggggctgttccctggcgacacccacaacacactcggttcttgtacccctcttcctgacactgtctctcgccactagttcttggtggaggaaaggcccctgggtcccagagagggggccggctcagggctcaggggtcccggtatgggtgggagtccctcctggccacacccaccgcagctttaggccatgcccccaccgccctgactcacgctgcctcatgctgtccccagttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtaccatgcgtgtggagggcgactctgtgaccggacagtgtgtgctaggcctctccctccagcctcggcctgcctgccccatgtaatagataagggagcggagactgggagtgtgggagggtcagttgttcaggattcacaatccacaggctcagaacctgggcttccctcctcctcccgccccactccccccattcctcccacccccatgagcaccggcctgcctctgcccacagcccagtcacagaaccgtgctgggctctctgggggcctccaaatggcatagggcagtgaccatagcatggaatgtggtttggagcccagactgacccctccccctaccccaggtggccatccagctcaatgacacccacccctccctggccatccccgagctgatgaggatcctggtggacctggaacggatggactgggacaaggtgggcttcagggcccctctgccccatctgatgctctctgcctcggggttcccttcccagtttgggagcgtgggaggatatgaatggagtgaagggatcagagcctgaggccagagggaccgtcctggaacctggcactgcagtgggggggcccactgggatgcgtagtgtgtgaggagacccactgggctgaggtcagcatcctgactgcccaccccgtgtgccaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaacgtgagtccggaggcttgggggatggtgtgggggtgaggggggacacccagtctgggcctgggagtcggggcgtccagccagggccctgagactctggggcagtgggggcactgggcagagctctgggggtgtggggctggggactggggatgggggttcctgggtctggttctagctctgggctctctgggcacagcgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatgtgagccccgctttccagatcccgcccctctctaggccccacccactcaacgcctctgtcacacagaagccccgcccttcaccgaccactctctggtctctgggccctggcgcctttcacaggtggcgtcattcttacaagcacagcagccccttccagtgccgccctgtcctgagatgacctcctcttacacacagcacccccaaccttccccaggtctgcattccctgccccaggcccctttcagcaagacaccagggtaggggccccagggcagaggccttcattgtacaggggtgagtggtgaccctcgtccaacctcatcctgcagcttcaaagacttctatgagctggagcctcataagttccagaataagaccaacggcatcacccctcggcgctggctggttctgtgtaaccccgggctggcagaggtcattgctgaggtgagaggccaccgtagggccagtagagtcaacatgggtccctgcagggatcagctgggtatggtcgtgtaggtggttcactgcatcagggctcccagctgaaggctgaaatccctcctgcactgtgttccccaagcctcgcatccacctggaggagggacaccatcttatttgcatgagggtgctctgtgtgctaatggaggccctggctgtggaggtgaacacagcagagggagtcatccatgggtcacatctgaagtgagcctggaagggggcagatatctggtagggaaggcgcaaggtcatgctggcgttaggaaaaggccaggaagccaggaaggcctgctggggtcaggtggggtcagccatcagagctcaaggacgggaggggaggaaggtgcatggatgccccgtgccccatctgggcggctggaggaggaggggctgggagggcccccagagcagcctgctgggtgaagggggcttggctgacctggaaatggccccttctgtgttgggaggagggaggacatggggatgggcttggctgagagccgtcttcccatagcgcatcggggaggacttcatctctgacctggaccagctgcgcaaactgctctcctttgtggatgatgaagctttcattcgggatgtggccaaagtgaagcaggtggggagagatgcaatgtgggacagctgtgctgtgtggagagcgctggaggggccagatgtctgggtcaggcgtggcaaatagagctcatctctcctgccagcccaggccgttggtggaagttgcctggagtctgtggtgggaaggcatcatctgacctcacatgaacagtgctgacattgattagcaatgtctgccctggtacaggagtggacagaagtagccagtgagcctcctggtagccatcctcctggggctgactggagtgtggactgtaggatttcctgaggctgtggcctgttggtgagcccttccccgtctctgcctccaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgtgagtggcagccactctaccctgtctctcagtgctcccccgtgttcctgcggcatagtacatattgcccaaccaacatctcctttggacttgggactactcttgggacatggaattatccccatttcacagatgggcaaactgaggctaagagagcatagcaagtgattgttcgagtcaggcctacggtgtcccagcccagcctctgtcaggagctactacccagagggaaaggtaggcccactggatccctctcgtttctccacaggcatcaagagggagcccaataagttttttgtgcctcggactgtgatgattggagggaaggtgagaagccaggctccagccctgggctcccgtcctttgatatatccaggttgaggtcagcccagctgagttgcaggatagggggtggggggccaggcagtagagctgaccccagactttgtcccctcaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaaggtgggtgctgccaacagggaccctagggaggctctgactagttcagtctcaggaagaggtatcagtcgtctcttcctgggatacttgtacttgaaagaagaatctggagagggcaatgcttaaaccatgaggaggccaggcgcagtggcccatgcctgtaatcccagcactttgggaggccaaggtgggtggatcacctgaggtcaggagttcgagaccagcctggccaacatggtgaaaccccgtctctactaaaaatacaaaaattagctgggcgtgatggcaggtgcctataatcccagctacttgggaggctgaagcaggagaatcacttgaacctgggaggcggaggttgcagtgagccgagatcacgccattgcacttcagcctgggcaacaaaagcaaaactccgtctcaaaaaacaagaggaaacaaaacaaagcaaaaaccccatgaggatgccctctaatggtggaatttcaggcagtacagggtgaaattaccttcaaatctgcaacagaggtggggaaatccaggttggacctagatggtcaagaatcaacaagaggtagagggcagtgggggtgcggtgtgagagggaggcttggctggtgaagactgggagtttggggtggggcgactctgagtccagctatgcctggggccagcctaatctgagagtccccagctggtgtgagggtcttccctgagttgacttgtccccctgctgccaccccacagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtatgggggtcagggttcacgggcaaaagacacccaggtgtggctgctggagagtggtgctgggagcaagcggcacgtctggaaagactggtccaggcccagcaaggtcttggtcatggccagcaggattctgggaaactttagagggcgcttacagcaaataaggttaatgaaattggaaaagaaagaagtaatatagaactgaaggaaaaggaagagaatattatatcaaccctaagagataatattgtttgggaaatggaagtaaaaaaatccttgctctacgccgggtgcggtggctcacacctgtaatcccagcactttgggaggccaaggcgggcggatcacaaggtcaagagatccagaccatcctggctaacacggtgaaaccccatctctactaaaaatacaaaaaattagccgggcgtgttggcaggcgcctgtagtcccagctgatcgggaggctgaggcaggagaatggtgtgaatccaggaggcggagcttgcagtgagccgagatcgcgccactgcgctccagcctgggtaacagagtgagactctgcctcaaaaaaaaaaaaaaaaaatccttgctccctgaaagccatgggcaaaagggaaatatgggcacagtagttacaaggggcctatggtcagaaacagttcttcagagaagacattatcctggcattacattaaaaaattttattttattttattttaatgtatttttttttttgagacggagtctcgctctgtcacccaggctggagtgcagtggcgcgatcttggctcactgcaagcttcgcctcccgggttcacaccattctcctgcctctacctcccgagtagctgggactacaggcacctgctgccacgcctggctaattttttgcatttttagtagagacggggtttcaccatgttagccaggatggtctcgatctgctgacctcgtgatctgcctgcctcggcctcccaaagtgctgggattacaggcgtgagccactgcgcccggccttttgttttgttttgagatggagtcttgctctgtcacccaggccgcagtgcaatggcacgatcttggctcaccgcaacctccaccgcccgggtacaagcgattctcctgcctcagcctcctgagtagctgggattacagatacccaccaccacgcccagctaatttttgtatttttagtagagacggggtttcatcattttggccaggatggtctctatctcctgacctcaggtgatccaccctcctcggcctcccaagtgctgggcttacaggggtgagccactgcgcctggcctatttatttttatgtttttgagacagagtcactctgtcacctaggctggagtgcaatggcatgattttggctcactgcaacctccgcctcccaggttcaagtgattctctcacctcagcctcccgagtagctgggattacaggcacccaccatcacgcccaggtaatttttgtatttttgtagagatggggtttcatcatgttggccaggctggtcttgaactcctgacctcaagtaatccacccgcctcggcctcccaaagtgctgggtttacaggcgtgagccaccgcgccctgcttgaatcctgatatcttagcattggagagagattttccatgttattagtcttcaaaaatattttaaatgtttgtataacattccatcctatgagcatgtcacaacttatttaatcaattccatgtggctggacactaaggttaatttccggtttgttaaatattactgtgatgagcaaccttttaatgtctacgtccacatctgatgatttccttaagataattatcagaagggtgatatttctgagttaaaaagtatgagttcttaaggctcttgatacagattgccaaactgctttccagaaagtttctcccagtttacactcccacaacagcttcccagagttggcattaaacactgaaagaagtgtctcctgtgaggcttcactagaaagctggctgtcccatgggcaggagggagctgtgagatgttgtgagcatggtcccgcatgctcagaacgaggcctggaagaaccctctggctgcaggatggagacagtgctggagggggcaggtgggggaccactgtgggggctgacaccataatgcagggagagttgcctgagagtcgcacaagggactagagagtcgcacgagggattagagattttgtggggagcgctggtttctggttggaacggttaggttttgagactggcctgtggagcgctttgagccgtggtgggggcgctgagggtcagctgaagggttatctttttttttttttttgagatggagtcttgctctgttgcccaggctggagtgcaatggcatgatctcggttcactgcaacctccgcctcccgggttcaagtgattcttccacctcagcctcccgaggagctgggattacaggcacacgacaccatgcccggctactttttgtatttttgtagagactgggtttcaccatgttggccaggttggtcttgaactcctgacctcctcagatgatccgcccacctcggcctcccaaagtgctgggattacaggcgtgagccaccatgcctggcccagttgaagggttgtacctgttagctgctcttgctgccccagggcaaggccggatatggacttgggctactggaggagaaaagccattttggagcaaacaaactggttaagagacagcagtggcgtgtgggagaaaagagcttgtttgggggccttggctctaacacttagctttctgtatcctccgggcctcagtttcttcattcacaaaggagggatgaaaagctgagcagagaaggggagttgcagggaggccctgcaggggcgatgtggcagccctggggagcagcaggctggacctgggttttgaccctggggcatgggacttctcagcttttctctggaagaggagccaggaacccctttccggggagctgaccacagctctgtcctggcaggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtgagctggttggcccgggaatcactcaggtggggccgcagggcagatcgaggctcaggtgtgtggtggggaagccggacgcgggtcctggtagttggagccaggcgcctttggaagcagcatgaccctctaggtccccggctgtccactgggacagggcaggcttggcccttgacctcatagaacttatcctagccccctaaaggaatagcacatgcctatcctttcccctccaggtttaaagtcttcgcagattatgaagactacattaaatgccaggagaaagtcagcgccttgtacaaggtgaggggtcctgggccaggggttggcagggctttggtggccctggttgggatgaggcagaaggtggagatcctgccagcagagtgaaccagagcttccctttgacctgcagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctccttactcctctttgttgggaaatatttttagctcttggcgggctcaacagcagccgcgcagtcacccccttatcctccaccctcggcaggtgcgtcccacggcgggacggtgatgggaggtggagggggcgacccgtgggggcggggcctaggcctctccagcccctttcctggcgtcaccctccacgcctctcttcccagtgccgtgtccatactaggtcagcggccagcctcgctggccgggggcggggcgtctgcctgggtggggcccaccggggctgggagccgggacttgggctgaggcttcccggaccacggaggatccgcgctgtcgagggcaggacccaggagggggaggaagcagaggatgctcggcgccttcttggctccgcccttagccccgccctactgcggcgtttaagggtctcttagcaggtggctacactggatccaaagtcgggggagtgttacggcagggaacactcgcagaccgcctagtctaggccctcattatggggaaactgaggaacagaaaggtcctgtttctaagtcttacattaccaagactgaggtgcgggggcggtcctggatcccccgccccaaggctgggaggggcacgcctcggaagggaggtttggggtcggtggtttcacagtgagtgtgtctgaagccaaatggtcggaaaccgttacccgctctcctaggcccggctagtggggaccccaaccgcctgcggctgcccctcccaagttcctccctgttggccaggcatccaggtctccagtctccgagctgcggagaacccaccgccacatgcggctgcccctttccattcgaccctgtggggagccaggcttccggggccccgttcctcctgtgtgaactgggccccccgcccccattcccagacatcaaggccgcgtctccagatagccacgatttcattcctcgctccccacaggtccctctccccaaaatattcccatcttgtcctagcccatcccccagactatctcaaggaccagctgtccccacgcccccgacctccactaggcctgtgccacccgctgcctgcaggaagacgcccggtcccgggccgggttagccccatgggaacggtttgtctcgaaaacaggaacccgagctgggggctgggcggggcgccccttccccaccgcagtccgcttcctgcccctcccggcttcctccgcccgacacccaggcagggcggggggcactggggcgtccgcggttgggggaggggctcttcgtttcggtcccccctccgcgtcccgggcggcggggcctccggtcgcccgccctcggggcagctagtggcgcagccccccgcccgcggccctggcctcccgggcggcgcggcaggggaggggttaagctgccgcagggaccgccgcgtgcggggcgagagggagcccccggtgggggtggcgcagccggcggtgcggagctccgcgcaggggcggaggggggagggggcagcctggcgcgggggcgggggcggggcggcggggagcggggccgcggcgtggagagcgggcgggagccgcagccgcagcgaggccggcgggcgggagcgcacggaggtggggtcggccaggccggtgcgggctccttgcggcaggtcccaagagtgagtgggcgagcgcgggcggggcgccaggcgaaggagggcgcggcccccagcgactccccccccgcccagggcggcgcgggcgggctgggggcggcgagcgggtggggagtctgcggcccgggtctgggagagggggcagcggccacgagagctaaggcgcgctggatccccggagggcggag

SEQ ID NO: 13687 - DNA, 24509 bp, Human; identical to SEQ ID NO: 12612

SEQ ID NO: 13688 - DNA, 18558 bp, Human
ctccgttttcgggggctgtgtcccagctgcagagcctgaggctgggccaggggcgcggctacagggatggccgggtctgatgtttctgcagagccttgccctctcctcctgcacacgagattcagccgcacaaggcgcccctcctccaacgcacctgctgctctgtgggcggccacctcggcacccacctgagggcggggcccctccctggggaccgtgcgcctgggctcccctctggacgcctcttgggtctctgcggaggtaccagggaaggcgggggctgcaggcggacagagagtcctgaacggctcgctggggaacaagaccagagacgcgattttcaggctgcagacaccggctggcgcgatggagtaacccagatgtgctaggggtgcccctccttgcgccggatcccctagatgtgccccccacccctgcaggcagggagcgggcgcccaggctggagatgtggggagggaggtcagactgactccgggaccccccagtcgcactcagtgaccccggggtccccgtccccggctcaggcacgtctcgaaccccaggagaacaaggaaactttacccccgcccggggcccagcgcagcctccccgtccccctgggcgcgcggtccatccctgctcattctccctggcccttgctccctcctcccttttcactctccgttccccgcgggtgcgcgcgactgggcgaccgcgaggctccccatccccagccgcacaggctgcgctcgcacccgggctgagccaggcgaggagggagttgaccgccggcgaatgcggagggctgggaaaggggctttccgcggggtgtggggggttccgctgctatttcagggctggccccaaaagctcgaacttgagcagaggtggggccaccttcgcccttcccccatccatccagctaaatttccctgaagacccccatgcctgcttcctccggtttaggggatcagaggggtggcctctgcccttggcggccgccacccaccttttctgcaggaaggacaaggtcgcgggtggggactctgggctgggagtcaaggctcccaggggtgtagaactgacccctccccctccccgagtcctgtctgcgctctcaggccagcgggacccaccagggaggtggaggtctccccctccgcccagacccgccccttatggcagcgcccaggacaggcggggaatgcctcagatcctggggccccggacctggagcacagatggacctagggctgtgctcctccagagcgactcatcaggggcgttctgggtctgcccaacagcacggtcaggctggggtgcggagggggctggcacctcgttggggtctgcatctgaaacactcctcgggcatcaggggattgatgaaccaggggaggttccgtaggaagcgggcgcttgtgggggcccgatcctccttccccttcctccctcttcctgcctgggctggccccgctgccctgtactccctcctttgctgctgttacccccgagtgtcctctgactcgccagctgctagagacacagcccttccctggaagtcagtgtgacaggagacccaaagcagtcctcggcccatccgccgcctggttttgtggtgcggtcaaggtgctgggaaggcctccgtgggctgaggggcctgggaagcttccccgaggaaatcacaattacacccaggggtgggagagagccggaggccaagagagggcagcgcacgccacgcccggcacacacacacacacacacacagcacgcccggcacgcgcacgcccggcacacacacacacacacacacagcgcacgcccggcgcacacacacacacacacagcgcacgcccggcacacacacaggtcctggggtgggaagggctcatgtgaggagctgaaaggaagtggacgtgctgggcagggggctggggcagcctggagagctcctggacagctcccggctcctgtcccgcctgcacctgagccactggcctgcctctccccgcagccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggtaggtgagggcgtggccatcgtgcgctgtgactgaggtcgccctgcaaggagcacaggggtctgggtgggcagaggggacacagccatcaacactccccgtggctgtgagtgtccggcccgggctggtacgtcagaacgacagccaccagctctgccccgcctgagccccagccaagggttgattcagagcgtcccagccaggccctgccctttcctcccccttgacgtgggaacactccaagtggccaggttctcagtacagagcccaggcaccttcggaagcaaagaacagcaaaggccttgcttgggggtggcggggcacgctgtgacctcggagcaacagggacaaccggccggggcaggggccggggcaggagcaggcactgtggtgtcccggcagcaccccaaccttagctggccccagaggcccctcacccacagatctggaatgtggggtttgggggagtcttgggcgagttctgtttgtctgaagtatgtttcctttctggtggggggcccaggaggctgctgggaggaagcctactggtccagccaggcccctgcagcgtgggccagtgcacatggagccccaaggcagggataggaaccaggaggcttcgaggctgagagaactgagctgcgggaggctcggccttgtgctcggttgagatgcttggttacctacccaggcctgagccagactgtctgggggtctcggcggccctggaggggccgggtaaggggcagcagagacatttccacgtttcccagccaggctcagccactccaaatggggtgagaccatccctcagggtacctggctgggtgggggtgcatagcctgggggctgccaccatggaggagggcaggttgggcaggccatggtctctgggagctggcccacttgcgagtgggcagccaatggccagctgagctgcaggggctcgtcttccacactgaagtccgccagctccagccctgctgccaaatcccagctcgctggtccagggagggcacccccacatggggaggcatttgtatgctgtagaggcccagcccacaccttgccaggatgccaagcctgggtctgccgctgagggaggagccaccgggttgcgggagaatttcctctctttgggaggctggtgccgtgcgtgttgggtaaccctgggcctggggcctgtgaaacggggtgagagctgcttcactatcccaggctgagtgggccacaccccaggggcttttgggaggtgtggggagctgcagccacattcccgcggacaggctgctcagtggtggcagttgcccatgcagggcagcgcatggagactccagtcagccagccccgtccagggttggccacccagacctccagcctcagtgtcctggagctgcccctgagtggctcctgtggagtgtccctggcggaggcccagccagaagacaatgcgggttgcacaggcttggcaagcctgctgaggtttgcaaacacggctgcaaagtgatagctggcagaggcggccgctggcagctgcccaaggctctgggtctgccaccccccacctggctgcctacctgagcttctcagggctcaatccatggctccctacgccaccacagagtccccagtttgcccaggagacattgaggcctggagcacacccagaaccaagactcccagagctgcccacccctctctccaccctgcagccgactaaggacttacacgaacatgcacacgtgggtgctgacgctcctgggtgcccaaggccgagggccacgtgtgcacggaaggggctgcctgatgctcctgggtgctggcctaaggctgaggaccacgtgtatgtggaaggggctgccttgtgtctggcccactctgccgtcccaccaggggctggggattcacctgtgccccctttgcgggctcggatacttgttataggtgccatcaccagggtctgtcctggaggggagggcttgtgagctgcacgtgtgagctcaggccccaggactggctgcagaggagggtctggaagacccagtgcttttccaaccagcccaggccagtgctgagtggtggtgaaatgtgcagtgttgacctgccctccagcttcaagggcgactgagaatgacggctgcaagggggtagggcacgacactgggcaggagggccaggcctggccacgtgaagctggttctgaggaccctggagcttcctcagacacacggggatgaggtcctgtggggagatatggccctgcacggagacatggtctgtggggacgtggtctgtgggacgtggtcctgtggggacatggtcagtggagacgtggtcctgtggggacacggtccgtggagaacgtggtcctgtgggaatgtggtcctgtggggatgtggttctgtggggacgtggtccgtggagatgtggtcctgtgggttgtggtcctgtggggacgtggttctgtggggatgtggtccatggagatgtggtcggtggggacgtggtcctgtggggatgtggaaggaggtgggtggggtgggtcggaaggggctggggtgagtggcccagctgcacacagtgaccttgagtgacaggtcccacctgctcaggtcatgaggcacagtcctggaggggccaccctggccagcagtggaacccacttatgtgccaggggcagctttgctggctgtgtgtgcccacatgggggccttgtctgcagaggggctgcccccaagggccgggagggagcaaggcaggtgggcagaaggaggctccccatgcccgccacacctgtccttagctggggaagcctgtgaggccgccgactcctctccagtttcctgctggagatgtttgtggccttgtccccacatccctaggtcccctcagagtccccatcctgggctcggctgcctccagggacggggcactcaccccctccacaggtcgcccgtccaccatatcttgccctggccgtgtccttgtgccagtggctgtagatgaggaaacctagggccagagaaagacaccaaggggtcactggcccccttcctctctcggtgccctaggatgagaagaaccagatgatgaccacgaacgtatgggtgaagcaggtgagtgggagggcactgccctgccccacccctgccctcccccacacccctcaccctgctgccctgtcctggccctgccccaccctggccctgccccacccctgccctccctcacacccctcaccctgctgccccaccctggccctgtcccgcccctgccctccctcacacccctcaccctgctgccctgccctggccctgcccctgccccaccctggccctgtcccgcccctgccctcccccacacccctcaccctgcagcctccccccgccccacctcatccaggagtggcacgactacaagctgcgctgggacccagctgactatgagaatgtcacctccatccgcatcccctccgagctcatctggcggccggacatcgtcctctacaacaagtgagtcctctacaacaagtgagtcctctacagggccttggtgggcaggagtggccagggcctgcccctgcccagacagggagctccaccaaggcccagcctggcccagcggggcctatgccagccccatgcatgccagcccaggcccaggaaggaagaagcaggagcaatggagaaattggtgtgggttgaggagggaagggtccccccaggccagcaaagaggctgagggcatccctgggtctcagcactggagcgtcagagccggaggggcctgagagtggctatggcacctggacacagtgtccctgcctggaccagtcctgaggcctgggggctggctcctgacccgcgacgtctttgcccccacccttgacagctgcaggagagcccttttgggcaggagtgcttttcgccatcagaccccatcctggcctttctgggagaatagtgtggactgcagggtgccctggagaggggtgaggaagccccagatggttctcatgccactagggcctctgctttctctgcatactcacgctctgcccaggacatgtcacgccaggtccccagcaaacaaacaaagcctcgggctgggccaagcccatgtcaggctcctaggaggccaagatgaagtctggtcatggaaacgggttttctgtgcctggaagccagggcagcgttgccacggattggccgtggcagatggtggcctccggaggctgctgtcctctaacttgtccttcctgcagatctgtgccgagggccctgcgcccggcagccagcgctctctgagctgagtcctccagggatgatctctggccacaggctcagggtctgggtgtggcagggtcacagctcccacaaacaaagcaaatggaagctcttcctcctctcccgtcccagccatctgcccacagccctttccaggccccagggcacccgcctgacctacaaaccctgctgtatgattaagaacgattgggctcctcttccaactcaattgattccagtaatggcagcgggaagggcctccggcagtgggagggccggacgcttttccagagtgcattggggaggtggtcagtggtgagtgggcagcgggtggtcttcccttaggacagactccctgccccctgcaagccacccagccacctagctccccgccaccaggaccatgcaccgaatccgcctgtgtgactcgcatggacacatttcagggagaagtggaaacgcccaggatgggccgggcagagaagccgctctgggtgcctgtgcacagccctccaggaatgcagcccccaggaacgaagcctctgaggaccacagcccccactgtgacctcaaacccccaggaccacagccccccgagtactgcagccccccccacttccacagcctcaccaggaccacggccctccaaagactgcagcccccaccaggttcacagctcccccaggaccacagttcctctaggaccacagccccctaggaccacaggcccccaggaccacattccctgccaggaccacagtcctcccaggacttcatcccaccctagggctacagtgcctcctgcagaactgcagcccccacaaggatcacagttcttgcctgaccacagccccctaggactacaacacccctaggacagcagctcccccccaggaccacagccccctaggaccacagccccccaggactacagccccccaggaccacagccccatttaggaccacagccccctaggaccacagccccccaggaccacagcccccccaggaccacagccccccaggaccacaggcccccaggaccacattccctgccaggaccacagtcctcccaggacttcatcccaccctagggctacagtgcctcctgcagaactgcagcccccacaaggatcacagttcttgcctgaccacagccccctaggactacaacacccctaggaccgcagcccccccgccaggaccacagccccccaggaccacagacctcccaggaccgcagcccccccgagggtcacagccccctaggaccacagccccccaggaccacagccccccaggaccacagcccgctaggaccacagtccccccagaaccacagcccccccgagggtcacagccccctagaaccacagcccctccaggaccacagccccctctaggaccatagccccctaggaccgcagccccctaggactacagcccccccaggaccacagcctcctaggaccacagcccccccaggaccgcagcccccccaggaccacagcctcctaggactgcagccctcccaggaccacagccccctaggactacagcccctccaggaccacagccccctctaggaccacagccccctaggactgcagtccccccaggaccgcagcccccccaggaccacagcccctccaggaccatggccccctctaggaccacagccccccaggaccgcagccccccctaggaccacagcccccccaggaccacagcccccctaggaccacagccccctaggaccacagctcaggagagcagggattgctgccaccccatgttctcctgtgtctcctcctcaccatggcctgtgggatgtagtggggtgaccccagttttctctttggggctgggattgtcaccgaggctctctccggacaggacccagggttcctggagtggccgctggtgctgggtctgctcccgctgaggaggcctgtttctggggcagcaggtggctgtggctggtggccggccaggctgcagggtgggaggcctcggcccttctctgggatttggccacccccagttgggggccctgctgtccacttggggcaggtgcccagaaatccctgacctggactggggtcggggtggaggggacagagggtctcacgccagcctgtgggccctggagcaggaacctggacctgctggactgggcggctcctcagaccctgtctgctcccagggtgcagctttatggtgcgagtccagagccagctcacggccgggtggttcagcccaaacggggttctcctcaaaggctccccagagggcggctggagccaggggtgggcggggcagggagcagcagtgatgcagcccaggggtgctgtgggacctgggggctgggggacctggccctgaccttgtcccgtttcctgtggcgcgggcagaggaccctgggggaggggggccctgcccagagtggcgcagacctgcactgttccctgagcatggccctggcgttccctgtagagtgtgtgctgaacagagtagtcacccgcttgccatatgagaatcttttaatttgtgcctcagaaggtggagggcgttggtttttggagagatgggctggggagagggagcaaacttgagcctgattccacccagactgacttggtggtaaagccccgccccccgctggagggacgctcgggagccaggctgtgctgggccggagccgcattgagatgcagctggtggctcttgctgggtctccctccctctgcagctgagcggcagcccagccggcggtgttggctcaggaccagttcagaggggcagaggctcagcaccgactgagaccgtggggggccaggtctccacgacctggagggcagagctccagcagtggcggctccacaaagggagggtccctgagggttgggagggaggttgaggtgcaggtccagccctgggactcgggggcaggcacagaggaagctcagggaacagtcgccagctctgcccaagtacctggagaggccctggcctttgagcaggctctcagggaatgagacagaggagggatgggcaggggtccaggcagcttggcagaggtggagcaggaggtgtgtggctgggcagccgctccccccgacgcgtcgtgccccagcgccctccacagagctgagcctggccccatgcctgccaacgctggggatttaatggggcctcaggcttcccattggtggggacttctgtgggtgggggtggagggtcggctgctgcccccgtgagcctggctgcctcagccctgaatgtgctcctgcagtgcgtcccacccagccagccgctgtctatggaaccgggggctggggctgggagctctgcctaccgggaggagttcaagggacatcagcccctcgctccattgctctgttgcccacctgggcctgtggacagaacacccacgtcccccaaggcaaaagagagtccagagccagtggctcagacgtggccctggaactgggcagtgcgtatgcagccccactgcattggccctgggtggccagaacacctgtccttgcctctgtggcccctggtgtcctcatgctcacacactgggaggtggcctccaagtccttggggttaacggcagaagctgggtgaggaattcccatggtggcccggggtgctgcttggaggggcagggacatagggatgccgtgtgtcccaggaggtgacgctgggagactagccccatccatgcgccactcatggataagggtaatcaccagcagcagtgattatgtgtgtcaggcactcgtaggtcccttcccgttctctgaaccacgtgctacgcccagctcagggatgataaactgaggtgcacgagtaggtgagaagacgaacagtgtacccgggcaaggccgccagcccttttgtgctcctgtgacgtgagaatgcctctgtgtgtggacgtggacgtggacgtggacgtgggtgtggatgtgggcgtggacgtggacgtgggtgtggatgtgggcgtgggacatggatgtgggcgtggacgtggatgtgggcgtggacgtggatgtgggcgtggatgtgggtgtgggtgtggacgtgggcatgggtgtggcagtgggcgtgggtgtggacgtgggcatggatgtgggggtctcacacccttcgctctcttcctgcccagtgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggacgccgtgggcacctacaacaccaggaagtacgagtgctgcgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcaccctccctcaccgtccttctgcgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtaagtcccgcccatggctgtgttgggcgcctctgacccagacggaaccggcggacgccctttcttcctggtgtgtaatccaggagccgggcccaggcctcaggctgcttcgctttggggtgcagggcgtggcccctgctgcagcagcctcttcccaagcctgctatgtggccgcaggtcccaggctgagccgggcagggggccccgagtggctggcacagggtggatcccggtgccgtctctggctttgggacacagtgggcctcggcggacggcacggtgaggggccacaggcagcgtccttccagcacagaacgggggcgctctgggaactcctgcccagcaatggccaagtccccagaacgcaacgaggcactgccaaggccctttctccagagtgcgcctgtgcctgccccgcgggcctccccggggcccctccgtatctggggcctggatgtagggggctcagagaagatgggatgggatgggctggtggcaggaggacggagctgggacagggacacagctccaagaccatcagccccacacggccaagctggggacaggtgggagagccaggggctgggggcagaacgctggtcccacggctaaggccccccggggcccggggccagcccacctaccctcaccctccagcgccaggcactggccgcacagaggccccaggagccacagtttctgctaagtggcagccatgtccgtgttacccgtggctgtgcagtttcctacccattccatgcaggagaggctggggctgagccagctttgcctgaccccagcaccaggtagcttccctgtttccttctgcagacatttactgcctgtcacatggggggaggcacaggggccagggtccacagacaggataatggggcgggacgggtggggcacacaggtggccgggggtctcggcctcggctgtgcagcccatgacgtccacagcggcaattcggcatctgtcctgtccatccacctgctgtcgccggcacctcctggctcttgtcccggtgccagggcctggtgccctcagtgggccacctccgtctgaaggggccacctctgccaggaccccagagcgccatcctcgatggtttattcggacgcatctggtgcctgcccccactagctgagcgagccccaaagcgaggggcccgtgctccatacccatgaaaagtgagggagttgctcgctccacacagccaccccactgaatcccaagaagctgcaaaacctcctgcaggttccagaacattctggggtcacgagagcagcctggagaagcatcgggatcctgctttgctgccagctcttgaagcgagaggcagctgtgcccgggctgtgccaccgtggggtcagatgcatttaggtgtttgatcaaagcggtcctgaagctggcagtgggtctgagctcggcggtcgcgcggcctgggcccctccagcagccttctcgggccgattgctgccgctgcctgacctggttctgggcttgtggggagcagagctgacttcacagcagccacctcggggacaaagggaaggctttggtctgcggctgcgtttcatcttcagggtggatggaacgcggcacacagaacccagggaactaaaggcacataggaaagggcgagagggcggccgcgtccccgcccccagagccgaggcctgggcaggactttatttataagtgaccccgtttgccttcaggcttcccgtagataaatgcggccgttttggttcagtttaacaccatcaggagacctgggattgctataaacaatcagagcaggaggcggcactgtccccacagtgtgcccaggcccccgcggcacatccctcccatccctcagcatccacaggcctgggacccaggacaccctcacggctgggcccagaggcagctcatcagcttgggggttgtctcaggtcctacacggcagagccagagacgcgggacgggggagccggggcgagggcagtggccagcggcatgagtgccttgggctgcacacagcggctgtctcgagagtggcttcccgactccaggcctgaccaggccactgcctctgccctccctaggcctctgctcctgggggtcacccgggggaggtccgccctgcatcagccccaggagtgtggggttagaagccggacctggagccggaacccgctgtccccgttcagatatgtaaccgcagccgcccctgaaggcctcagtgtgaaaacgagacaggccaggggaggctcgagtgagagactgcagatggcggcagctctgcgggctccatgtgtgctgctttcgtccgccctctgtgcgcccaccgggccacatttgcccatctgcaaaacggggagggggatgggccctcccagcgctggtgagctgagagcagaccgctcacggggtgcctgagcccccctcccccgtgcccccttcccggagcacaggccgcctgctgagaggtgggggcacacagggcatagtgcagagcttgtctccacaagggggtctgcccagccagaattcccagggttgcaaggtcctcctgccccataccatggtgatgatgccccccgcagagcactggctgtcccgtgcaccccaattcctcccctcggtgcagctgtgtgccgcgtgcaccagcagcaatggctgcctcgggtggaaggtgggaggtggagaagctgttgccggcggcgccggggtcctgagggctgtccccgctggcggcggccgggccgtgctggagtgacggcgtctgtgcttgcaggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagtgctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatcacctgttagtggactttgcttgcagctgtcggtgattaggaatggaggtgccggtgtgtgcatggcactctatccgttatgcatgtttattttctgcatctgttaatgttttaacatctttcagacccaggactgctcctcctagggccagttagttcccgggggtggacagcttgcctagaacccaccttgccagggctgtgacccccgaccccctatcaaagtctcacactaagccaacgtttccccgccctgtgccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggccgcccggcttctgcaggcaatgtctgccaagccctggaatgtgctcccagtgtgtgcacagacttcaatgaataaaacgcaccgtcaccacgtgtgccgtgctttgcattttctattcaagtgtcttctatttcagtctgtaggaaaggctggatgcaacccacaaaactgatttcttgacccatggttggaagctcgctgcttaggacggaac

SEQ ID NO: 13689 - DNA, 6759 bp, Human
gggcacaggaagaaatcgggtggccaccacagccccgtgggtacgccaggctggggccctgtggggccggctgcatctgccatttcgtggcctcgggagccaggtgccctgtcgggggcaggaggtctgtgtgtcctgcacagctgctgggtgtgatggctgctgtgtgtgggggcagggccttggcctcttccttggggcctggggggtcaggggctgcatccaccgaggccacccgtccccgcagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcggtgagtggcatgggccggggctcttgctggaggcagcgggggcacgtgaggaaataaagtgcacacccccccccacgtctacacacacacacacgtagacacacagacacacagacacacacatgcacacacacagacacagacacagacacacagagacacacacgcacagacacacatgcacacacacatgcacacagacatacacatgcacacacagacacacacacaagacacatcacatgacacacacagacatacacatagacacagacacacacacagagacacacaaaacagatcacacggacacacacagacacacacacagatcacacggacacacacagacacacacacacacagacacacactgatccagacacacacacagacacacacagatcacattggctcaaagacttcatcctctctaagttccattatttcctttctcaccaaaaccaaagacaatcgctgccagggaatggagatgcccgtgcgtgaaggcgcagtttggattccgatgttagaatgggagggaacgttgtggtataggaaaaatgccgtgtgtgtctgaggagagctacactgaggcaccacgcacgtttgcgctctgagcgaaaggctccgtacccctcgccctcacacaaagggcttgatcatctcagacagtccccacgcccttcagggtcctccgggagggaatgtggggtaaaacaggcaccaccaggccgcaagccgctgacagccattctcctgttcgagttcccactgcctacatcacgcagtcatgagcctcttcgctggtccttctgcgtccagctcctcccgcgtcatcacaaacttccagaagggaaatcgctgggctagaccactaggaactgctccttggttcttttttttttttttgagacggagtctcactctgtcgcccaggctggagtgcaatggcgcagtctcggctcactgtaacctccacctcctgggttcaaatgattctcctgcctcagccacctgagtagctgagattacaggcacctgtcaccacgcccagctaattatatatatatatatatatatattttttttttttttttttttttgagacggagtctggctctgtcgcccaggctggagtgcagtggcgtgatctcggctcactgcaagctccgcctcccgggttcacgccattctcctgcctcagcctcccgagtagctgggactacaggcgcccgccaccacgcccggctaattttttgtatttttagtagagatggggtttcaccgtgttagccaggatggtctcgatctcctgacctcgtgatccatccgcctcagcctctcaaagtgctgggattacaggcgtgagccaccacgcccagcttgctccttggttcgtgataaacagttgccttccagaagggcggtagctggcctgcagttccaattttcaatcaggccagctgccctttgccccggcccctcctctgagcccgcagagcttggaggcagatgagacatggcccagcctccccaacccttccccacctcagctggctcagctgaccccaggctctgctccactcccctctgcagactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggtagggccctcagagggcgtggctggggtcgtggccggggcgtggccggagggctgggggcttcctgtgtgtggagctggggactcggctgggagcaggatgcggcccctgccctcgggagcccaggctgggcagggaggtgggaagccaccgtgagtccggtggggcccccattctgaatggcacgcacagcagggcccaccacgcagccgctgccttgttcacgtgccttgttcactggcccagccctgggcccctctgacggcctgggagcctcccagttccctgtcccccgggccctccggtccccacacacctgcaatcccaggggaagttgggctcctgaaggtggtcaggccccagtgtggccttagctgcagcggccgtgcgtgggtcagacagtggggtcatcaccgtcccactgctggggcaatgcggccgctgtgcccgtccatgcttcgggggcagggcacaggcagcccccacggcccactcagctccaggctgattgcaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggtactgtccccactgtccctgactgggcatgagaggcagagtgggggaggtcctgggtagccggcagggacgctggggggtgcctcccccacgggcttcagggccctccgcgggccatcgcctgaactccacacctgcaccattctctgagcacccaggctggtgcctggagctgcctgttggagccctgtccagagggaggtgttagcagtggacagtgtgctgggtggcgccaaggcatggcagctgaggctgcggggaaggccccaggaaggggcagtggatggctggtgtggcttcttgggggagggtaggcaggtgggccccagctcttctcatccctgtcggccgcaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtagtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatatatcctatctcacatgctattcctagaaatctggtgcaatgttatcagtcataattttggttattacattaaaatgctgcatgccacagaaataaccaagtttccttgccaaccgtgtcacgaatataataaactctcatcagatcctgagccatggctatcttaagtcttcggtcattcacagttattatcttactttgattttttctgaaagctttgcaatcagctagtcccaaattgtttattcttcaaagagattcctgggaaggattctgacaggtgctctggagcacaggtttctggttcaggtcatagccttggattgggtgcaaatttccagaactcgaaggagggacctggcaggtccatgaaagttctgtcccaggatcaaccagaacaagaattaatgacatgggaatgaatgaactgacgaggatgtttactgtttaatgacttttgtctgaagcattacggttctttaatattttgttttccagatgtaagaaaacgttttttgtttctgtttttgtttttgaagacagggtcttgctctgtcacccaggctggagcgcagtggcgtgaccacagctcattgcagccttgaattcccaggctcaagtgatcctcccgcctcagcctcctgaatagttgggactacaggaatgcaccaccacacctggctaattttaaatttttttttttttaggagattcagggtcttgctatgttgcccaggctggtctcgaactcctgggctctagcaatcctcctgcctcgggactacaggcctgagctgctgcgcccagcctgggcacgaaagccgtctgtacgagagttgctggggaaatttctctgaagtctgtatcaagtggggcagcttcagcttacagggctttgggaaaagagcagttttaattttcagtgactccatgaggaatggtggaagaaaaaattggaaagagtggtttggtgagctgtaggcaaatattggaggaaactgaagttcaggacccggtccggaccacaggtgggcgacaaaacctccagacagcaaaccgggctagagtctaatagtgggggcacgagttttattttgaaacataatttttctctctacagtcaacaaatttctttttctttttttttttttgagatagagtttcgctcttattgcacaggctggagtgcaatggcttgatctcggctcacggcaacctctgcctcccgggttcaagtgattctcctgcctcagcctcccgagtagctgggattacaggcatgcgccaccacgcccagctaatttttgtactttcagtagagatggggtttcttcacgttggtcaggttggtctcgaactcccgacctcaggtgatccacccacctcggcctcccaaaatgctgggattacaggtgtgagccaccgcacccagccaacaaatttccttcttcctttttttttttgagatggagtctcgctctgtcgcccaggctggagtgcaatggcgcaatattggctcactgcaacctctgcctctcgggttcaagtgattctcctgcctcagcctcccaagtctctgggattacaggtgcctgctaccacgcccgactaatttttgtatttttagtagagatagggttttgccatgttggccaggctggtctcgaactcctgacctcaggtgatccgcccacctcggcttcccaaagtgctgggattacaggtgtgagccaccgtgaccggctgcaaattaacgcatttctatcaaagataataaaagtaggattgttttcaaattaacacatttctatcaaagataataaaagattgatttgattgcagagtaagtttggcctcattaaacctggtgtggttatttatgtaagtggaacaagaatagtgattaaccacataggttcttcctcatttttgttttccaacagggcctcaccctgtcaccgaggctggagtgcag

SEQ ID NO: 13690 - DNA, 13821 bp, Human
  misc_feature (1)...(13821): n = A,T,C or G
ggcgcacccggaggggagggtccctggaagatgtcagtgggtctgggagcgggcttccggcgttccctgcaccgtgggagaccagcctctcagggggagggtggttctgcgctggatcctcggggcctgtcatggtgcgcccaggagggcaggcacgtgaggacagggactggaaaccagcagattccgggttccaccctgaggcctgcacccccgggcctcattagggagagcccctcagagccgggcttcgttggttctggggcgtcccccatgagcagggccggggaggggccggtagacccaggctcgtctcccaggctgcagcccacctgctcccctcccccgcctgccggctccggtcctcggcgtctgccctgtccccggggaccgcttttcgcggctcaagcgtgttcctgccctgagccggctctcgccccgtctcccgggcccgccgcgctctccccgcgccgtctccgtcccggtccctccctcccgccgcctccctgccctgccccccgccccgcccccgcccgcggcgcgtttctcccccgcctcccgcgtccgtctttgcagcccgcgcctcccgcatcgcctcgcgtccccgtggcgcccgcccgcgcgcgtccgcgccccgccccctcccgcgcggttccgcattggcgtgctgcagggcgcggtgcactgcgccgccaccgtcaataggtggaccccctcccggagataaaaccgccggcgccggcgccgccagtccctctggctgagacctcggctccgggtaaggacgctcggcccccgggcctccgcccccgcccccgtcttccgaagagggacccccggggccggtcctggggggcagagggtggccgggccccgcacccgcccccgcgcgcgcccggagtccggcttccgggggtccccgcgtcggccgggctgggcccggggtggggggcggcgcggggcggcggggccgggtcctgggcggcgatcgccccgtagccgtgaccttggggccgcggggaccctgcgggccgggggctgatgggggtcgggcttcggggcgctgggccagaggacgctgagggaggtggtgagatctgggggccctggcctccccacccccacccgtgttcccaccccagggtggcttctgtcctctttccctcccccagccacctgtccgcgaggagcagcgtgggtttctccactgacctctgtgatgggacagggctgtgacccagggtcctgagtcacagggagggggggagggagggtgccccctatacccccacggggccgagggcatctccacctggcacttgctgggctcggcagggccgggtcctccttcctcaggctggaacagggacccccacctcccggccgctgtctgtccctgtgagagtccgggaggggggtgcctagagctattctgggttcctaatctgggcagcgcatctccgtcggggctctggcccagcctgccgggcagggatgaggggaagatggcgccgtccctgcctgaggaggggagtggggagcagtggccatctctccccggtggcagcgggtgggggtggggcgccgtgtccctggccctgccgccggggaggggagtgcgcttgcaggacagggccctggagcgctgggcaggtgactcatcacccggctctgctggtcacggacgtacccagcctggcgctgcgtggtctctccaaatggtggctaaccccttcccaaggagcagcccgcgggctccaacgcccagttatttacagcagatggggctgtttgggctcaagtgtggggtgggggcagtgcacagcctctgcttgccctggccaggcccagctgtgggtgggggcccttccctccccaccaaacatgggggcttggtttgtgggcagggatgcctgtccagcctgtgccaggacagtctctgctggtgtctccccctggggctccccatcaccggtctccccaccaccactggccccacagaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgaggtgagctccccaggctatggtcttggccccctgagaaggaacccccaactcccgtggtggccaggcttggcatctcccagccccagggcatggggctcaggtgacctcctccagggcaggagggacccccgctgtggggcactcaggcctcagagggtctggtggggcagcctctctcttagggggagcttggtgggggaggggtggccatcgagctgccggacttgccctgtggtgagggaggtgacctgggagggtctgcagaaggctctggaactctgccatgttgagctggggctggagggcgctggagccttacccccttccccccagggccaaggctggggctggggatggtactgccctcacttgtcctagggccctgccagggcgcacgctactattaatagctgattgatgggcagccggcccgtctgctccattttcttgtgctgggctgtggagggctgctgtccagggcagccctggggtgggggtcctggatgaggtgacctcctagctgaccttttgaagcgattcctctttggtggctgagacggtggtggggagcggtcatgagacggggtctgctctctgatccccatcccccacccaggactctggggagaagcccactcctgggagggcctgtgggagctctcacctggatgatgagggcggaggccagggcccaaggtgggggcactcgctgtcctgggctgagcctctgccctggcggggttgggggtgctctgagctgcacccctgagtttgggctgcatcaccctttacctggccttgtcaggaggaggcgggggtttcagagggccgctgtttcaggccccagctgggtcccatctgggtctgctccagactgggcagcctcctggagggcagagtcctgtctgtgcgaggccctggcgaggagttctgcccagctgggtagtgaccgccgctgctgccctgactgaagcccgtccccttctgtgggggtctcactggccgaggccccccagcttcccgtgtccggcagagcgaggaaggggaggagaagcctcagagggatggggaggctggagcagcgggaaggagctgcgtggccaggccctcctcctgacctcattcagttttcctttctccttaccttaaaaaaacacacacacacagagggttatttatctgacagccccaaacacggtggtattattggcctctggttgaggaagggatctgggggcgtccgcagcttcagataaaggggagccctcgcccgggaggggtttatcccatctggcggcttcgctcgtagagcgagcgactcccaggcccttgcgccacctgctggtggacctgcgtagccgcgcccatttcggagcaggtgcggaggccggccctggggggcagggtctgggtgtggggtcccgacggagggggccggcgtcccaggaccccgacggagagcaagggggtgctggagcccatctcccgcctctcgcggccactctgctgtaacaagcagctcgcaccaccagggactcctgggtcccgggtcccgccctcagccgtgaccctcacccgctccagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggtgagcagggcacagcaggcggggctgggggagaggccgctgcacccttcaagggacactgggggcccctggggtcactgggatggtggggtctcctgtgcttcctgtgagggcaggggacccctcacctgggccaccctcacccagtctggctcagagcccccctaaggatgaatccagtgctctggcatctgaaccagtgcctgtgaaggcatccagccagtgtcagagtccccagatagatgggggcagatggggacgtggacacaccttcatacatggaggggttggaggccaggatggggagagtgagcagtgggcagaggtgccacccgccaggtgtagactgtatgacatttcagggcactcacagagacgcacggacaccccagacacagcaccctgcagacagcaggacacatgccaccacctccaaactgctttgataactgtgacttctatccgtcctcaagtgaggaacaggagcagataggctgagtgacttgtccagggacacacagcccactggtggtggagccagggctgaacctcggtcccctgacccagggcctggcgatgagcccccatgctgcccttgaagtggggacccccatgcctccctccccaaggccccagtgggctgctcaggccccagcccgctgcctggagaggcctggaagtgaggtggggccaggctcgctctgtcccctgccaggcaggcggggcagggctcactgtgtcccctgccgggcaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacgtgagtggcggctagggcggggcgggccacgggagctggctggaccccctggcccagagcgaggcaccggcaggtggcacggggaggtcgagggcctgtccccgggaaatgcaggttcccctcgaaacctgctgggtttccctaactggctcagggcccggcggggagccccatgcccctcagcaccgggctttgctcctacactcagcctcccacgcggctggccggggccagggcccatctacgatgtcaacacagcaggggcagcggcctccagcaccaggcccatgtgcttggtctccagagccctgccatgggggcggtcggtttcatctctgccaggccattgtcctggtcctggacaccgtgcaggggctttgggctgggccgtgggggcctccttggctgcctcccctgggatcttggagcagggttgggctttgggaagtgtgcatgcttctgggcttgctgggatggccaagggttggctcttggccggtcacctgggagctcaacgtgcgaacagtctgtagcccagggactctgccttggctggaggtgacgcgtggagacacttgcagaacctgagactgttcccagggttctccaagccagaggagaccccagaatggccaccactaggctctgccagcactgtcgctgcccacagtgagggtgcaggtgtggagtctagagacagcagggagacagaccagcagcactgagcctggagctgaggtctggggacagaactgagagggactcccccagctccgcctccatctcacgaggctcggtgttgtttacctgtgatggcgttttcctcatggggtatcatgtggcgaacgccactctcccctccccagggaggcctccagccatcagggaccctgcactcccctctggcctgagctgctaggtggcccgtgcttacacaggccctggggggctggggcactgtgctgccggccccctcccctgctccctgtttgtggcaggtggcccagagggaggcttcatgggatgggagtgggggccacactaggagaagctccggacaaggctgggccaagctcggaggcagcacggtgtccagaagctagggtggggcgaggctcctccagctctgtccctggcctggcccttggccagactcagcatcctcctagtcaagtcatctgccctgcctggagctgatggtcaggggcccggggtttcggggacttggggctggactggggatttgttcacagtgtcagcaactcctgagcagcctgggctgggaagggtgctttccctctttgtcctcctccttttaagagggatctccttcccagagtccctgtgatgctggggctatgggctggggaggagcagggtggggaaattcctcatctcaaagggcacgaggcaagtttagcctgaacagcagtactcctggaagcaccctggggaggcctgagggtggggaggccaccaatgtctcttaacggattgattttctccctttggtccagatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggtgagcaagggcgctgtgctggagctcctgcctggccagctctgcctgccctagaccaggggcccctacaaggcatctcaagactgggctgtctccaatctctccccttaccacacactttctgtgggacagtccatcccacatccatccatccatccacccacctccccacccatccatcctctgtccatccatccacccatccatctatccacctctccatccatctatctatccatccatccatccatcgatccatccatctccccacccatccatccttcactccatccatccatccatccattgtcccatccatccttctctctatcgaaccatccctccatctctccatctatccacctccccacccatccatccttctgtccatcaatccatccatccatccatccatccacctctccatccatccatccatctccccacccatccatccttctctctatccatccatccatccatccatccattgattgtcccacccatccatccttctctctatccctccatccatccatccatgcatccatccatccattgtcccacccatccatccttctctctatccatccatccatccttccatccatccatccacctccccacccatccatccttctgtccatccatccatccatccatctctccatccatccatccatccatccattgtctcaaccatccatccttctctctatccatccatccatccatccatccatctacccacccatccatccttctctctatccatccatctattgacccacccatccatccttctatctatccatccatccattcatccactcacccacctacccacccatccatccttctgtacatccatccatccatccatccacccacctacctatccatccatccttccatccatccatttatccatccatccatccatccatctatccacccacctacccacccatacatccatccatccacctccccatccatccacttccccatccatccatccatccatccatctccccatccacccatccacctctctatccatccatctccccacccagccatccttccctccatcatccatccatccatctcatccatccgttcatctcctcatccatccatccatccatccatccatccatccatccatccatccacctccccatccgtccgtccatccatccatccatccatctatccccccatccatccatccatccatccatccatccatccatctatccatccacctccccatccatccattcatccacccaccttcctacccatccatccttctgtccatccactcatctacctcctcatccatccatccatccatccatccaccaatccatccatccatctccctactcatccatctccccacccatccttctgtccatccacctccccatccatctaccaccccattcatacatccatccatccatccacccacctccccatccatccgtccatccatccatccatcccaccaagaagagaaaccataaacaaatctgagaccctagagaagggcactgataggagacccccagccagtgggctgcagccaaagatgttgcaggcatctctgtgtgcactgtgggggcatcatgctcaccccagcacagagcacagccactggcctcagtgaagttggctggaggctacaacaggcctccctcacagccctgggaggtgagggtggagacccagtagcctggggggggacaagacccccatgtggcagctgcacaattggtttaagtagatccatgagaaatgccagggacgctcatgtgccgctgtgcctgtgctgcatctggctgagaggcccctttagtgatagagacctgcagcatccaagtggggcccagagagcctgcagggagcagggagcagggcctgcagggagcagggagcagggccaccaggccccaggcagaagcagtcagtcgccccgcccacactcacagggaggagtcctcagacaaaggaggggtcccatagtgcctcctttgagggaaagtgctctccgggggcaaggatgggaccccaggttcagacagcccctctctgcccatcctcccgcttctctgtccctgtggcttttccgtgggttcctgggagctctgctgctcagcctcttatttccccagctgggtgggagagcccccacttcccttggaatctctgtgtctgcccttgtccctggcctcccttcccctgcactccgcccatgtggccccaacccccaggcctgtcggggggatccagtcccaggctttgttggtttccaggctctgtccccgaatatcctgccccagcatcccctcgggccccaccttcccctcacaccccctcccctctgcaggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtggggggctgcgctgggtccagggggctggcgcctgctggacagcagcaggactgtcctgggtgaggctgctgtcggcaggtggcctggcgtggggagaaaaccggaccctcaggctgggcgcagtggctcacgcctgtaatcccagcactttgagaggccgaggcgggcagatcacgaggtcaagagatcaagtccatcctggtcaacatggtgaaaccccgtctctactaaaaatacaaaaattagccaggcgtggtggcacgtgcctgtagtcccagctatcaggaagctgaggcaggagaatcgcttgaacctgggaggcggaggttgcagtgagccgagattgcgccactgcactccagcctgcgtgacagagcgagacttcgtctcaaaagaaaaaaaaaaaaagaaaagggacccgcataccaccgagggggccaccgagcactcaacgaggggatcaatcagttctgggaggggtgcaggccctgtggctcccagcctgtgtgcaatcccgggtctgtcttccacgctgcactgctgggatgcccagcctttgaggtcctacattcgtcctagaaaaacgcttttgttaacttactgtctgagacatctctgtcatacttttattctctacagtcttcattgcccctctttgctggcctcttcatatgatttatttatttattttttgagacggagtctcgctctgttgcccaggctggagtgcagtggtgcgatctcggctcactgcaacctccgcctcccgggttcaagtgattctcctgcctcagcctcccaagtaggtaagattacaggcatgtgccaccacgcctggctaatttttgtattattagtagatacggggtttcaccatgttagccaggctggtctcgaactcctgacctcaagtgatccacgtgcgtcagcctcccaaagtactgggatgacaggtgtgagccaccgtgcctggcctcttcatatgatttttaaaagtggctttattgagatacaactgaaacacaggaattgaggtccagttttgtcacccccccgccttagttccagctggggttggccgtgtaagtgctgcccctgccccttcgaaacaatgaatctcagttgtttatcttttgcttaatgaggatgttgaggttcaggtctgggggctgggtcctcagagcctgagccccctccagtcagcactccgggcccaggagcccgtgcaggggcgccggtgactgggcctcccagccccgctctggcgccctcccggtgcccaccgccgatgtgcctgatggccgcctgtggctccgctcgcaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggtgagccggggtggtccggggaggtgcagcccccaggctgtggctgatccaggctgagggcagaggactgcggggatggggcgctggggacagcagtgggccccctttcctgcggagcttggcccagagcatggcaggagagccacggcctccgtgtcactgagtgcaggtgaccctgcccagacgagctggggtgggccctgtgtgcagacgaggccccgaaagtgagggaggccccgcgagtgaggaaggcccgcggtcgcccagtggcagcgttagggctgcccccgccccgtggccgccccgcagaccgtggagcagccgcccaggcaggactcccgcgaggccggccgtcttcacaggggcgcgctctgcgctaagcgtgttccgaggacattcccgacgcggttgcgcccccgcccggccagagccctggggttggggggggtcaagtcctccggccccgcccacacgccgccccccgccccccaggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggcgccgcgctccgaaccccggcccggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccagagccgtgtgcgcctgctgctggggggtgggccccgcgccccccggaccccctccctgcccaagtggccggcccagcatccttcactccctgcccggggaccccagggtgggcggtgggcctgcaagagtggtcccctgcgctgcacagggtgagcgctgagcgctcgctgaggagggcctggtgtcccccaggccgtggcccagcagcaagaccccatccgaaggccaggtggcctgggtggctttgaggggcttctccatggctactcagggcagagaatggtgccttcagatccacagaaccaggctgcgggttttgggatctctgggggccgcatgagagctgagggctcctccaccgcgagtgactgtcacacacacactcattcttcccctggccccgcacacctggtctcactctcctgctaagccggtcacctgtggctgcagcctgtacctatccatcctgctcccaggtccaggccctctgtacgtggttgtaggaactccagcccccgaacccgggaggctggtgacttcagtcagtgggctgggggctttgggtcttccctagtctctctgggctagaacctgccccgaccttggctgggaagagtggaggggtggggagaggggaggacagctcctttccacccctccctgctctgggaaagcggccccggcccacagccagtcatgctgcagcaggtgaaggtcggggtggagggtgagcaggttccctgaggatgcagaggagggtcagggtggagggtgggcagcttccttgaggatgcagaggagggtcagggtggagggtgggcagcttccctgaggatgcggaggagggtggggtggagggtgggcaggttccctgaggatgcagaggagggtggggtggaggatgggcaggttccctgaggatgcagaggagggtggggtggaggatgggcaggttccctgaggatgcagaggagggtggggtggaggttgggcagcttccctgaggatgcagaggagggtctgggtggagggtgggcaggctccctgaggatgcggaggagggtggggtggagggtgggcaggttccctgaggatgcggaggagggtggggtggagggtgggcaggttccctgaggatgcaggtgaggtcagggtggaggatgggcaggttccctgaggatgcagggagggtggggtggagggtgggcaggttccctgaccctgtacacagcactgaggcaggcctctctgtcgcccagcccccagctcccagcctgcagccgggtacctgactcggagggttccgcagagcaggcaggctgaccgcagggcctcatagcgccttagtctcttagggatgctgcgaccaatgacggcaaatggcgaggcctcctggggtcaggccaaaaccagcctccctgccgaaatcaaggtgtcgatggggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13691 - DNA, 8572 bp, Human
agttcagagcaaacctgggtgctgcatgtgtctctcccctggaagaagcaggctggagacagtggcccctcttcccacctccccggtgcactgcgggcagactgggaaccaggcagcaaatccacccagcttgaggcccacgtcctcctgaaagggccccaggcccacacccggggttttgctgaagtgaccaaaggtaaccgctgtgctgagggggcggtggaggacagggagggggcgaaggcgaggtgggcgctggaggacgtgggggtgaaggcgaggtggtcgctggaggacagggagggggcgaaggtgtggtggacgctggaggacagagagggggcaaaggcgaggtgggcgctggaggacagggagggggcgaaggcgaggtgggcgctggaggacagagagggggcgaaggcgaggtgggcgctggaggacagagagggggcgaaggcgaggtaccctgagatcatcccagaaaacacactgggaagttctaccttgtgtctagcctaactcctttgctggccctcaggccctttcccgacagccctcccctcctatgcccctgagcttcctgctgcctctccctctgcgccctgcagccctggcttctgggctctatcctcagcagggcctgcagacaccccagaggccttaagagcctgggaggggtttccagccacacccttcactttgatttctgcaggaaaccaggtggctctgggccttgcataggaaagggttgggggtctcgctggggcctggcaacactggcctgagtatgaccagaacagtcaccagaggcctcctgggagggcgggtgcagccccagcccccgccgtgagtgggggtcggggggcaggtgtgaaagtgtggtgggcagcagctgggtctatgcggctcagcagtgggaagagaacgggccaggcttccaggtgagctcagggacggttttcactgcagctaaccctctcctgcccacctgcgctccccgtggcaaccagcggccctgcagcgtgcgactcctctttattcttccaaactctgtgagcctgcacgctcccatccaggacggaacagcaggggagagtggctgaaggatgacagggggcttttagggccagccgggtggatgagctgggtttgctggggttgagggctcagtcgggggttggggggtgtcgaagtctgggccccatccagctgtcctttttgtcccgcccaggtgtccctggggttcctgttctgcccctggcttctctggggttaagtcctcctccctgttccctcactgtggggtttggcagtgtggcacagtgtggagcttggaccggcagccagggtcacagcagacctcaggaactccgattccagtgccaacactgagtactcctcttttgggggcatcagagcctctcccttggctacctggggaggctggtatggagggaggtggagggagatgggggaagggggagcgggaggtgagggcagctcgggcccttctttttgctctgatcttcctggcctgaggacaagagctgctcccagacctgcagaggccccttggggcagagggatgtttcagagaacagccgggtgacctgcctccctgctctgcgtgacgcagccctaggcccctgtgaggctagagtcacccccgcaaggtgggaggtcacggcccctgcctgcacaggcagcacagctcacatgtccttccttgagccttctctgcttccggaggctgccctgggcgcctgaccttggagccatcatctccagctccccaacccctcccccacagccctggggcagacaccagcctggggaggggtctccatgctcagttccttcccgtcttgttcagagagacgtggcctgcccacgtgcagtcagcggcatccgcaaccctgccaggggccccgtgacacgcccccgctgcacagagcatgtgaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggtcagtcccgggcgggggggccttcctgccgtgggcctgggcacgattctggacccttccagcccagggctctgcctcctccgtagcatccatcccccaacaggaagggtctggcctgatgacggagcagtggtcctgcaagcccctccagtgcccatgggctcgtgcctgacaccctcccccggagtctctgctggctgagtgtttcagaccgtgggacgtgaggaggggctgcctctggccacagtctgagggtctcagctgtggaggccgccagcttggtgcacaagtacccctttgtgatagaagtgggtggggctgacattgcctggggccctcaccttccccgctgctgttctgcacagggagaggagatgtttaaagaacaggatcagggtgaccaaggcaggcagtggtcagccagaaggtcctggatgctcagcctgtggggaatttctccaggccccaacctgcagctactgtctggtcttccccaactgaatcaagtccccggagtacctatcctagtcttggcccgggcctgctcctctgccctacagctgcagaccatgtggtcagacctgagttcaggtcccagctctgccacttcctggctgaaggacagggcagcagggcccaccgagggctttacaaatactggcacagccatggtcattgtcagcagtgggctctgggggggcaccatcctggtaaggctggaccaacttaagacagctggtcggggggacagtggctgggacagtcagaagccgtggcgtgaaggggcaggcccagctcacccacctccctggaagtccaaggctcaggaggcaaaggccaggcaagaggcatggcaggtgcagagccggggtctttggggctggtagaggtccagtgcccgatgcagcccaaacctgtgatgtcagtggcaggtgacgtatcgcatggatgccgatgaggggacggggtcgccaggaggtagagagatgacgggtcccccacccccaaagggaggcatgagttcctaaaagcaagcctggccccagactggccttctagggcagcctcccttcttcttctcactgggaatccatcttggggaagcagagacctggggaggggcccttctggctcctgaagccccagggctatagatgtaccaagccctggggggcccccactgctcactctgggaacaatgcaaatgccagctcagtcctttcctgaacattctcgcccatcctggccggcaccccagtcacccttgtccccttttcacctttgatgctaatgaggtacaagtgacatcccccaccaagccccctgcccaccccctcctccttcttgccacctgggagctcccctccagctgaagctctcatagccttggaaggacacaccgggggcccggggactgggtgggacctggctggggccagcatctctccgcaccccaggccatcaggacaaggtgaggtgcttcttctgctatgggggcctgcagagctggaagcgcggggacgacccctggacggagcatgccaagtggttccccaggtaccggctgcccctgcggggccccgggtctgatcatgggtagggggtgggcccccaacggctctgtcgacccaacaccaggcctgctttgcctccctggccccacagggcactggggaggcccttctgtgggaggtgcttctggccggcaggtacccacttttcctgtgagggccccttttcggaagggctgctgggggcagaaatgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcttgggtgagcgccacctctcctcggggctccgggtggcagtggggtcctgcccctcctatttccccaaggcctgatggtctctggctccttccaggacccgtgggaagaaccggaagacgcagcccctgtggccccctccggtgagagctgacaccacccctgctgactccttgtgcgcctgcagcctgtgcttggccaaggccactgggtgtccccaccctcccagacagcagggagagtgacgggcatgtgacagggtgtgacgctgctgcctgggttggcttcagggggctgtgccatgtgagggtgggggcggggcggcaggggcctcccccagtgcaaggccccattctgcttctctcccagcttaccccttgggcacagcccattgcccgtcgccataccacccccaacagtgcccagcacacagcatctgcagctactgccagatgggcaggatgtgcagagggcattggacaagggacaggctctctggtggcgcctccaggaagcctctggatcctgttatgctgtgggaggggtgggaagaagtgtcgggagcggggatactctgcagcccctccactcccggccagaactggaccccacaggctgcagacctgtatctgggccggcccagctttctccttgggagttaggcctcaagtctatcctaactgtccacagtccctgcctctgggtaccctgagctgcccacacccaggagagaggtccagtctgaaagtgcccaggagccaggtgcaggcccgggaccccctgggtgagggctggggcaggggagggctgagggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgagcgccccagcaccacgcgcagccagccctcctgcggagggggccctgagccggctgtgcccggccctcctgaacccatgcaggcccttcccgggtggcagcgtcagcttgtttttacccggctcccaggtcccgctgatagcgcccatcaatcttactacctcccttgacgcttaggttggggcctggtccttcgggcaccgtgccctggcggccaccatagctctgcctgcctgcattaactgacgcctgctggctcctctcagccttgattttcctcagtggtcaaggaaagccggctttggaggcgtttggggaaacagggtgggccaggttgggcttacacaagcgagacactggcctggcttcaacccggggccaaggcatggtgggaacacctgcacgggaagggggtgtgtgaacctgttcttagagaagtgggtgggataccccatactggccgagggacaggtgctgtgaccgcctcggggctccccagagcctctgtagttacccccgggatgtgtctgaagatctggcaggggacaaagtggtcgggcagggaactctgggatctgaggcccctggctaggtgggccccgtcggttgccattgactcacccacccctcctctccctctaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagcagcctgttccagaccacgagctgcctccccacccacccaacccgacacaggtcaccacctctccaggctggcagggcagcacctgcccaggtccagctggctccaggctgctccccaaacttcccccactcccgcagacaccccccttccaggcccctcacctccttcccctcgcgcttatcctccagtattttaaggactgttggaacgggcaggccgcaggccccacctgagattgtacccctgactgtcccccaagctcggcatcttccacagagtgggtgagggccatgttcctgtttatttaccaacttgatgatacctgggggagcctttgggactgtttgcccaagagccccctttacaagagtactgcctgctcgtcaccaccatgtgccctgccctatgccttggggcctggctctgctgttcctggtcaagcccagcccccaccctagggctccatcagcctcagctcctgggtggggtgggggttcttctggcacgagtttggggttaggaaccctccatgttcaacaggggccctcaccgcttgaggggtctcgggcctcacattgacttcctggggaggctgcatcccagcagcagtgcttgcagcccgagggtccagcagccccaggtgggcacctgagggaggggctcctcgacgagacgacagcctgggggcagagctgtgacccccatgttgccagaggaggtgggcatgtggggttttgccttttcttttgtatgttttcttttcttttttttttttaagagaaaggaaattacaaactctcttgacgctgcagccagccgtggcactgccctgccgccctggctggtgtccagtacttagaacccagggcaggtgctgccggccgcctggggggtgctgggtgggggcgcgtcccaaggcctgggagctcctgtcattgtcactggtcggtcgctgaggctggaggccacaggagcaggatcagctgtttcctcacttacgcaggcctgtggggacaaggtcagagagcacctgggggaacagggctggggcggccactgggggctgccaccccctccccttggagaacctgaaatggaacaaagtccaagcagtggacggcttcaggcctttggcagaaaggagatgggtgggactgaggctctggaaagcccccactgcctctccctgtgccggcaggtcagcgtcttgtgcctgtttgctgacaactcagtggggtctggcctgtggggctgggagtggagagggggctcacccaggggtgtgcctgggtccctggctcagggtctgcgtgtgaccccaccccttcccaggtctttattcccctgttctctgacatgggagctgggctcctgctaccttgaacggcccctgccgggacagccctcatttttaggagagaagagccaggggctacccaggggcgtgccatcaggtgtgtctgggggcctgggcagcccaggggcggtgcagccacctattctgagccccaaactaggattgtgtacggggcgggctgtgtggcaaaagctgtttcagaggaggccaggtgggagccctggcaccccatgccaaagtctggggtttgcagagctgtggacactgcctttcaagaaacaagtctggttctgccagataggaagccagggccccagctcctgccacagagagacccctacagcacccccatgccgcctgctgggaagtggctcttcaggacacccttgcggcccccgactcagagccgactcctggacccaaccccctcccacagtctccatctctgctgggctctgagcttctgggctgggactgggtcctaggtctctgcagccccagtaccaccccagagcctggcatgaagcagatgttagaaaagtgagagtggatggatggacggatggatggcagaacggacaggcaggtgcctggtgaggcccccaaggaaggcagcctctcgctgtgagggccagat

SEQ ID NO: 13692 - DNA, 36895 bp, Human
ttttgccactgatacatacgttacacatactactttatacgaagtactgctaaagtgtttcaataaattaaaaaactttggtctcttggctgaaaatgggatgaatgcagggtggtgagatctgagcagccagtcccttagggagacacccaagcgagagagaacatcggcagaagagatggagagcaaggtgagatcaagatgctttggccagagtcaatggctgctgctagacagattaccggacaaaagagagggaagaatagaagatggtcacaggtttcaagcatgagaggccctgcaagatggggccacaaataaggaggaaggactggaagaagaacaggtttgagaagcagggcaagtttgacgtgactattagacatgcgtctggagaaatcaagcaggtgtctgaattacagatcctgagctcagagctgaaaacatgaattagtgaaataaggggcggggggggcggtgctggggcacagggatatttaaagccaagaattcagcaaagaccataggaagagcgtagatagggaatgagaatcgccattacttggaggatgccaaccttgaaggtaaagcagagaaagtggcaccagcagaagaaaacttgatgtggagcggcaggtaaagtggaggagaaaccaggagtcgctgtcacacacgaacacccatctttcgttgtcaactgcaaaactcactgagaccaactttttattcacgacaattaatggtaacttaaggactcattttctttttcttttttttttgagacagagcctcgctctgtcgcccaggctggagggcagtggcgcgatcatggctcaccgcagcctcgacctcctgggctcaagcgatcctcccacctcagcctccagagtaactgggacaacaggagcgcaccactctgcctggctaatttttttatttttagcagagaagggagtctcgctgttgccacggctggtctcgaactcgcgggctcaagtgatccgcccacttcgacctccgccaccgcgcccggccctaggaccaacgttaagagctccctaggaaaaggcaccttttctctcggcccattcggtgatcggcactcacagcgcttccactccgggcagttacgtgcgcccatgaaaagcaacaactttgtagaactggccagtcctgttagcaggaagaactcggtagtctcaaactccagcataaaaagattcagcagaagaaaacacccgtgtgctgaagactcctactttccatgccacactttacatcctcacccgctcggtttctgctttaaagcagcagattttattaaaaagacttcgttacggacgtcgctcctccacagagacagctaccgccgcccctcaggctggccgggaccgccccagaacaccagcgcctgaggccgcgcgcctggaggctgagccctgactgccccctgggcaccggcgcggggcggccgtccgggcctggactcactgcgcgccccaattccgcacctgccagcgccggcgcttccaaggcccccagagcgggggcggcgcgcaccccggccacatcccgcctgcccgcccggcccggccccgggagacgctcggcccggccgcccgggcccgccgccgccatcttaccgtgcggaacctgcctcccgcgctgcgcggtctgggcggctgcggctccgcagcctctcctgggctggggagaggtggcggccgccggggcgcccgagtagaaggaggcagaggtgggggccgcggcggaggcgggggcgggggcgggggcggggagcgggagggcaggcgcaccggaggccgcccctcagcacctctcgcgacagcaagagagcgcgagagcgcgagccgatgaccaatgaagcgcccccgcgagggggcggggcggacggcctcccggaagcgcggaacctcagcttccgtacttgcgcagaactcccctcgcggcgaccacgcactacgggttggcgccagagtcaaaaggcgtcggccctctggcaagatggctgctgcggaggcgttggagcgcggaaatctggaaccgggatggcgacgtctacactgagtcggaggcgaaggtcccagcttttttcctgtcgtttgcgtgaggccgcacggggtggggcgggggaaaggcgccgggtgtccgcggccgcccctcagacggagggagtcccctcccgaccggcggccttccagggctagtgtccctgaggtccagggagagacggctgacccgagaccgggctgggcgagagctgtgctgtctgcgcgttgaagcgagttcccccgctttactcgagatgttgttgagcgcgtcctcactcgaggccaggtggggaatcagaagggccctgccctcagggcgcctcccatgggctacgccgaagggcgggacgcggccagggcgcgcgggacaaaggagaccccacttgcttgcggggcggagtcccggcggcggcgcggggcagggccggggttactcggtgactggagaccctcccggcaggagcgcgggttgaggccgcacttgggtatttgcgcgtttacttgcttattgcctgtccgctcaggaggaatgcgaagtctgtcattgcagggtcccatgtttccgttgctgggaagtaccttaaaatatttgatagagccgaaggaagaaatagagtccttgaggggcagctcctgatttcatctgtgaggaattcacgggacggcttctttctgaagtcaggggtgaggtggtttcgtgtgtttgcttacaagcgagctgaacaacgtgtaagctatgtcggtcggtctactcagcgacagtaagtccagttcggcaaataggttggaggagactgattttggacattttccgttaatcgaaagagctaaatctgcaggtataaggtcttgacaaaattatgcttcatatgcagaggcagtacatgccagtaattttttcatttgcaactacataaccctatgggaaacagttattggtctttatttagttatttattttgagacgaagtctcactctcgcccaggctggagcgcagtggcgccatctcggctcactgcaacctccgcctcccgggttcaagcgattctcctgcctcagcctcccgagtagctgggaccacaggggcgcaccaccacgcccagctaatttttgtatttttagtagagacggggtttccccttgttggtcaggctggtctcagtgtcttgacctcgtgatccgcccgcctcggactcccaaagtgctgggattacaggcgtgagccaccgctcccggcctattttgattttattttattctattttttgagaaggagtctcactttgttgcccaggctggagtgcactgtcatgatctcgactcactgcaacctccgcctcctgggttcaagtgattctcctgcctcagcctcccgagtagctggaactacaggcacccgccaccacgcccggctacttattttgtatttttagtacgggtggggtttcaccatgttggctaggctggtctcgaactcctgacctcaaatgatcacccacctcggcctcccaaggtgctcggattacagtcatgagccaccgcatccggcctatttttattttttaaagttttttagagacggggtcttgccttcttgcccaggctggtctcgatctcctgggctcaagccatcctcccgcctcggcctctgggagtgctgggtttacaggcgtcagccaccatgcccagcctgaacgtcaaggagaaagtgtgcaaggggatgcacgagcagaaagcttgagtgctagcgccttaaggcgacattccttaacattccagtccaaagaggctgtctcagtgcctgcctgtgggtcacaggttaatgctcctcctcccaacagccaaccggttaccaagtcctgctcgagccccctccttaatcctctctagaaactggctcctttgtgttgtttcccagcctcttccaccataacgtggaagccatcatctttgctttttggattgccaggatgtctccgtaactcctgttgagctccagaagtcctgtcactacctctcacatagcagacagggtgatctctccaaaagccatcactcattgactctatccttctaacatcccttggggactccccagttgcctgtgtaaagttagcgcagctataagtctgcactcctgatcttactctctgctccagccatcccagctgattggaggttttctcatgtcaacaagctttgttatcgctgtgctctcagtctgggccctagctaacagccttccctaggctaactcctgctcacctcctcagtagagacgtggctttctcggggaagtcttccctaacaaagctggattgagtgcctttcctttatgcttgcacagaatcctaacttagctcttcgtagctcttagcacacggtccgtgtggttgctgtctgatgggatgtcatgattcagcataaaatggtaagcttcatgtgagttgattatggctaaatcgtaataggagctccataaatatttatttgttgagtgacgaaggaataaatgagtgaatgattatgaggatcttaactggaagcaatactagcaaaaatggaaagagaccttcagtcaggatggaaatgagcagtccttggtgactgacaatttgtgggagctaagaaggaagaccagagtgatgcgggtgagtagcccagctgatgaggtggtggcaccaactgagaatgatcatgaagaagaaggaggtgcaacaacgagggaaaggtggtgagttcaccgtgggcctcattcaattggaggtgcctgtgggacacatctaaagctcaaggggaagagcagggctagagttgagagttgatgggtacagtattcagaggaagcccatggagacaaggagtggatcaagtccagaatgcagagctgcaagctgtattcactaaggaagaagctgcctatgaagggtagcaagaaagtggccggggggtctgacaagaaccaggggcttcaaaggcgctccctgaagccacagggtgtccagtttcgagaagctatgttagcagtttccaggcggcagggaagtccagggtgaaggtgccaaaactccccatttgatggtttttggtgagagagcaagaagttgagagatgtgatgggaatgggaaacattggagtgtggtgagcaggggtgaggtgaagacagcgtagtatgttgaaggtgttcagaagccattagggccatgcacttatgtactgagaagtgagcagtgagctagatgccacaaaacgctgcagcagcaggtgagactgaggagcagggaggggggtcaaggataatttctcagcttctggcctatgaatttatagggtggtgggaccatcctctggatagggaacgccagagaagagcctggaagtatgtagtagggaggtcagaagtcctaagctcattttgcatgtgttaggtaggttttgaagtgcatttgaggcattcacgtggagatgccaggggagcaggtgaatgatggtgcccagatccaggcagagataaaggcaactacagccaggtgtgcatgaagtctctgtggagaagggatgggtggagggagaggaggagagcctgggccagagccctgaagccaccagcatggaggctcaccaagagtgcaggagagcaggaaagaggtaggtgggtcccgggacaggagagggtgcagggccacacgggttggcatctgggacagtgacaaggacttcagcctgctggattcatcaactgcctgagctttcctatgacagaggtgggcatgtggatgagagaaaccaaaggcttggcccttacagtcagctgaggggcaaccaggtgttcagagcttccagtgtcttgcaagctgaggtggtggctttgaacttgagttgtttcatattgaaagagatgaacagaaagaggagtgctaaaggtatattaatcttaaaagaacattaatgagtttttaaaaaggggagagcagtttgcccaggctggagtgcaatggtgtgataatggctcactgcaacctacacctcccagctaatcctcccatgttagcctcttgagtagctgggactacaggcggaagccaccacacccagctaattttgtttattttttgtagaggagaggtctcactatgttgcccaggctgttctcaaacttctgcgtgcaagcagtcttcctgcctcagcctcccagagtgctgggattacaggtgtgaaccactgcatagagtgcttcctttactcaaatcatagaatgtttaaaaaccaggatatcagccatgtttcaaaaccacattattcccatggatgttttgttttactctcaaaacccaaaagcataaaatcaaacccctacatactggagacttcaggctttcaaagagattgggcaaatcaaaccaccttacttttcaggataattgataaacccatcagttgttgatgcttagaatggttagcagaagtaggtaggaaacactcagacctcaattttcatgaacttcacttttcacagtattttaaacaattagagatgttggaaagaggtaaggaagaattttactatttagtctgctgcacatattcttttgttgttgtttttttgtttgagacagaatttcactcttgttgcccaggctggagtgcaatggcacgatcttggctcactgcaacctccgcctaccggtttaagcgattctcctgcctcagcctcctgagtaactgggattacagacatgcgccaccacgcccggctaattttgtattgttagtagagatggggtttcttcatgttggtcaggctggtctcgaactccagacctcaggtgatccacctgcctgggcctcccaaaatgctgggaatacaggcatgagccatggcgcctggcctgctgcacatattctgacaccatgtgtctggtgaacccagaccctgtaaagaatcttcactggtgattgtttgatataggtgaccttccccctccctctttttgcctgattttatttccctttctagattataccactaaatcagaaagcactgaatattttgtaagtttgtttgggtgagagcaagaataatcttttcttgatttttatttttatttttttaaaacctttaactcctgctgaggttgagacaaaccgtatctagcatactgttacctgaaacaaatgtggtaggagggaaggtgatacagtcctgccattgcagaccagtgggaaaggccaaagagtattttgagtagcaatgtacatggtcaaagcattgtttatgtactatttcatttgagtttgattatgtagtttgaacctggctggtcaggatttgatagacagttactggtttgggatctgacttttcttttttataaaaattaacaaaaaatatatgtaaatatacacacatacatgtggatagttctctctgtgtcttaagttatttgtatgcatgcagctgttgtgatcacgtgtctgatgggcaggtagaagtagaaataagagttcctatgtttcccaggctggccttcaactcctgggctcaagtgatcctctctcctgggcctcccaaagtgtcaggattacaggcgtgagccaccgtgcctggccctacatttactctttaaatactttcctattggaatgaaagaggcagggtggctcacacctacaatcccagcactttggggaggctgagacaggggaatcccttgaggccaggagtttgagaccagccaggtcaacaaagcaagacctccctgaagggaaaaaacctccagttcccatttgggtgtcttttggaaactgctaatacctcagtctttgttgttgttgttggtatttcctccaaacacactctttctcagttttaccattttgtttttgtgaactaagcaagagcaggaattaatttatatagttattcatatctggacaaattctggaaggttgctggagtctctttcacttcttaaagtgttttcatttaagaaaaaaatctttaattgtagcctgcacaattgtagccctatccttacccctaaggtcccatactcccaaggcattgaggttaggtagaaggcccaagaatggggccggggcccattgcgtctggaatgcagtgtgaactgatggctgtctctgacctcatggacatccctgcaccttcctcctggtgctcgccagcaggtgcaggaattcagtcgtctatgggttcgtttcccctttttcgcgggtctctattccgtggtgtgaagagcctgtaagggtaaatgtcctatttgggtacaaccactttactcttattctgtcagaatctgtccaagcgtttttttggcttgtttgctgtgttcctttaaagatggttgagataaaaccagtcagaaaagaaatagttttttgccctatacttaactaaaatattgatttattccaaagttgtttttatttacttttcactgacctcaaagagaaaacttagacaccttagagaaacatgaaacattctcagaggaaggagtgatgagcatggttctgtattaatgtgttcactccttagcagaagatatagaaatactgcagcttaggccaggcactgtggctcatgccttcggaatcccagcactttgggaggcagaggcgagtggatccctggagttcgagaccagcctgggcaacatagtgaaaccccatctctacaaaaaatacaaaaactagccagttgtggtggcatgcacctgtagtcccagctactcgggagggtgaggcaggagggttgcttgagcctgggaggcagaggttgcagacagccaagatcacactactgcactccagcctggcaacagggtgagaccttgtctcaaggaaaacaacaacacaaactgcagctcattctttctaaaggtatctggaaaatgacagaactgagaataacatccagattcagttccctgccatgagaagttccttttgccttgtttgtggatattgttgtcagttcattgcagctgtcttgagtaacttacagaggctaatgtgaccaaagaaagatccatcatcccttgttgtttttctagttaaaagtcatagcacaggtttctggtaacatacaaatgataagacactgtccataattctaattacaacaattcagtttgtatagtaatttggtacagcattaaagggggtgatgccctcctcccatctcatttccctccctttttcctatttcacatttattcttttgtctaaaagacagaaaattggtatgattctcatatgccgcatagaacgtgtagctccatcacatcccacagctttctagaggtctttggggttggaacacaaagtttaacttctgtttctgtttttccttgaattcttttgtttcctggcccttttccatcttgccggttccccttatgttacccactatcgtccatgctctccctctgtgttggttgtctcaaaacagcattcagcggaattcattgagtgggtgaattctgtgaagttgccttttctggcagtgctgttactcagtgatgcacaaacgtagcatttgccctttggtagacaaagatctgtgttttttttttttttgtttgtttgtttctttgagacggagtctcgctgtcacccaggctggagtgcagcgggttcaagcgattctcctaccttagcctcccgagtagctgggattacaggcgcctgccaccacgcccggctaatttttgtatttttagtagagatggggtttcaccatgttggtcaggctggtcttgaactcctaacctcaggacctcaggcgatccacccacctcggcctacctaagtgctgggaacaggcttgaaccaccgcgcctggcagatctggttagtattcttcaaaggagccaaaggcagtgctttcgtgtttgctttgaggggaagtagtggacgatttgattgtgacaccttttagcattggtgagttgatttatctaaaattaactgttaaagttagctggccttatacaacgtaaaagtaaagaaaattcatcagtttctcaaaaaaaaaaaacaaaacagtggctgaagtttttgttagcaataagaaaacagtaggcatatatatatatatatacactttttcttttttctgggaatccacgttctcctcctgggtaaaggagagggttgtattttgtgattcctttttcctgccccaagtggctggcgatacagcccccggcgcgccgggcactgaggccctggagcacagcgtggggggcctggcacagacacgactcacgaccgggccgatctccggccagaaagaactatgttccggccgcccgggtcgcgggcccgcggtgcatccctgcaggcctccatcctgcctcggcagaggtctgcaagaatcctgtgggtgtcccccggagcgggcagaggaggagcccagcgccgaggcccaggcgcgccccgccctcgcccctccccgtgcccctcccccgctgctcccctcccaaaggccgagacctggacgctgcccggtggcctcggcgggggccctgtccttggccgctgcctctctgaatcccaggtgagaagaataaaacgtcctgacgctgtccggcttccggttcttggagaggacgggccgtctctgccgagagaactgtgcggaatcaggaagcgctggtgctccttcgctttcacgggactaagcgaaatccggctttaaacgaagtaaagccggctgcctcctggagtatttttgtcatagtatttttattttgggtcagggtattctgctgcggaccctgagtcttaggaaggaggcttataacagcggaaagccatttttttttaagaattgctgagttttccggattgtactttcaaagactttccctgaaactttgcgtggcatgggggttgcagaaactggtgtctacacattacaaaagtgtactgtttacacctatttgtgatgcacccatcgtgtttttctccatggaccacctattaagcttcctgctggagcgctcttggcccccttcctgctttctgggccacatcctgttgtaaatcggtgctacttgtggggttttgtttgtgaattggggatatttaaggaacaatttattgaaacaactgaagagtttgtttcctcctttgggttttacttttaaaataaattcggttaggaaaaagtattcttttgctagtggagttcaaattcaaatacccagactgtagattctccaaatgcctttctcaccagggagggcagctcccaggaatagtgacggcaggtaagctgggataaagctgacttcgtcaccttgtaggtggggaaggccagagtggatagtctggccaggcctccacagccgagccagcttctgctggggggcgggggagatgagaacgagaggcaggttccagtatcctctggacttgcaggaaggaaggcattctgcgtatcgctgagcactgcggtgagctgagtgagggttccctttcctcatgttttcctgcctttttcttcctcttggttctcttgtccctgagccgccttgtccactctttctattcccttagtgcctttccatctatctctcctgagtgcccagcgtgaaactgtacccaagagttaaaatctcttaaaaatctcaccgtcttgcagaaacaaattgtggctggtttaaagatcctcagctaaagagactgggctgaggttcccccataccagttggatttagagagagcctcttgtagggaggcctcatgtggtcttcacctgggcctcagcatgtgagccctcctttaacagagagcttgcccaagatctcactgcttgttaaaggtggtctcaaccccgtctgtcttctaagcttcccactaccccatgtctgagagcaaaaagccctctttgcaacctgagatcacactcaagatggaagactgtcaagcccatccctgccagattctattaatgtggtcctaatgggccacaccagcaaaaacaagctgcgttgtattcctttgaagaaaactaagtctgcctcagaaactagcagaccctgtaatcttcagcggtattattaaaaagcacacctgcctcaaagcccctggttcatccatggaagcatcgcagaagcctctgtattaggggcagctttacggcactctgggccccttttactcttggccagggccaacgccaaaggctagatggtccatgcttccaggtagcgtatcactgttcacagaagcagaaacaagtaatggggccacctccaccccccccaggtccctgccctcggagcaagtggccagtgcccatggtgcctcgaggcaacagctgcccctcctgccccctcccagtctctttcctgcagtatctggggacagacaggtgatagagtgtcactctagttactattgagcgaactgaagaaaatccacatggaaggttgacatctaccatacctcactttcccctctcttgatagtaagtgtctaatctttccctccaacccctgtgggcaaacatgtccatgcgttctttgagttctagctactggtcagtagttctgagtgtaggattgacatggtgggaggaggcagagctttgggaccacaccgccaaggtccctggggcctagaggtccagcgtgcccgcctcccttcctcgctgtgctcctttctctcccccccacccccacgctcctggtttctggagccgagcttggggtggggaggcagcaggtagggtcttcaagttggagagaaaccccgcccacacctggacctcgcccctcgctgccattcccagccgaggccgtcaggggcctgcgttttgagaaacacaatctggaagagaaaacctgggccttttcttcttttatcccctgtccccgcccccctacacctcttacaaatttagcccaggagctttctatccccaccgacttgaagggtttatcggtcttaagagcgaaatcctggcggagtgcagtccctcggggctagcatccacgttccgcctgcgccctgcccgggctgttccgagggatccccgcaagggcactgccccagctttcactcttggagtcggggaaataaggtgtccacaaaggatgcaagcaagtcattgtcagtgcagacccgaagggcgcgtccggagtgcaggtatgaaagacgggcgcatgcgcgcagtccggggccgggcttcgcagcccgggctccgctctagccccgcagcgtctcggtggccggtctcgtcctccgcccgccgcgcgggggcgccgctctagccccgcgccatctcggtggccgtccgcccactccgcggcgttcggggaaatggctgcgagaccctagaggcctgcggcctgcggtaagtggcgtcccgggcgccgggtagaagagccggccgccgcttgggccgccctcgggagcggggcggggccggcatcggagcccggctggcgagagccgcggatcccgcacaggccgctcccgccgagaagatggcggccgcggaagggaaggagcgggcgggcgggcgggcgagcgggcggggccggtcagagccgccgcggcctggggcgcgggcctcagacgccggccctggtgggctgcgtgaggtcgaggggactggcgagcactcggtggtcgcggctggaacggttccgagggtgggagtcggggcggccgctcgcggggaagagcgcagggctggcctgggcgagtgcggcccggggctcgggggctgcgtagctggcttgtaagcgcagctggtttccctaggcattctcggggacctcggcgcttcctcccgggccttgggtgcggtcggggtggccggcttagcttctggcgtgccttcgggggattccggcactgcaggggcggctggcgctgcaggaagcgcgaagagcccggattcgcttttctgaagagtgtgtccttacctccccgcgctggttttcagtttttttgtggaatagtttgttgcgttggtttgtactggccgtatttgtgacacattttgccttccagtgaccccggaagccgaaagggcccgctcttgcgctcggcgggaggggtgctcgtgctgcctccgctgcggcgtccggggctccttctcgcggttctgagacagtggaggtcaaggccggcttttctgctctaaataaaggactttaatatataagtttagagtttgggccacaggtagcagtagcttactgcgttaccagttattgaaaatactctttaacttgtgcctgggccttcgatatccgtgtcatctgtctgctgatggaatgagatttgagcctagtgtactcagggacttagaggagggaaaggcagatgggaacgtcttttcggtatattcacataactttgctatataccccgtgttccatggtttccgtagggccacatatgacttggttgaaatacagttctgagaaaggtccttagcagtgccttttaaggagtaaatacagtctttttttaaatgagcattcattgcttactgttagcacgagggatacagcagtgaccaaggtggcccctgtcccagtcctggagacaagttcactggggaacttgagagattattccagctccttcctttaaatcaggtgttgccaactcgtttacctggagcctagggctctttagtggccctttgggttgctgttagtgtatgtgtgtctgtgactatttcactattttaaatacggcatagacatctcagaagtgtcacccaggaagacagacacagccctgttgtgaaactccctgcttaatgcacacttgttttcctacttgctgtgtacatggggaggagatgtctgttcttgtagacttgtttcagcaagtttcataagatacctcttgttttggaaaagcgcgtatcttgaattttttcaggctttccaccagaggctgtcccttattagtagttgattgaattcagactatgtcaagcagagctcattgtgctgtggtgagaagacagggcacaaataagataatttgtgattgactgcccagccgtacccatggttaccagacagcccagcccatgttgcatgtgcatatgtgagcctcgcaaaggcttgtctaggacgtgcggatcatcggttgggccttggagggtgctggggtttcttcatgtaaggaggaaatgattggaatgggcattggctcccgttttgttcgcggtgaagttggcaggttctgctgttgatactgtgagtttttctacagccttagggtcataattcccttaaggtcagttctgtggagcccagtagggtgcttctcttcagtgtttatttttaagctgtgccacgtcttcattgtttggaatctctgtaaacaagacacgtttttcctttttatatgcctgtcccataataccaagtggcttatttggctcttgaagagctaagattgaaagtgtttaacaggtgactccctactatctgtgggtccctgcactgtgcccttgcctgagaggtctcatctctctctggcaggctcagaagaccactagaaaattctctctaaacagagtctctcacttacatttcttatttaaatgacggggtcccttacagtggatactaagatcagcctttttatgactactatcaaatgatgtgtgttaattgcattacaaaagttctataattaacagttaatggaaatgtactaattgggaaagaggaggtcaaagaacaaagtccagtttgctcatttcatgtacgtgtacacagtcatctgtgagacagtctgtgttgtctaggcctcattttattttttgagtagtaattttgaggttaagttgttatatgaagttgaataggtaattgtacatattttaataagaattctgtaaccatgtccataaaacttaataggcggttgtaatcgtgtgtaagttgtaaaggaggcatttctctccttgggtatcaaattttgatgccgtggttttgttttgcgtatgctgatatagacatttaagtggtacttaatatacctttataataaggtaaatcaactttttttccaaaatgaagataccttaatgtgtttgattacaaaagtaatacacatacaggaaacttaaacattatgtaaaaatagaaagtaaagacactagaaagggtgctgtccagaaaagctccacgttacagctgttttgcactagtgaacgggatgcgttggaggctgtggccactgccctggccggcttgtctgcggctctcactcaggtgccagggagtttttctcacggctgtgcatgtgatgattcatcacccttaaagaattcccggccgggcatggtgggtcgtgcctggaatcccagcactttgggaggccaagatgggtggatcacttgtcaggagttcgagaccagcctggccaatatggtgaaaccccatctctaactaaaaatacaaaaattagctgggtgtggtggtacgtgcctgtaatcccagctacttgggaggccgaggtgggagaatcgcttgaacctgggaggtcgaggttgcagtgagccgagaccgcaccactgcactccagcctgggcgacagtgagactctgtctcaaaaaaaaaataataataattaggccaagcatgctgatgtgctcctgtagtcccagcactttgggaggctgaggccagaggccagaggaccccttgaagccaggagttccaggctgtagtgagccgtggttctgctactgctctccagcctgggtgacagagcaagactctgtccaccccccacccccaacaaaaagaatttcactatatagatgtttcttgatttttcaaactggtctgttagtttgtgttcagtttgtcacctttgtgagaaaaaaaacactcataagttagtgtgtacttcctacttaatttctcctgggtcatcgtgaagcactccctgccctccatgagaacagtatgtcacccgctctcttccctgtgccaagcccataaagggctgttggcaaatatgtcggacaaatagactcgcctaagagggcctttctctccaagccctcgccagcacaggctgtgtcactttcttaggtggcacctaccgtctgttgcacacttgccgcagatgatttggcacaggatgtcgcttcagaaaaccttgtaggaagctgtgaggtcgttaccgtccccatttcacagacaggaaagtgcaggccttagatgcactgcctgataccctgtggcccccgcgttcctagacagatacactgcctggtacactgtacccccccacccccgctatcgtttgcagctggggttgaaccctgcattcatagacaggttcccccttgagtgagccccccatctgcttaactgagggcttgtcctggttataaatgtctgggtgggggtgggcactgctggctgcagctgtcaggactgggaatgctgaacctgcactgaggggagtaggccccagagatgctcccaagaccctggagacacaggccaggtagacacctgtgtgtgtgtgtatatatatgtgtgtgtgtgtatatatatatatgtgtgtgtgtgtatatatatgtacatatatatatacacacacacacacatacatataaaagagccgggcattgtttgtgtgtgtgtgtgtgtatatatgtatatatgtgtgtgtgtgtgtgtatatatatagtgtgtatatatagtgtgtatatagtgtatatagtgtgtgtatatatatattgtgtgtatatatatcgtgtggatatatattgtgtggatatatatatagtgtatatatattgtggacatatgtatagtgtgtatatatattgtggacatatatagtgtatatatattttggacatatatagtgtatatatattgtggatatatatatagtgtgtatatatattgtggatatatatatagcgggtatatgtagtggatatatatagtatatatatattgtggatatacacacacacacaatagctgggcattgtagtgcatgcttgtagtcccagttactcaggaggctgaggtagaaggataacctgagcccagggagattgaggctgcagtgagccgtgatcagtcgctccattgccctccagcctgggcgacagagaccctgtctccaaaaaaaaaaaaaaaaaattggctgcagctccaatttgagaagcaaattcttgtgagagaagggtttttaaagaagaaaccccattctctccacctgaacttagggtggccatcatctcacttggcaatccctgcctggtcagtaatcacatgaaactgaatgagagtagacagggtgtctggaaaaagtgaatgctaaagcagtacctgtcactgccactaggatcctgactgaaccggaatggcctcggggagcagcctttcaggctccagcagtggaaggcgctgctgtgtcagcggttaccagactggcaggacccaggactgctttacactcctaaaaagcagggaagaccccaaagagcttttgttatatctattgatagtcaccatgtttgacatttaaaaatgagtcatttaaatgctgaagtgccttctatttaaaattggaaaccagccgggcacggtggctcatgcctgtaatcctagcactttgggaggccaaggtgggcggatcacctgaggtcaggagttcaagaccagcctggccaacatggtgaaaccctttctctactaaagacacaaaaaaaataactcggcatggtggcacacgcctgtaatcccagctactcgggaggctgaggcaggagaatcccttgaacccaggaggcggaggttgcagtgagctgagatcgtgccactccactccagcctaagtgagagcgagactccatctcaaataaataaagtaaaattgtaaaccattatatattaacataagtaaaccatttagtggaacctgttttcaatgacgaaaacaatgagaaagatggttttgttttcacaaatctgtttggcttaactgacagcttctggattctccttccgaattcaaacttagtgtctccgttcagcttctgaaatgctctagcatatactcagagtggctgtggaaacagcatggaatgttggtgttgtgcagactgctttgatccgggggcctcccaaaaggacccctggaccacgctttgagaaccacttctctaagagttgtaaaatagctctaaacacttggggaaattgattacttttaggaagataagctgtgtctttgaacaatttttagtggctcaaccatgtgcttgccccttggggcaagtgtggaatcaatctgatgcgctgtcaccggtaaagctgttccagtacacacctctccctcaaagtgccctacacagccccttgctgaatcctttgcagcagtgaaaatcgggggttggggggaggcaagagtaggctgtgcttggggccatggaattatgcaggtctctaagggtgtggaccgaggagaacataaaggaacagtgatttaaacctgtaataaacagatgcccttgaggggaagcagcccccacagtaccctgctgggatgacctcccgcagcgcaccccactcacatggtacccggggagctcacactgccacacttgcggcatgaggtggatttcttcatggggataagaacctgtgcattgtggtcctcaccagggcccaagtggtaatcttttattaagagcaacaggaatcctggtatgtagaattgggaccgtatcttaagtgtttgaaaccatactttcttttttactgagacaagaggagtccatcaaaggtagtggtttaggagactttatgtccagccattaaatagagaacaataaacctcacttctccttcacctcgataaatgattttatgtgactgtttctggttcctggcattcatttggagagttgaaatttcccacctgagttgcccaccaaggtcaccagcctgtgttttgcactaggaagtagatagagggaaatggcaggattgttgcaagctcacatggggagcttggcggcccggctgtagccgggggctggccaaagcattagtcctcagcaggtttttcagtaacaagttttgctttttgtctccgcgtatctataaaaacacaaatacccaagaaatgtaaaacaacaataggttgtttctggatttttctctacattttctttgtgagaaacatactgtgttgtggcacccttgctgctttttttttttcttctttgagagggagttttgctcttgttgcccaggctggagtacagtggcacgatctcagctcactgcaacctccgcttcccgggtttaagtgattctcctgcctcagcctcccaagtagctgggactacaggcacctgccaccaagccctgctaatttttgtgtttttagtagagatggggatttcaccatgttggccaggctggtctcaaactcctgacctcaggtgatccacctgcctcagcctcccgaagtgcaggcatgagccaccgcacccggcccagaataatttttgtaatgacggtattatttggtaagcagcaaaactttgaatttgccgtctgaaggatttaaatgtaatctatgcaattgagtcagattctgcatagatactaaagtaaatgaaagttgggcttcttcagttccttgtgggcccaaatctctttcctgtttggtgagtgcagcacagtgtttcctgccgcaagctggtggagctttgagtgggccatcatggtacatgaacggctgctgctggtggctggagaacacgtcgcatttggggatgtcatctgaagtttctaggcatattctcctagtgactgtcgcattaatgaaaactgagctatcaagagtctttcattgggtaatctttccttcatttgtggtagtttaaagatcttttacctagtgtcttctcagttgctcctcatctgcataataaaacagattgatgagccaggagacccttaataggcaaaatataaataaatgtaaactttggcctaccctgtcagaattagcgaaaataatgaagtttagaatagtgaggttttattgtagcattataatttctgactggcgggttaaaattgttttgaatattgtttcaggggaatgtgaggtttgaagaaacagaatgtttgccactaggtgaggtaaactatgcatttttgttttatctttttgcttagaagtcagagctcttttcctggaggtgcgatgttatgaaaatagaaacttaattatggttgtatgtcatattttaaagtgtcttggagattaattactcagaaactagtctcaagtttttggaactgaaaatctttaggtgggagctgggcactgtggctcacgccagtggtgtcccagctactcaggttgaggcagaaggatcgtttgaacctatgaggtagaggctgcagtgagccctgatcatgcagctgtaccacaacctggaagtgggcacgcttgagttaatgacttcaagcagattttagagtagtaaaagttgagcatacagatttgcagtggttgcaaacccatgcattgtaatagttgcagttaggctttttaaagtaacagagctgaccttttgggaagatatttttatttggtttttaagaaatttcacttttggctgcttactgttttggtgagttggggaatctgagggaagattaacaggtagttacagaacccttgtggaaggaaatgtttaaagtctcttctgatgtctgaagcataggtatgtattactgctttgcacatatccagtgtactcctaaactggtagaaatggcatgttgccacagttctttgtgtttcatggactcctgagggggaagtccttgaagccctttctggggctaagaggtaaagatgacttctgcataataatagtctaatagtacaggccttttctggtgagtttgacatttgcatcggtggcacagggcagattggagccctcttcagcaccgtgcatgggcaccgaatgtttagaatatgccaattttcccaaataatgtccctgatgatgcagtaaatattaatttttttcggaacccgcaaacatacatcttttttactttcgctgtgattaaatgtcaagttatatataaagcttctgctgcatccccacgtggtactgtccacgcacagccctaggggattgagctgggagccgagtggtctcggaaacgctgtctgtccctgacagaacaacagacggaggacagttttcagactcagcatgtggcaggcgttttgtccaaaacgagtgatgtctcaaagaaaaaacgaacagtatttgttgctaaggataaaatttgagctttggggtgaaaattggaattttagaaaacttgtatctgccattgtaaacctgatggctttctagtaattaaagtcttcttggagattggacccgacattatcggccaggtgaggtgactcacacttgtaatcccagcactttggaaggcggaggtgggtagatcacttgatcccaggagtttgagaccagcttgggcaacatagtaagaccctgtctctacaaaaaaaaatgcaaaaattacctgggcatggtggcatgcacctgtagtcccagctactggggagggtgaggtgggaagaccgctttgagcctggcggtggtgtgggtgggggaggtgctgaggctgcagtgatccttgattgcaccactgcactccatcctgggcaacaggaaaaaaaatgtttgttttatgctatccgatgagatgtgtggacattgagaatctgtctgttacttgaacccgtgtcatccaggtgaacagcatgcacatgggtccagagtgcaaggacgtgttcagagtgaacacagcagtcagttttcatgaaagaaagggagaagttccttgacaaaggctgcaaattctgtttcagctaacttttatgaaactgctccttggcgagagttggtgtagtatcagtgaacatccagttatgtgaagatggttacaatactccattctaaagacctatctgtgtgaggcaagattttgatgacatgttttagctgaaacactctatgggaacagattgagggcagaagtagacatgaacatggagctgtcttcggttatgccagaaatttgcaaaaatgtacaacagggccactcttcctgttcatttttgtttgttttagaaataactttcatttaaagatactattaatgtattaataggtttatttttaatacatacttagaattttgaaaatagcaatacattccacataaacaaaagctctttggtgttctcaacttgtaaaagtgtcttgagacaaaaggtttgagagccgccattcaagcatttggaagtcagtgtgtgtcctctgcttgaatcgccgctcatcagctgcttctagtcaatagaaaatgaagcagttttcagctggggaaaaaaatgtgcttagaaatgtggaaatattaaatttggtacattctgttttaacctgtagtttgttcacttcccagcttcaaggatacccacatttttctttctggggaaaagttgttactgatacaatatggttgcagttttatgaacacattccccctgtgatgggctgtgtagtgtgtagaattacacactaattatacacacaaaaagttgtgttagaacaggtttttttgcttgtgccttgatatacatatgtttttattttacaagctgactgaaatgttatagtaaattttctctgttgaagacattatgaaatcagttttgtaaatataaagtgatctgatcttttccgaaggtatatccttcattgaattctacttaacagaaataactacatttttctgattactcagaactcaaatctagtagcgtgtttattcgcagattaacataaattgaatttttaaaaatcagttttcgttcccgagaacttcttaatttctttgcttttataaatgttcagtgttggctgggcatggtggctcgttcatgtactccccaaaactctggaggctgaggcaggaggattgcttgaggccagcagttcaagaccagcctggataacatagcaaaaccctgtctctaaaagaatttttttcaaaaattagctgggcatagtggcacgcatctgtagtcccagttgctcatgaggctaagccaggaggatcacttgagccccggagtttgagactgtagtgagccatgattgggccactgcactccagcctgggcaacaaagcaagatgccaactctttaaaaagtaaagtaaaataaattaaatgctcagtgttgcaaaatataaaagtttatttccagtgttttctgagcagtcgtttctgaattcttgaagtaattgttttgaggatgatagttttaccacattgaagagatggtgactatgacgatgccgtttggcttatcagagggaatgcctgtcttatttttattttttgtagagacagggtgtctacatggtgacacgttgcctgggctggtgttgaactcctgggctcaagcagtcctcccaagcagctgggatcacagatgcgaaacactatgcccagttgtcactgtccctttaaaaggaggggagttggaatgtttgtccctttgttctgaggttgccagggagaccacagagggaaggcagttggtcttgaggctgaggaagaggtgagagctggggctcagtttggaagtgtcggctttggggcaaggacctagctagaaactcggcacctggaacctttgagtgttgtgatgtgactggttgagagaggatacaagagaattgtttcttaaacacacgtggtgaactgtatcgtgttgattttagtacgtcacaaacattagtattctaaaatttttcttgtttttaattaaaataattcagatacattattaagaattttcaattattacattcttatataatttcgatgttcagccttttcactttttgttcttgttcctctgttttgtggtggattttattgagtggggtccatctcggacataggctccaaatggaaaagaagctgatgcttggcgactcctctctggccctggtctggctgggcctctgcctgcctccctggggcaagcctgggactccactccttcctgcgctgccccggcccctttctcttgggggttggtagcatctgctgtcctgggtagaggtccttaaggacactgcttgcgtgctggttttcaacccccaagctgtctttgtgggtcacacagtatcactcaaataataggttacttgagaagttcggtactcccttttaattgttgtcgatacgtagtttacttaagatatgtaaaatattttcttattttcttttaggagcttactccacgggaacagcctctagataatctgagttgttgaaaatacgaagcctgttactcgtgaacagtggctgacaacagtgttgttgtgagcctggctgtctgcttggacccagaggtttcgtctgccagggtttttggttgtatttaggatttcagggaaaagtgtccaagctttcagtgttggagcaggtaaggtatcaacactgttagtagcaacaaaattttaacttaataagtctgtatttgctatttataaagtggcatttgtaaagaaactgatagtagaatgtagtattcgtattcatttgaaatacattcagccatttgtatcagcagtctctatagcagcagattctgcatctgtggattcaaccagctgcagattggaaatatttgggggacaaacaataaataataatctgacaataaaaaataataaaaatgttataaaacagtgtagtacagcaactgtttctatgatgtaatctagagatgatctaaatatttgagaggttttgcataggtcatgtgcaaatagcctgttctctctttaatgagaacccagttttataaactagagctcttcctgtagaaagctaccagcatggatgcagcagcccttttcagctgggttggagcttcataggcccccagaggcagaggcgactgcaactttgtgcccttctgggcaaaggctagtgcgagcccctcagactacatctttactagaaactccaagtgttgcatgaaaacgagagcttgaccctcttttgagatgacagtcatatttcttgcaaatattttggcttgcacaagcagaaaacttcttctaaatgtaaaatttccaatgagaacgaataaaccattttaactgatgtggtttaataattgctctaccatatatatttgtaagcagcattctctgctttgcccttaatctttgaggtcagcattgcctcctggatcagagcggttccttgtgacttgcctggggtcacctggctggtgaaggaagcccccctttctgtttaccaccatctctagtgcccccctcacacagcagcctccagagtttgcaccctgacttggagtcgctgctggtgccctgattgagttgagctgtgtcctttaacaatggggtcacttcaggtgagcatagaagtgatgtgtcccttatctccaaggcttccgtggagtgccctggggggtgtgggtcatgtttacagagcgtggaggccacggccaggcagcatctttagctggacaggaaaatgagaagtgacagcatttagagggaagcaaaaagaacaacacaggttacaggttgcaagtaattttccattttgtattttcgttctttttcttttttttgagactgagtcttgctcgcccaggctggagtgcagtggtgcgatctcggcttactgcaacctccacctcctggattcaagcaattctcctgcctcagcctcccaagtatctgggattacaggcgcctgccaccatgcccagctaatttttgtatttttaatagagatggggtttcaccatgttggccaggctggtctcgaactcctaacctcaagtggtctgcctgcctcggcctcccgaagtgctgggattatgggcttgagccaccaggcccggccccattttgtatattttttaaggctttcattttatgccagtccttcccccaggatggaacatggcataaaatcagagtcatcattagcattgaaatgtaattaaagcttggacagcttggaaaagaattctcaaagtatctactgtctttttcagatttttgtcatttcaacaagagtaaaagtttcataaataagattctttagtaatgtattagaatgaaagtgaaaaataatacagaaaaaaaaatatactggcctggcacagtggctaactccagcctggggacagagcaagactccgtctcaaaaaaaaaaaaaaagaaatataccttaaagtgatcgccttgaccatgttttctaagtgtcccagttgtcttgctgctaacaatatctccaaagctcagtagactaaaacaaggtttatttcataccacacaatctgttgggtcaggagttaggcagttctctcacattgtgcccgtgagggtcattcacttggcagcagggctggtatggagggtcccagatagtgatagcatccttcctggccccagcccctggttggggagctgaaagtcgggactcagcttcttcatatcctcttttcagcatggtggtggccagcccatacttgcaaaagtccagaacagacttgggtccctttgcaggccacacccaaactggcacagcgtcttgttcactgtgcttgtggtcagagcagcccatctgcctgcggaggtgctggggagctcgtgccacctccgagctgctcgcgtccttgctcacgtccttactcacatccttaccctgctatactgtccaatatttcctatttgtccctactgtctggcttgtgaagccttgtcctgagcagttaaatgatgaaattgtacatttgatttgttagctgtatttttgtctaaacgttagttgtttaactatattaaaattatctttacaaatcatcttgaatcatctcacatagcacacattaggaaacactggtcagaaggacttgctttatgtagagctccactgtttgtagggaggtggcccctgctgcgcgtgtttggcggcaatgtcaccttttgttctgtggtcagttggtcactatgtgcttacactttaccgctaggtatggacgacaaaggcgacccgagcaatgaggaggcacctaaggccatcaaacccaccagcaaagagttcaggaaaacatggggttttcgaaggaccactatcgccaagcgagagggcgcaggggacgcggaggctgacccactggagccgccacccccacagcagcagctgggcctgtccctgcggcgcagtgggaggcagcccaagcgcactgagcgcgtggagcagttcctgaccattgcgcggcgccgcggcaggaggagcatgcctgtctccctggaggattctggtgagcccacgtcctgccccgccacagacgccgagacagcctccgagggcagcgtggaaagcgcttctgagaccagaagcggcccccagtctgcttccacagctgtgaaggaacgaccagcctcttctgaaaaggtgaaaggaggggatgaccacgatgacacctccgatagtgacagcgatggcctgaccttgaaagagcttcagaatcgccttcgcaggaagcgggaacaggagcccactgagaggcccctgaaagggatccagagtcgcctgcggaagaagcgccgggaggagggtcccgccgagactgtgggctccgaggccagtgacactgtggagggcgtcctgcccagtaagcaggagcccgagaacgatcagggggttgtgtcccaggctgggaaagatgacagagagagtaagttggagggaaaggcggctcaggacatcaaagatgaggagcctggagacttgggccgaccgaagcctgaatgtgagggttacgaccccaacgccctgtattgcatttgccgccagcctcacaacaacaggtgggtcatgtgtgggcacccacagaaatcccagggttgcaaacagaattttccatttgttttcattttaaagggttacaaagctgggctggatgagcgatttgttggaaaagatgaacaagttgtcaaaaaagaaacacataagagtggctaaggacttcctagagccacctctccactctggtagccactggccacacatggctgtttccagtcaagtgaggaggtgaatagcgccccaccccagtcacgtgagccacgtgcagccagtggctctgtgtagacggcatggaggagaatgtgtccgtcactccggggtctgtctgagactgctcctctagactgccccttgggagacatagcagaggggcatgtgcagaccgcaagtgtcctagtgcaaacattggggcagctcaaaagatctctgctaggactgggtgtcagacggtgataggcagcctgttggcttggcgctgggataaaggcattgtcgcagttttggggggagacttgctgaggtatctgtggtggaatgccttagagtttgctcctaaaatgcgctactcttaaaaaacggtgaagtaaatttggttgaatgttaaaatcaaaggaaaggcatgaggacgttcttaatctctacttttctgtatatttgcattttttcatgaagttaaaaccaattgtcttattaatgtgttgaaaagtgcttgtcactcacgtcccattgctaataccgttattttataatttcaggtttatgatttgctgtgaccgctgtgaagaatggtttcatggcgattgtgtgggcatttctgaggctcgagggaggcttttggaaaggaatggggaagactatatctgcccaaactgcaccattctgcaagtgcaggatgagactcattcagaaacggcagatcagcaggaagctaaatggagacctggagatgctgatggcaccgattgtacaagtataggaacaatagagcagaagtctagcgaagaccaagggataaagggtagaattgagaaagctgcaaatccaagtggcaagaagaaactcaagatcttccagcctgtaagtgtttgtccgctgagacgagcattcagcagtcggcctcactggtttcagtctcgctctagatagaaattcctcccaggacgggtgctgcacccatgtggggcggtgcctctcccgggttcctgcctcactccacctgggtgaggcctttctatttttattcttaccctgtctacctcctctactattaatgacttaattgttgaaatcagcccatctttgaggatttgggtgttgcttacatgctttgtatgcattagcagaaaggaattgtttctgaacgatgggagtggcggtgctcctgtgtcacctgctgtctccagctgcctcgtggttctggtgctggctcctcggggtgcttgtgttgagagtggtttctctgtcttgcagctgtgttgacacttaattctctccccctgatgtttatgacatttcccacatgctgtcagcttctgctgctgtcttgtgtttgcagtctccattccagtccccacagggcaggtgtgacttggcgtgttttcactctggtccctccagggtcccgggcctgtccccacccagctgcctgtcctctggcaggtattggaaattgctgtgtctagaagcatctctgccttcacactcttgcactgcattagctgcaaggtgaggatgtccgaaggctgggccgtgcacctgggagcgtgcccttggaggcaggaggggctgaaggctcatgctgcgctgctatcagaggccacatctgggcattcagagatgaatggagatgggaattcatgagaaaagtcattggctttatgtctttattttttaaatatattgattctgttttttgtgcagttgaggcttcgctctgttgcccaggctggagttcggtggcacagtcccagctcactgcagcctcgatctcctgggcttgagtgatcctcccaccttagcctcccaagtagctgggactacaagcacacaccaccacgcccaacatctttttttaattgtcattgtgcttgacaataccctgcacaaacctaaattgtattctcaataaaacttagattctgtggaggaaaactgattatgttaaatatttaatttgagaaataaggtttcgcttaagtatgtgtgagggacatgttcgtgtgtgttgaggcctgatcatcgagacagactttgtaaacagcagtggtcaagctgtttgtggtgcgtgagtttcctcctgctgcacgatgagttactgcagtcctggcttgaaggagctcacatttatgcctccatttccatgggaagcctggacctgctgctcaggtctcacaggactgcagtcacggtgcagcgggggctgtggtctccagaggcttggcaggggattcccttccagaagccctcacgctgttttttactgtataagtgtgtctggccgggtgctgtggctcacacctgtcatcccagcactttgagaagtcaagatgggaggatcacttgaggccaagagttcgagaccagcctgggcaacgtagtgagacccccatctctacaaaaaaataaataatgagctgggcgtggtggtatgtgcctgtagtcccagctactggggaggctggggtgggaggatcacttgagcccaggacatcaaggctgcagtgagctatgattgtgccactgctctccggcctgggcaacagagcgagaccctgtctcaaacaaaaaaaaaagtatgtttcatgcaatttggggggcatacttacactgaaaaattactcattgtttatctgacattccgatttcattggcatactgtattttacttggcagccttgccctcagatcctagccacagctaatcctctcaaagcagggaagcttacttcaaaaccagctatgaagtcttctctcttcatgaaagacccagttccttttttaagggtttttacctgatttagccggacccatttgacttgcagtcatcccagttagatccttaattacatctgaagaagccctgcatgtgggtcctctagcggagcctcatcgtggatgtgaggtcccgtgggccccgcccaccctcgagaggggtgcacagagcagagggcggcagtccaggggtctcctcacactcctgccccctgcagggcatgacgggcagtgacagtgtgaatgccttacctggctttttcatagcttgaatcaacaaaatgtttattcatattaaaagtactgttagtatctcattttgaaactgtggccttggtactataaatggtgattttacaaaacacacacttaactgcttaaaattggcaagtacattgtttgaagtcatctgttttgttctgcaggtgatagaggcgcctggtgcctcaaaatgtattggccccgggtgctgtcacgtggcgcagcccgactcggtgtactgcagtaatgactgtatcctcaaacacgccgcagcgacaatgaagtttctaagctcaggtaaagaacagaagccaaagcctaaagaaaagatgaagatgaagccagagaagcccagtcttccgaaatgcggtgctcaggtgagtggaccaggaccagccgcccaggcagtggacgcacaggcgtgagagcgtttgtcgcagaactgttggtttgtagaccgtgtgggggtggcaggtgtaggggggcgcacacgtggtgtcgccttgacctttgtcttccaccttcccaccagttttcccttctctgcccgttagctgaggggttaattaacacaagtgcagtaaagcaaatgctgacaatggcagtgtacggggggcataagacttcaggacacaccctgctgtcttgtgagaagagttggtaaccacccggtggagtttgtagagcgtagacttgcaggcaggtaggagtgggaggcgggttcggggcaaggctgtggtcttcatttaagacccggctctcagagttgtctcatgtttgtactccgtgttatttggaaagaactccgtgttatttggaatgtttagagatcgcaaactcttgtcttagacttgaaggcccttgtgaggctcaggcggcggtggctgtgtcactgccccggttatgtttgtgaccagcaaagcgcaactagcactgttcagggagttttcttgattattttcaaatgattatttagcctttgaatgacttaatttttaaggctggtccttttgaaccctcggcgttgggcacagcctcgcgcgcaggcctttcctctcatttggctcatttggttcattgccgcactcctcctgtcatcttggcagcctgtccagtggctgctgctcctgtcatcttggcaacttggcacctcatcagggttgcaggtgactctgtgccagccgcccttcacggagcacaagtggttgaagttctcagttttgcacggggaaactgcgggcccaccgcgggcccaccgaatacgcaagtgtgttgaactgctgccaagcaggcgcaggatgggtgcagggtcttcagatggcctcaggaagacattgggtccccgccttcatctctcagtgaaatgaagtgaaggtatgatttcttacctttttaatgatttggggttttactgattatccaggcaggtattaaaatctcttctgtgcacaagagaccagctccagaaaaaaaagagaccacagtgaagaaggcagtggtggtccctgcgcggagtgaagcactcgggaaggaagcagcttgtgagagcagcacgccgtcgtgggcgagcgatcacaattacaatgcagtaaagccagaaaagactgctgctccctcgccgtcactgttgtataaatgtatgtatcacctaggggttggcctcctggacccctcccgttctttctggatagccatcccctgggcctgtccaggactgggagttgcagctttgtgttaagctgatcacagacaccggctgcaccatcagcgggaagcagagcccatgtccaggatgcctcctgctgccctgtgtccatccctagtctgtcaggacttcctgtcactgttttccaaagctgtaaacctcactggtgaacgttcaccttaatgattgattctttaatctctgttttcactctcaggctctggtaagtattcgtattctcttcatcccagtctgattgcatagccacactgcccggcacgccacatccacccctgtctgcacatgagttgttctgacaacagcgctgtatacgcttcagtttttccacattgtccacggccagcacatgaaagcatcacttcttttttatgttgtgggaatctttgcaagttagtgttgcatctgattttcaggtgtacatttatttttgactgggcagataggggatttttttttttccatgtccgattcacacgctacacacccacatgaacacattcgaacttcgaaggccacacactcctgcttcataggccccacggtaagtgagttcacacctagaacactgtcctgaccgcaggacgcgtgccttggacttggtattctacatgtgactggctttcttgccctcgtctcttgaatgtttagactcttaagatcatatcctgccccaaatttcaaattaatgaaatgaagatatttcaaacagatctttgaaacctcagattctgtggtgcaattttaatgttttcttgtttctcagttttctgctataaaactattttcaattcagtctttaatgccttctgtctatagtgcattttgtgctttttttaaaaagcaccgaaaggttaaatagtctcaattcaaagatgatcacagagtgccccactttcccgtcgtcagactttgagcagattccctaagggaaggcactcatgcaggcaagcagacctatgctaggtctggtgtgccttacaaaaaagacactttttttttttttttttttttttttttgagacaagagtcttgctctgtcacccaggctggagtgcagtggcatgatctcggctcactgcaagctccacctccgggttcaaatgattctcctacctcagcctcccaagtagctgggattacaggcccgtgccaccatgcctggctaatttttgtatttttagtagagacggggtttcaccatgttggtcaggctggtcttgaactcctggcctcatgtgatctgcccaactcggccttcccagagtgctggaattgcagatgtgagccacagcgcttggctaaaaatatgcagttattgagtatgagtagcttcataaaagaagaaaaatatgtccctcgttttgatcatgtaaacagcctagacctaagaaattgagccgcacataaaatgaatcatgcaattgctgcattataatgaatctcgataccttacattgtttgagctgagaattttatgctagcaaatgtctcaaatgttcatcagattctagcacctctacgatagagcagttctacagagctaatgggcttaaagtgtcacccacctgtgaatgcagagagagggatttttaatgctgtactaaaatttagctgtacattggttttagacacataacagtgaagaaaagaaaaactgcggttatagcctcagttcagataagtgggtgataatttcagtttggttaatttccatctgtgtcaaccaaaattgaaaagctgccagagactccacatgtggagttggaagagtccgtgtacattgtggggagggagcattggtgggaagatggggaaatgaggggctctcagccctgggttattgcttcctgcctgcctcctgcactgtgagcggggagaggtcgaccaggaggctgctcttctgcccatagcggggtactctgacctcttctccctcttcccttctttgccacacatcagctcctctgggaagctgatttgctccagggacaggaggtgggggaaattgcctgttaaccttcccaacacatcacctcaagttaaaattggtggatttccagaatttgtataggatgggaatggggacgacacacttttgagctagtagcttctgctcgttttgttatcccgtaaatgttgtcttcccaaaaggtgattgattggagcagagttagagacattggtgacagcagctaccatgtctctgcctctcccctaaacacctctgcacttttgtaggctcaacaagtactggggagcctgccaccactgtatgcctttgaggcccctgccctgcctccctggctggccacggagctcgccctccctggtagggggtgagtttggaagtgagaggctggtgtgggtctgtcccatgagctgactcacacttgcctcaccacacataccatcagaagacccacgtggtggagctaccgctgctgctccccacagtgcacctaggcaccctcctgtccttcccatggcactcggttgacctgggggttcctgtccaacaggtgaggcctggtgtgcacagacactctgccattgctagaaggaggctgtgccccctgctaagatatcagtaggtccttcacagcctcaccttgttcctcccatttgtttttaaaaattgtttcttatatatacagtttatttagcttacgtaaacatttggtgcacataacttctctcaaagatcatgatgtttcttttgtggttttataaattcttattccatttttttctctttatttccactgttcacctcccattattgtcgaggcatgaag

SEQ ID NO: 13693 - DNA, 142504 bp, Human
  misc_feature (1)...(142504): n = A,T,C or G
gactagacatatttttttttttaactggggcagaaaatgctttgggtttttcatgtttaatcacagaatttggagaaaactttaggactttatatggataacatcattattaactatgaaataataaaaagtggtgttctgattcccataatgacaatctaataatgtatgacaaggtgtattgaaagcagttcacattttcaatggttgactttagatagatatatataagatgttttcagagaaaatttatggtatttttttcaaaaattactcgacagtaatttaattagaaatgaaattgtgcttttaaatactatatttatgataccttttaggtacttactcatactcccaacagtcttttctattactacagcaaaatatttgagagatgctcccactttgcatttttctaaacaccagtgtcttatttgttcttcaaaagcaatatttaaaataaattaacttatgttaagtgaattagagtttgaggttaactggaaaggaatactgtgtagagtttcaaataataaaaccaaaaggagaatatattacttattggtaactttaaaatgccataaatactgcaatatcactgaaaacctcatgatatcatataaacattacctcttgcctattgcaagtattttcattttcattgtcatacagtcataatgcatctggttatttcataagcatatttatatacagcgtagaatcctgcatgttattaaacatgactattacattaactgcttcattagttcttccgtagtcttacatcctataaataatgcatacaaaagtgctatattctgtccgggcatggtggctcaacgcctgtaatcccagcattttgggaggccgaggcaggtggatcacttgaggtcaggagttaaagaccagcctggccaacatggcgaaaccccatctctactaaaaaatacaaaacaaacaaacaaaaatgccatattcaaggccaaatatatattcaaataccttttctacaacccaagtaggggattgcactgctcacaatatgatcaggttaatgaaagcatccttgtttttatagatgtaagatatttaagtacttctactctaaagatactttcaaacaaaacgcagcatgtaaaacaaataaagtggaaagataaaaaacaagaaagagaaagagattgttgtagcaatagcagaggacaaacaaacacctctggcagcatttgttagaactatgatgcagtgcttgggttatcatcaatatgggttcttggctattccattttgtaaaaatgtgtcattacagaaagagtagtggtcttgggaatatgaagactcaggttcaagcctagttctgtcatgacctagctgtatgatcttggtgaagtcacttatcctctatttttttatttttttttttatttttctttttttggtttctttgactgcaagagagaagtgtggtagagagtctttgggtgtacctcttcccctgcttctcacccagttctctaaattgtgagtccatgattgcttggccgtctccaaaaaagaagtactttgcttaaccttttaggctatatttttaagggtaatgatcatgtgtttacagtgagttgtaaaaatgctgtcattgccagtgttcagtcataaaatttggtgaaaatctatggttttaaatagcccaaacaatgggagttaacaaattgggcactaacattttaactttttctcgtgtttcaatatgtggaatttcttgcttagaagctggctctttccaagtatattgtttcatacaaacttggagtttcttgtttgattttctatttgacctttgattgctgctgttttcctactaagtgtttggccaaaagtgagagggccagtacagataaagcaaatagtgtttcatggggttaataattaataaactgaactgtcatcagaaaacccgcggatccagttcattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattaggtaaggttataagatctcattttgtgagcaaagacaacagtttttgttttatttttcctcctgtagtgtccttcacctaagcatgtgatagcaccttggaaagaaagacttttattatttgacatttgcatctgggaaacctgaagcaggtggaaaatttaagtgaatttcccaatgtctgtcatattaactgtgcttagtaattccaatatgatgcactcaaatgtggaaatatgcagtcagattgcttattttatctatatgctggtctgatttatttttggcttttctttcatgcagctgaccaatttgacctactcttttgacattgtacacaggccacagtgtctgtaaaatctggcttctaaatctggatttctttgccctacttttacagcacaccttctaaaactgctgaatacccaaactcaggaacaaaatcatgtattctttttccaaatgagctgactagagtcatcccaccctgaactaaaatttttcttttccatttgcttttgtttttaaggtctagtctaacagtacttttgctgacctcatgctacctcctggtaaagattcctctccttttgttgctgttgtgctttcatattcccaggataaaatttcaactatgtgaaaaatagaatcacatgtttaaaggatcatcatatatagcagcactatttccactaagttttttatagagaataaatttaatttaaatgtgagaaaaaagatccctgtagactttataagatataagatttgagcatatcatttgcaggggagatttcatcaacactattttattatttaaatcatctgtcaaggtaagagttgttatcctcattttctagctaatgaaactaagagcttagtaaggtgcaccctgtccatctgaaattttagcaaggtttggcagaagtttagcacattttatcagggttttgcttgctctccatggctctggatttttgcatggcttttgtatttatttattttttagtccttatcctaggatttctttatcctatatttcttttttcttcatggtgtgcacacgattttggcaactctgtagtctaaccaaggctactgaatatgggtatgtaaattgtacccttcaccaacagataggtcagaaaaagaagaagacactccctagaaagacccttcacagtgctatggaagtgtctcccccagaaggaaggggctacacctttcagtaattgattcattcagagggccttttatctccatcaaggagagggagttatttaagcctaaacagatgaatttttctctctcttctgtctttttggggttcactaatgattgtcatattagtaattaattattaaatttgagctatcagttttcagatataggcaatcacaagtatggtagtggaaaataaaagttaagagcacaggcgctggaaatagactgcctgtgtttgaaccctacctctgccacttgctagcagtatgatcttgggcaaattacttacctctcttgtccctcattttcctcatctgtacagtggtaataatagtagtaactactttttagggctgctgtggcagtgaatgattaaaatatgtatagtactttgaacagtatctggccctagtaaacactatattgttgttattattattctacttatatagttcagtgaaacttaatttgattttgtgcataaatttattctttttttcaacaaacatttgagtgtgaagcagcataagcattggtaaaaaaaagtggactctggaataagaatgctttcaattcaaatcttggttttaccacttattatgtgatactgggcaagtgtcttattgcactgtgtcttggttatataatctgtaaaataaataccataataaaaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaattaaaatgtaaactgaggtgggagtagggcaaaggatcagagggcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttacagtatgatctatgagaagccattgaaatgttctaaacagaggaagagtatgattaattagagtatagtctgcttatacaggtatgctataatgtcctatgacttgtcatcaagggcattttatttagtgagtgtggtcatttacaaggcagcttgatcagtgtgagcagcccaagacagcctcaaagaatagagagtcagtgtgtgtaatggaaagatccttggattaaaaatcaggagacctggctcctaactgggcgtcaggagacctggcctctggttctggctctgctacttggtaggaaacttgcccaaagtcactcagctatcttttctgggctcagtgtcctcaaccataaaatgaaggggttgaagtagatgatctctaatgtcttttccagatccaaaagtctgagttttaggaaatccatctcttgaaacccagtttggggtagttgagacagacattaatatatataaataaggagaagatttacataaatgaatgactttttttttcaaattaagacttttttaatggtcgtagttataacacaaatgcaattgatggtttatgaaattttctcagaaaaggaatcctaaaagaatctcaagatacagtaaagtttgacctttgaattgacttcagttcatacaaagtagatagataatagactttaagtcgttactctcatggcaacttgagaagtctactaataacttgagattattaaaaagtggtaaaacatttggaggtagaaaaatgcattgtgtgctagaatggtgataataaggagggtaagaataaatttatagttatgttagaagatatttttcttacacttagatacatttagtattcacatactttggaaatagaggaattaaagtgaattttaaaataatttattattggctgttttgtcacttcagaaatatttgtagatttttattatgcagctctttttcaagtcttgctttttatctacttgaaagagataaaacgtaaaaaacataaaaagatgataagtcttgaaagtagctttggaattgatatatctcctctgaattcctaggtgaggtagaaattacatattaaattaaagcttttaattaggatttgctgtgtgcaaatttgctgcttatttctagtatgcttgtctaaaatgtaatttttttccttttatgtttttcaaaaggagtattaatgatattctaaattcagatatttctgatcctacatataaactgtctattaaaaatatggttccttaaataatactccatttatattctgatattttgatggataaaaatgattcgatagagaagaaagtgattttgttagttcataaaccagtgttcatattcatataacatatgtatgtattatactgtcatttccaggaaatatacttacttaatcattaataataataaatatcattttaaattcctaggcataggattaaagcatcaactgcaaacttttatgctagctgaaatttatatattagaatataaaataccagctatcttgtaatgttaactagttaaaatgaataagtggttaatagtagctgggatttctctagggggtagcacacactgattaatgagaacattatcatgtaatattcactgactatttacatatccttggatatatctactgatcttatagaaaatactctttgcagtcctattaggtttttgaataatggctggcaccatggagcagttttgtgaccaacattcaaaaaagacagcaaaacagtcatgaagatcttatcgtctttctttacaaaaagtttctttagccattgttgcctattgtacattaaatatacacatttcatttttattttagatcttttgttatttttgctcatgaaccaaatattgccaatttgttatttaactatgcccttagggtatattagaacatgaaatgcatatataaataaatcttggggaaatttttaattgtcattatgagcaaacagcatgttattacattaacagtcctggattatggcagccacccattattcaaatacattaggcatattctactacttttataattattgatggactttttaagaatattattggcttggatttgattatatactaaaataagcgttctcaaattgtctatttcacatgtatttttaatttaaaatgatggcttacctttattttcaattaatatttgtctaatgctatataaattacatgagagcatattttaaagaaaggattatagttgttaaacatgaaataaaattgttcttaaagcttatagatctttaggatataggcatatgtgtttggataatgcagggactttgaataaatcatcagatatattaaaaatcaagttgtgctgaattgattttacttatatttagaaaatgcattgacagttgatgtcatggtaattttccctttctttgagctttgtacatgcatataaaagaaaatgcagttattttccacttaatatgagcaatatgtaacatttcatttttttcagttattcttgaaaaataacattttcagcattaaaaatttaagcacctatttattagggttgctgctgtcaaatacagctactatctaatgagtttggaacagcttgcttttcttttttcttgtggcccttttaccagaaacttattctgcagggttctcacattcttggtatggccaataaaaattccttaggacagatggtatcttctgttagttcaaaagtttacagaatcaccttcatgttcacaagttgacacctttcagagcagttatcctaattttgtatgtgacttgtgcagcagaaccagcttgatcttttttgatataaatgcagggtagacacttgaaaatcagtgtgaagcaggtgctggtctagggattttgcatataatgaactgtttcctatctcacaaacttgaaacttttgtctcaaaatactgaataattttggttaaagagagcatatgaaccactttgaattctccagttagaaaaatatatttgtactgagaggtacagtggggatgaaaatagaatttgatagtatctggatcatctttagggattaaaaatataccaactttcttcttcagtgaatcatgccaaataccagaacttgcctgaatgatattgttagccattctccagtctacaaggtggattgctattcatttttcagcaccacaatcttcaatcccaagctttttttttccaccaaagaggtttctgtagtgtttctacatagaaaaagacagcggcatgagggagaatgcactgtcatggaaaatagtcatttgtgtattcagcaaacatttaagtagtcaagcatagtggctaaaagcatgcactctgaacctaaattgccaaagagccaagttcctctaccctcgaattgggtgacctgaggcaagttacttaatctacacatctgtttcattatctgtaaaatggatataataatagcacccacttcacagttttcttgagaagactcaatacatgaatacatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaattcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgttttttcttcatttgaggtagtacatttcaactataaagtatgtaatagtctgtttttgccaaaaaaaactcacctttcagagctataaaatatacagaattgaaagctgacacctaatatatttttcattagatacagatgttcaatgtaaaattctttttacaagtattcatgaaaaacaggataactaaaaagatataatgtataaaaagtaaaaatcatactttttggtaaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaacgtagaaaatcttgcaaataatttgtaaagaaataattcaacaatttagagtaaagtttatcttctttatcttaaaatttaaacttatttgaataacattataattaagagaattatttctaatatttactttctgtaattttgtgaaataattttcttattagaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttctgctaaaaaaaaaaaaaaaaaggaaaaaaaaaaagagaaaatgcaggccaatatgatgaatacacaatacaaattctgttacactgggttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactaggtgcctagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagtatgacatacggaaaacagatcaatgtgtactggatgaatctccctctggaactctgattaaagatagaacttgtccaaggaggtagaaggtagggcattgaagttgggggccataccaggaacaaaagcatagcagcagaaatagaaaggtctgcaaggggaatctgtgaaggcagcctatagatagatcacggagtagggtgtagggatgttagatgggaaagatgggttagaggaatacagggagacctttggatattgggttaaagtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacacaaaaaattaaggcaggaaaatggaatcttctgaaacttggattaataggaaacaaaaaaaggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaagcaatccacctacctccggcttccaaaattctgggattacaggcctgagctactgtgccccgcctacctgtattattttaatcaggaaaaccatttcaatagaatctagagatatggttttatacattggccatgttattcaagttcccaatggtggtttttaaaaaatacatacatggttctattttaaattaaagaaaattgatctggctgggtgcaccctagattacatgactgtaatcccagtacttttggaggccgaggctggaggattgcttgagcccaaggagctcaaaactgcagtgagctatgatcctgccactgcactccagattgcgtgacagagtacaatcctgtagagagagagagagagcgagagacctacggcgttcttgtagtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttggttagttttcattccccttgattactaaatgatggaactctttcacccaggatatcattttgccaccttttatttgaaataaaactgttatgcagttagcactatgttatgaaaatattaaatgttgagattcttgcaaccaaaggaagatagaaaattccaaagaaatgactatttctggtaagctcctatcccagttatgtaactcagctagaatagcaattttagtgataaaactgtgtcaaatattttatttagtgtgaatctgacatttgattttccttttataatgcttctttttgttatttcagggaaggagattacagcagaaacttttatggagaagttggacaatggtgccttgctctgtcaacttgcagaaactatgcaggagaaattcaaggagagcatggatgctaacaagcccacaaaggtaaaagatcccaatgcaaaaatcactcttaggtggtagattacatttataattgcttataaattgtgtgtaattaaaaaatttattgtgaacggatgcatcaaggtctatactaacaacaaagtacagagagttctttttaattaggtaacatgttatttgcactctaattacataaattgcataatccttttggtgaatctaattaaataaaagcttatgagaaatgatggtattaaaagagtattgtgtataaactcaatgaatctgaaatattgattaaaaacttagcagagaaataattgtgtcattaggcaatgcacagatctagccaagaaagatttactgaatagatctttgttttcaaaaatattatggcagaatactagaacaaaatttctggactgtaatttttggtttattctaaataagtagtaccattgaactaagtaaatttggacaaattattttatttctaactgctcagatttcttttctccacattaattctaatattcttctctagtgattataaacacttgatgaaagtatagtgtttgactttttttgaagaaaacaagagagattgtacttaatttttaatagagaatgaaaagagatataaaaaatattaaaataatgttggccaggcatggtggctcatgcctgtaatcccagtactttgggaggctgaggcgggcagatcacttgaggtcaggagtttgagactagtctggccaacatggccaaaacccgtctctactaaaaaaaaaaaaaaaaaaaaaaaaaaatagcctggcatcatgacgcatgtctataatcccagctactcaggaggctgaggcgggagaatcgcttgaacccaggaagtaaaggttgcggtgagcagagatcacgccattgcactccagcctgggtgacagagtaggactctatctaaaaaaataataaaataaaaatgttgaagacaatttaagacaaaaagcaactgttaagccttttctgcaactctgacagaaaaaataaaaggggtgtatgtgtgtattaccactgaatttattttttaaatattttatattactccgtaaagtattgtataatatacaaaacctccctctatttttttatttcttaaaagcagctctgtgaaggtattaattaattcagtggctcccaaactttgctgcacattggaattacctgagcatcttttaaaaaaatgctgagagctgggctggatgtggtggctcgtgactgtaatctcagcactttgcgggggtcaaggcaggcagattgcttgagctcgggagtcgagatcaacctgggcaacatgacaaagcaccatctgtaagaaaaacacaaaaaagttagcagggaatggtggtgtgttcctgtagccccaggtatttgggaaactgaggcggcaggttcaattgagcccaggaggttgaggttgcagtgagccaagatcacaacactgcactccagcctagaagacggaatgagaccatttctcaaaagtaataataaaataaaataatactgagacctcgatcccatgcctgaacattctgatttaatcccatagggtgaaacctgggtactagaatttttaaaaagctccccaggtgattctaatgtgcagcaaagtttggtaaccattaatttcttttaattttctccttaattggatggttgaagactgtaagtaatttgtacaagattggctagtaagtgaccaagcaagaatttgacacagacaactttgcaagtttaatgctctctcatttttgttcattatgtcattatgggtagcccaggtgtgaggagactgtttatgaaaatgctttgtgtcaagcttaatgttaggacaccaatttttcttctgctctcatttccgtcgtgatgtaactggcctctacatcagctactgatgaaaaaatataatgccaataagaggacaacttgtatagaaggtttacagtaaagcaatgaacagagggaaataagctgtggtgcccagactcttgaaagcattaccttcacattacgaagttcctgaaacttgtattgcttattgttgaggatggagagccgaatgcctcagtgtaaagaatccttgaatcctccagagtagtaaagattaaccaactctattaaggctgttgtgcagttctggttttgctttgtttataagcctttgcttttttaaaacagaagcaaagattcccaaatagatttgtaattgtaagactcaatgtaagataaccctaaagcattagcctataggtcaaaggctttgacattaagtgcattttgcttgggttctagttttatttattaattggacgtgtctgagccgtactttccttatctgtgaaataggattaataattacatatgtatagcttccatagagcattgcacaaaatagggctcttgataaaatctctttttgataaaatctcttttccttacgtgaaagataagagacccttgtaagtattttcgattaactataagaaaataaatactttatagtctacggccataccaccctgaacatgcccagtctcgtctgatctcggaagctaagcggggtcgggcctggttaggacttggaagggagaaaataaatgctttataaatgtttgtatttagcatgagagctgctatgtgcaaatatgtatacatttgccccaatctccatgataatatggaatattgagaatatttattgatcaaaagttatgtaagtactttccttttaaacagccatttcaatattataatttttataataaaactataaaacaaaaagaaaagaatttttttcagttagtaaaactgcagcaagttattaaacttgaaatagttccgtgaacctgagcaaatttttaactgaatataaagctaaatttttttctgattgtgataaaggttttagtataaaaccttaaatgtgttacttgaacaagtggaggtttaaaaatacttattatcatctcaccaaaaagtcacatgcaactgtatgttcatagcagcactattcactactgcaaagacatgaaatcaacctagatactcatcaacggtggactggctaagaaaatatggtccctatataccatggaataccttgcagccataagaaaccaaaatcatgtcctttgcagaaacatgggggcagctgaaggccattatcttaagcaagttaatgcaggaacagaaccaaatggtctcacatataagtgggagctaaacactgagtacacatggacacaaacaggagaacaaaagacactggggcctacttgagcaggaagggcggcaagagggtgaaggtcaaaaaactacctattgggttctatgctcactatctgggtgatgaaaccatttatatacccaacctcaacaaggtgcaatttacccatgtaacaatcctgcacatgtcccctccgaacctaaaataaaagttaaaaaaaaataccgattatgacctcactttcactgctcaatacatcaaatttgatctgaggtaaaagttgacacagttgctcttgactgaattgccttctctgttcttggcagcatttatatattcacgactgactgccagtaatatgcagcttaaatcaataataacttgtgccttactgtatgaaaagtgcaaagatgactacattttattttttgccttttatagtaaaattttaaaagatgaaaggccagagggttagtatgtatatcttcatggctactattgttcataaatatacttctgttaaactcaagatttttcagtccattgttggtctagaaacaaaaaagacttatgagattgtaagcatgttgatgttgttaaatctaaatacaagtttaaacaataatggattcactacaacccaggtaattaggattacagtgaatatttcccatgggaaaaaatgaggctttcaaattgagtataaatagtctggaggttacaatattaagtctgattttacacgtgtgtacactcatgtgttcatgtatgtgtttgtagagaactatttctcattttggcattttggagttcagaaaaaatggtggcgaaaatggatgaattagtcaatacattctttgaattaatgaaactgtgcatagggagatgttgaaacagaattacttttaaaaaattgacaaacttgatcccatccaaagccatgccacaggaagctctctgtaatttttttctagcagctttaatcttatctcctcattttcatagcaatattttttactattcttggttgatagttaatttggagattttacagctgtgtaaacaaatttgaacgagtaagttatgcctggtatgtgtgaagtatgtctgtattaaggatgatttaaatgctcttaaatctttaataaatgttagttcgcatatttaatattttagatatttagatatttctaaatttaatatttagatataaatccatgactcttttatatccagctttggtttgataaaatactctgaatggaaataattctgtcctatgattctttcttcccagacatcaataggtcaatttaaaaatagcttctttacgtgtgtgagctctaagtagttaaccttagcctttgtgtagtgggccattttctaactctgcatgggagcaatgcagagacttcacagactagggcagtagatgggtggaagcatttgagaccagtgtgcagccatttaatgtgtaattttatttaattcatttatacatactataatattatgaattcactgtaattacaaatcttaatatttctggagttgaggatgtttaaaggcaaaaatataaatgaaatgaatctttcaatattgttttaggatgagaaaaccaaaccaaatgacaggtttaaggttaggttttatgtcttttgactctcagctacccgatcggaattggcatctctaatcaagacaggggaattgttacatttatgcgtgaactttcttttcccggtccaaatagtgttccacagtacaaaccccttcctattgtatatttgctctctttcccccacccccaccaatcacaagtttgctgatttgtgcaaaagactctctcaaccacggggcatcagcgtggggcaagacattcaaaaggtttaacctctctttttctactaactttcctttgcatttgtctcatttattttgagtctcttcttcagacatcagagtttctctgggtttagagcttcctctgacttcaaagagccctgggtggttagatcaagtttgaagcagatgaaggagggggcggggggaaaagaagttctgttacctagtagaatgctgcattatgctccaaggaaggaactgaatattaaccgtctaaatgtagaatccagtccttgttcaggagaaagaacatcctgcagatagaatgcctacaatacatttgcccatcaggagtacttggttccttgagctgcaagataacaatacctcaggatgttgttttgtgccatctgggaattaaataagacataaagattagaaattttcttctcagaaaaatcaatagcactttttgtttagagaacatctcatcaagatttaattctgagaaatccagatatttgtgtttattgctgatctctctgccagaacaagaaagtatggtagatgcaataaaaggttttgtatgaaaaagaaaataaaatctcagctgtgattaatctggagtcattcattgctggctatacagctaaatgattttatatcccttaaaatttattgttctaaattgcaaacataatgctagaattaaacagagaatatattatgatgagatgggaagaatataagtggcatgatgtagaaagaaataatttttttataggtgtgttgctgcctgagactaaaggaaaaagaaaagttagtggtaaagtccacttcctcaggatttgtaaaatataggtaaaatatatttaagctttaaatacactaatttttttatttactttgtaattgcttcctgaggttgaattatttctcagtataaaattaaatccccctgtcactattttttaagtctctgaccaaatagccaaattattcacctccaaatcagagacaatgaaatgtcttgcttaatgttttttgtttttttttccactgagagtttctgttctatactatcttccagagatatgcctaaatcgggcttcaatgccatagcaatacatgttggtaaatcatatagaataaaaagaatggtatgtaaaggagcttgacttttatttttcaaataaaactcatcacaggagacttgatatgggctacatttgcagatgggggtgggcgagcggaaagcagcaatgtgaaaaattgggcaagatagggagtgagtgatgtgcctatggaacttatctagatcttcatgtctaattgagcccatcccatacatggcacttgtacttgtaaacccagaaaatcggagacaagtctcagttaatttagaaagtttattttgccaagactgaggacgtgcgcccatgatacagcctcaggcagtcctgatgacatgtgcccaaggtggtaggggcacagcttagttttatacattttatggagacatgagacatccatcaatatatgtaagaagtacattggtttggtctggaaaggcaggacaacttgaggcaaaggcaggaagacacgaagtagggaggatgcttccaggtcactgacagatgagagagaaatagtcgcattcttttgagtttctgattagcctttccaaaggaagcagtcagaaatgcatttatctcagccatcagaggtataactttgaatagaatgggaggcacatttgtcctcagcactttccagcttgagttttccttttagcctagtgatttttggggacccaagatattttcctttcacatactcaatggtaaagtagtgctgggcacaataaaaaatatggcccagtggatcatatggcactaagttcatgataaacatttaatgtttcatgattactggttcccatggtagaaattcagtctccatcagacaacaagaacaagcgaggaacatttgtgtcgtgtcctttcctaaaagggcaatgttcctacctgacccctactactagatgctgaaactttgtttagttggcagaacccctttctgcattttcatgagatttattctctaccctccagaatgtgtgtattttatgaaaccgtctggtttccctactattcctgctttgcagtatcaaatctccaatatcaaatattgtaaaatagaagaggagcttgatgacctgtgatgttgaaatatccatggtccctgtaggttatgtcacagggctggagatggtgtataggatagtaagaattctgttgttactgtcaaacatatgcaaactgattctggaattttctacttataagaataaagaaaattccattctccaaaccaagagatgaatgttaagtaccaggatattgagtgataacacttcattgaaaagaccacatctgtaacatcgattctgattaaatatgttacttcattgtaatcttcccactgtttccaagtcatgtcaatctttttttactgattttcattgagatgtggtagaagtcacttttattttttgcaatgttcaggtcattaataacagcatgaatctctgactttttaaataggtgtgctttttttatttggtacttttaccacaaaagaacttattccatgtgtcaaggataaaaattatgacattttttgagaatatccatgcaaattgcacattcaggtaaaactataaaaataacatctaatgtttgcaaaagtgtactagttatagtgtaaagtaggtttaggtaaaaaatctaactgtcacctgattcctcacaaagcatttcccttttctgaatgcatagtaaacagatcaggtccctttggagattggaaggaagctttatataaagacttgagatcattactgccttcattcagtgagctctgggtctataatttggctctagtctgggaattgggcaatcagaaaatttgttgctctttttgttatacaaagaaacccaaatactgcatgttctcacttataagtggtatctaaatgatgagaacccatggacacatacaggggaacaacacacactggtgtctttcagagggtagcgggaaggaggagggagaggatcaggaaaaataactaatgggtactaggcttaatacctgggtgattaaataatctgcacaacaaaccctctgacacaagtttacctatataacaaacctgcacttgtacccctgaacttaaaataaaagttaaaaaaataagaatttagggaattgactttcaatttacttcccaaggccccatgattaataaaccataatcagatttcctgtgctttaggtcattctaggagatctgattggcctctccagattgtattctgtcccccatatccactttgcctctggaaattaagtgccaacgtgtgttcctgccacccggagaatttccattcacactaaaatgaggaagctcatttcaataacagctcctgagactttctgaagaataatgtcaccttaaaaatttttggagctttcttcatcaacttattcttcaccctttagtgaaaaatagagccacttgggtcccactgagtgacatagtgaaaagtatgcttatgtgaggaattaattacaggtcgaatagaatgtggaattttttcttgaagttctaattcctttatctatatcataccaagtgattcctggctttttgtgccatttagtgtgagctattgttgaatatatctttgtgttagcaaatctagcaaactttaatagggtcattttatgctagcccattgaatttgggacatcttattagtccagtacaagtaaattaattttgctgaatctaaaattacatcctgctctcctcagactaataccctcaaaatctattgcaaagacagcaacaaacaaacaaacaaaaaacttctgccataatatatttagtggcactcaacattttaaatgtatattgaggctttgtaactagttagccaggaattcctgagccttactatgggatgtatctaaattcatcctcagccaggctgcagtattttgacgcctggtagaggttgtcagcaatggcttaaaaaagtgtgggttcggctgggtgcggtggcttacccctgtattcccaatactttgggaggctgaggcgggtggatcacttgaggtcaggagtttgagaccagcctggccaacatggtaaaacgctgtctctaccaaaaataaaaaaaattagctgggtgtggtggcatgcacctgtaatcccagcacttgggaggctgaggcaggagaatcacttgaacctgggaggcggaggttgcagttagccaagatcacgccactgcactccagcctgggtgacagagtgagactccttctcaaaaagaaaaaaaaaagactctttattctgtggctagctgagatttaaggacagagccattgtttcagaactgtccaaattaattgatatacttttcttaacctggtccaggagcataccgggtgtagaggaatccaccatgtaccctccctgtttcctgggagggtatgcttgctattttcttacccaacctgctcattcttttcatgtctctgcctctcttcccaagataagaatgttaatcccttctcatctgagaccaggatctggcaaggggacaggattttagcaaaggacaggagccaatagcaaatgcaagtcatattattctgtaaattccatatatcacagctattcagtggaaaattcttccatattcaacagctcacaaatgaaagaaagttggtagatttctctaaatttgacaacagaatatttgtcaaacaaatttgaaataaagaaaaaatttcaaaatttgtaatattcaccaataatgagctgtgaggttgaaagtgattttcctgaattattagaaattgtgtcctgattaatcatgctaaaagaaagattccaatacgtttctattcttcctatgcaaatatttctaaaacgttgtttttttaaattttattattattatactttaagttttagggtacatgtgcacattgtgcaggttagttacatatatatacatgtacaatgctggtgtgctgcacccattaactcgtcatgtagcattaggtatatctcctaatgctatccctcccccctccccccactccacaacagtccccagagtgtgatgttccccttcctgtgtccatgtgttctcattgttcagttcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttggattagttccaagtctttgctattgtgaatagtgccacgataaacatacgtgtgcatgtgtctttatagcagcatgatttatagtcctttgggtatatacccagtaatgagatggctgggtcaaatggtatttctagttctagatccctgaggaatcgccacactgacttccacaatggttgaactagtttacagtcccaccaacagtgtaaaagtgttcctacttctccatatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggagttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaaggtttaagtctttaatccatcttgaaataatttttgtgtaaggtgtaaggaaggaatccaattttagctttctacatatggctagccagttttcccagcaccatttattaaatagggaatcctttccccattgcttgtttttctcaggtttgtcaaagatcagatagttgtagataagtggcattatttctgagggctctgttctgttccattggtctatatactactgttttggtaccagtaccatgctgttttggttactgtagccttgtagtataatttgaagtcaggtagcatgattcctccagctttgttcttttggcttaggattgacttggtgatgcgggctcttttttggttgcatatgaactttaaagtagttttttccaattctgtgaagaaagtcattggtagcttgatggggatggcattgaatctataaattaccttgggcagtatgaccattttcacgatactgattgttcctacccatgagcatggaatgttcttccatttgtttgtatcctcttttatttcattgagcagtggtttgtagttctccttgaagaggtccttcacgtcccttgtaatttggattcctaggtattttattctctttgaagcaattgtgaatgggaattcactgatgatttggctctctgtttgtctgttgttggtgtataagaatgcttgtgatttttgtacattgatttcggtatcctgagactttgctgaagttgtttatcagcttaaggagattttgggctgagacaatggggttttctagatatacaatcatgtcatctgcaaacagggacaatttgacttcctcttttcctaattgaataccctttatttccttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaataggagtggtgagagagggcatcccctgtcttgtgccagttttcaaagggaatgcttccagtttttgcccattcagtatgatattggctatggagctgggtttttgaaaggatcagcaaaattgatagaccgctagcaagactaataaagaagaaaagagagaagaatcaaatagatgcaataaaaaatgataaaggggatatcaccacccatcccacagaaatacaaactaccatcagagaatactacaaacacctctatgcaaataaactagaaaatcttgaagaaatggataaattcctcaacacagtcaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttgatgaatattgatgcaaaaatcctcaataaaatactggcaaaccgaatccagcagcacatccaaaagcttatccaccatgatcaagtgggcttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagttaattaataagaaatattatgttgtttttctgtgctttgtgatggttctagtgtttaccatcttttaaaagttattaatttcttgtgctttattttattaggctaaaatgtttaattccatatcttattttgtgtttataattctgttcttttctataaggaaagcacccaaataaaataagctcaagcccccacaaaatctgtttcttttctagcccctgtgtaaatagcataggctgctagttttctattccacagttgtgttccattatcggtctcaacaccaattccaaatataacatatttttctgagtcctgacaacttaactccatactctggtaccaaagaaatttttggaaaagatgaatttattgagataaatgtacagaatgaagggagaattctaaatgaggggagtaatgatctcaagtctttactgtaccccttccttcaaatctacaaagggacccaaactctttactatgcattcagggaagagaaatgccttgtggggaatcaggtgacaggtagattttttaaatctgaaattattggaaaagatgaatttactgccaaaagaatgtattggaaagatatgggggtactgcttagagaaaaaagacatgtgaaggaaagtgaaactggatttggagggcttaagaattagactatttgcaaggattatgcagcatagatacacagtcatttcacagtaccactgttagggtgaataatttcagacatttttagagagggcagctgaacagaaatggttaatagtgtatactcagtagtcatactacctgggttgaaatcataactcctcctctgtgcgttagttttctcatttgtaaaatgtagtaataattgtagctacctcatttggttattatggggactaagtaagttagtatacacaagcactgagtggtacctagtacatatgggtgctcattaacatttagctgttaactttattgtatcattcctctcaagattaacatttcagcaagaaagagcctgatggacagccaactttctgactagatcatggcttcataccttgattgctcagtctgaataaaatgaaagaaccatagtgtccctatggaaaattaatatgctcttacctaagaagggaaaaggatactggaagtgtagagatgcccttgcagtctctacactctgtatctgtagatctggcctctttcttacggtttgtccatctgcatgttaacccctctttcttgtaccatactgttgtacttagttgtttcctagtctttatccctttgctagactctaagatccttgagtacatagtttatgttctattcatctgtgagtctaacataatacctagcatatagatgctcagtagacatggtgttggatgaatgaataaataaatgccccaagatggatatttacctttagatccagaatactgttatccgtgggttttagccatctttgctttttaatcctgaagactttattctcattaagtttgaaattcccccctctgcctgtttgcttagctcaaaagcctttgatgtgacaaagcatgaggagcaaatctgacttttccagtcgtaaagacggaagatttgagaattttagaatggtctagggaaacaataaggatctgaggacgttaaaagcactgacaagagattggctgaagtaacagaccatggggatttaaactagttaagaaaaagtggatcttggaggaggataatcatttagttaattgtaaatgttattatatagtgacatgatgtattatttgagttcagagcattatataaaggtaaaaattatgataaaaatgagcatatttatatccaatggttcattcagtttgaggatttcttttcaaggcctgattatactgcttgcagtataaaataagcatcagatgagcgatagctaatggtttcatgaatttgctcaccattgaaaattaggaagaaaaattaaattgtagggcttttaggtaacaggttctcaaaagatgtttttgacctgaaacgaagtgctgtgtctttcgattactagaggagacataaagatgaaatcattttttttcttttgcatctttttcccaataactgcctcttttgctcaataaaatagttggtgagggaaatgagaatattagaacctttattttctatcagagcagctaattgctgtctgccaaagcactatttaacaaccaatgtaaaaatacaatttctataaaactgcaggagagaatcagaattctagtacttaggaaaactgcacagtaaatactgctatcgactttctgaaaatgtgttattaaacaataggtaactcaaaaggagttaaatatgatcatggagtatagcaagttcattttatcaatcttttataatattgaatattaccaacaacaaatattttataataattgagtcctacttatatatgttactttaaaattggatagtttgagtatatgttagcaacaagagatgatgttattggctgtgggtgttaatgtgcatttgtcttcatggtgagaaagatagttgtgatttaaagggtgtgatttaaatgaagatagaatactctcaaggagtttactctctattaggaagaaatgtgttgtatgtggtaatatatagcttgtgagatcaagcttaaaaaaaaaatagttcggaaagggctgggcgcggtggctcacgcctgtaatcccagcactttgggaggccaaggcaggtggaccacctgagttcaggagttcaagaccaccctggccaatatagtgaaaccccgtctctactaaaaatacaaaaattagccgggtgtggtggcaggtgcctgtagtcccagctactctggacgctgagggaggaaaatcacttgaacctggaaggtggaggttgcagtgagccgagatcacaccactgcactccagcctggacaatggagtgagactctgtctcaaacaaacaaacaaataaaagttggggaaaaaaattagttgcaagaagtcacaggtcttaagtaagaaaaaggcattattttattatggggctgaagttaaaatagaagttaaaagatataacagtatatactgaaatgttttcacacttttaagattattttaaatgtgtcctatcttcttaaatcaaaaatgatactaattaataataaaaatacctgccatataatataaatacaggagctacacatgcattgcaatgtctaaagtgcttatgtatggacctattacaatgctttttaagtgggtgtaaactgattagtttgaccattctgactacccatacattatcattttctttgctctttttattatcacaggtcaaaatccaaattattctcatttccttgtttcagtgagtcatagaaggaattgtctctcacacttttgatatataactcttgaggtgggtggcagaagaagccagtgtctaagatattgtgctgagattctttaggaataatacttaacagaggatgaagtttgttgaactgtctgtagatggaattgcaaattgaacaaaattactttatggccttatgtatttaaaaatctttggacaagagtataggccctagcaaaatggaaaatgaccatatgcaaagcatggaaaacctttgtaaaaagcactcatgtttgagatagcttactttttatgccctaataagcaaatggcaaaagtaaaaattattttagaattccccttaaattataagagggtaaaataaaatctatcattttcatgtttgtctcctttcttatttgttgtaggccagtagctgctagccttctcatatgagcaaaaagccatttccccaatcttaatgttctctacatattggggtatgctcctaataaggactttgtgctgagatgtggggaagagtatgtctagccctattctgtactctgctgagaatctacatatttcagagcaaggagaagagatagggaaagaccaggtggcagattctaacctagaaatttgtctagattccagaggctactacatttatttgaatctgcttataaagagccccttcaaaattgttctttttgtctgtgagctcaaaccataatatattgtttggtagtgtaaataacagttgcattaaaggcatatgaaacatgtgactgaaaataaatatgttaaattgaaactccaaaaagtataaaaagaagaagagcaaattctggatagaaaaagggaggttcacacacacatgcacacatacacatttttcatctacgtgatttcctagcaccagcgcagtgttgtcccttgagcatgaaagtaaacctgactgaatttttccatgatgacatcatcccttctacttacagtctcacatcctgcatttaacaacatgcaggcacatcagcaagacaagattgtaaaaggagtctaactggggaactgttttcatgatatttgatagcactaattgcggtcaatgctttcaaagcactgtggatgtagaatattttgtcagaaaaagtcactctcaccctatggaaaatggagaattaattattttaaaatgagctgttactaaatgtgttggagaaactcaagtcgttggaacaaatcaataatgaatatgtatgctatttcttaaagggaaacattcatagattttatattaagaaccttttctaaaaggctgaaatttgggggaaagagttgctttttcatttaaaaatgtctgagaattgctaggtaatttaaaatgtaagcactcaccatatttatgtgtgtgtggtccaaggtatgtggtactggtacattacagagtaatggaataatgctttttagatgaggtaactgagtttacaatatatagagctcttcaactgtatcttaagctcttaggggctgacgacatgaatggcttctattgtttgacttagcagtttgaaaacacattacatatcatgcatgaagcctgaagccttctagtatgtgttttgtgtttatattactgtgctagtcatgtctaatttcacaccagtgtaggctgcttgtctaacagatgcctcgctagcattgctgtttcatataagaaataaaaaatgtggtaatttgcatatcttgaagccaaaagaagcaaacaaaaatcccagctcaatcaaaaattgttaaaaaagaattaaatcttggaagtgacaaggaagaaaagaaccctacaatgaaggtgaaacaactcaataaattcagaaagtcttttgagactctgttttgtaggtgttatggaggatgtgaagcaaataagtcatggattctttcttctagatcaggatcacttaagtgcttttgtgccatgttcttttaggcacttgggtgaagcctgtggatcatttctcctcatgctatttttaaataaatgaaataaatacaaaataaagggaaccaattttattaaaatacagttatttcaatattaaaaatcaacattgaaacacaaatttaaaataatgtgcttgtattttaaaaaggttaatctggcattgcttctaataaatcctatagttataaagtagagaagagagtaaacccagtgtttccagataccaggaacgattgtaatatgaaataaaagcttctacaatttttaccaatgagaaagctactgtggtatttttgtctacatttataattgaagggatattaaacttcaattagaagccagtgaaaataaacatatatatatatatatatatatatatatatatatatatatatatatattttgctcatctcaaattcatgattctcccagaaaagaaccctttcttgtagtaaggaatattgtagattgtagtaaggaatattctaataaacaaacaaaactcagaataaatggatttttacagaataaacaaaatgcagtgggcagattaacacaggagagattaatctttacttatctaatgaatgtgtatgcaaatatatatgtgtagaactaaaccatatgttgttctatgttgttatatttgctacatttaaaattgttcaaagattgaaaagtagatacatgatcctttatttccacagacttaattaatgccatgtgatatgataataaagcaaacatttactaagtatttacttcgtgtcattcagagtaagctttttacatgtattaaatcatcaaataatttaaaactcaaagtagattatgccacttcttagctcaaattttttcaaatggcacctcaactttcttggagaaaaagccaaaatctatatgacagcctacaaggctctatatgcactgttccttggtgacctttctgatctcatttattgtaacttttcccttacccgactttgttgcagccacactggactccttgcaattctttgaacctgacgagtaggtcccatccaccacagggccttcacaattgttcttctagcttcttagagtattattttcccaggggtgtgtatgatttgcttctcactctcttcatgtccctgctcaaatgtcatgtttatctgaggccttccctgaccaacctatataaagtgcctttcaagaatgcttttccagacttttcaactgctaaacatttattgaatgctaactgtgtacaagatctgataaataaaagaagactaaagcattattgggtcctccccaagaacttgcagtctagttaggtacataaaatatgaacatataataatatagatatcaatggaagtgctaaataagtgatacccaccagtggttctcaactttcgtttaaccataacatacattacaatgaaaacattcaattgattattcaacacatgtatactgaacacctaacatatacagggcaaaatattggatgctcacatgcttcatgcctttgtggattagcaagggataataacattaagctggtaattaaaaagtatgcaaacagtgaatttcaactgctgtgtataaatacaagaaagtgtacatacatgacctcctttaagaggaggacctaaattagtcatgtacaaaggatattttagattattctgaagcagaatgggaataagcaaggcagagagggaatatagagtgtgccaaatacagtaaattgcacacgtgaaagccctcagatgtaaaggtgcatgatgactttgaggaagtaaaggaaagcaagtatgtctggagactagcacataactcaagagaatcaagagatgagaccaaagctaagtcttgttggatgctggcatttatcttaagtataacaatatgccattgaactattaacattttaaacagaagcatgatagactcctttaaaatgacaacattagcagtgtagagaatggattggaaaggagaaatgaaggtggaaataaccacccaagtcaggaggctattgcctagctcaggtgacagataatgaccacttatcctagggtagtggcagtggaatgggaaagaagtagacggtttttttttttcttttattattatactttaagttttagggtacatgtgcacattgtgcaggttagttacatatgtatacatgtgccacgctggtgcactgcacccactaactcgtcatctagcattaggtatatctcccaatgctatccctccccgctccccccaccccacaacagtccccggagtgtgatgttccccttcctgtgtccatgtgatctcattgttcaattcccacctatgagtgagaatatgcggtgtttggttttttgtccttgcgatagtttactgagaatgatggtttccaatttcatccatgtccctacaaaggacatgaactcatcattttttatggctgcatagtattccatggtgcatatgtgccacattttcttaatccagtctatcactgttggacatttgggttggttccaagtctttgctattgtgaatagtgctgcaataaacatacgtgtgcatgtgtctttatagcagcatgatttataatcctttgggtatatacccagtaataggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttctctgatggttttgagatatattgagaccaggtggacttggcagagcttggtgataaattgtatagaatgggtaagggagattggtctggagtttcctacttgaggacacagatggatagtagtgctttgttttgcaagtggaaaggccacggaagagtaggattggggaaacatcattgtttcttacacacatgtgcattgtaccttcatgagtacctgagggttatgagccttgttggctccctgtcatgccacacctttcatttctgctcaaggaaacataaacaaatgagtaaggaagtgctttagagataaccttgaattttctttgacctagtccttaaaaaatatttcagttgtaagctgttaagatccatacttttaaaagtcacaaatgtttatagacttgactctcagctgatctagacataccattgtttagacagacctctgctgatatacttagtaggttcttgtaagggttcaggaaacagtttgtctaagtgctcggggaagtttgcatgtcagcagtggaatttaaattgtccaaacatggtgcaaaaaaatgtacagagaaattggtggcaaatgcaatataaatatgtggtgagtgaaccaaatattaatgctggaaaaatgcaagcatgtaccaggaatagtgaatagaaaaacatggttgatgtggatcatatatggagagaacgtttggcacatggactggtgaagctcacatctcataaccacaagacttaagtatttgaactttgttttgtaaacattgagctggagaatgagaacattaaatttaggaagattaatctgaggttgatgtgtatgcatattaggttggagaaatttgagacaggaaacaggaagatcgttgggtaaagtttctacatttgtttagatctgagatgttaaagggtctgaggtgagtgtgtcaatattttattaaaaggttcagggtaattgaagagatattcattggaaaacaacaatgagctagattgatgatttactgggcacaaaaagaagggatgaaggaagaatcaaagctaccataatttttacaatttgagacaatatgatgattaggggacagaacaaaagaaggaaattctgtttttgtgggagacatataatgacttgatagatgtactgaatagcaagatatgtaggtggatattatggatatttttgagattgtgtttatgttttttagtgattattaaaatccccaaattttcattggcaccccggactaaattttatttaaattagtttaaatgtccttttcttcagttttctaacaaacatgcacttaaattttaccatatgccagtcattatttcaagaacttctgtttaaacttatataaccctcatagcaacgtcatgatgtagttgctattattatgccatttcacagatgaagttaatatgcctcatgtcaacacaactagtaactaaaaatccagcattcaaactcaggcagtctggttccaaatgtacttatgaccactccattctgctgcccgtgactatatatggaatatatgcctcggctacaatcatatttgtatttattcaataaatgtttcataagtaatatttgataggtattacactaggtgctaggaataaggtggtgaacaaaaccagtcactgttccattcctcataaagcctacagcctaaaaggaaagatagttgttaatcagttaatcatatgaaggaacttgatagcaggagcacttaaacagtgtggattttacccaggtaaactgaagtgtaaggggtgggacttgcaattatttgggcaaagaaatatgggaagagcagagaggacacttaatgtgcaagaagcctgtggtgggaggcaggatggagaacatgcaggcattggaacaaatgctagcatggctacaggagacagagggcccatggtagtagagtagacagtgtgcgggctaatacaaaccatggaagccacatcatagggagctttctttatcctaaaagcactgggaagtcattgaagatttttaagcagagaaaaactcaatcaaattttccgtttgaaaaccctaatttgattagactgtagaactcagaggtgaatgcacagcatggtaatgaaaaaaaaaaaacacagaagacattgtaattaaatcaccatagaaaggtaaagcatttgtcttaaatgtttattttttcctgtgtatatgttggcttactacagtaattacagatgtggtgatacaactaatagtcaactctcctcaggacattctttgtaaatgtaattgaaagtagacatgtatttgaaaaaaaattaaattaattgaagataagctattatctaggattggtattaggtgctttctaggacatcttatttaattctcaaaacatgttacaaatgttaggccttcagttcgaaaggttaattagattaaattactgttcttggtcattattagtgcagtgaagttagcagcaaagttcaaccattgtggaagtcagtgtggcgattcctcagggatctagaactagaaataccatttgacccagccatcccattactgggtatatacccaaaggactataaatcatgctgctataaagacacatgcacacgtatgtttatcgtggcactattcacaatagcaaagacttggaaccaatccaaatgtccaacaacgatagactggattaagaaaatgtggcacatatacaccatggaatactatgcagcggtaaaaaatgatgagttcatgtcctttgtagggacatggatgaaattggaaatcatcattctcagtaaactattgcaaggacaaaaaaaccaaacaccgcatgttctcactcacacgtgggaattgaacaatgagaacacatagacacaggaaggggaacatcgcactctggggactgttgtggggtagggggaggggggagggatagcattaggagatatacctaatgctaaatgatgagttaatgggtgcagcacaccagcatggcacatgtatacatatgtaactaacatgcacattgtgcacatgtaccctaaaacttaaagtataataataatttaaaaaaggaaaaaacaaacaaacaaacaaacgaaaacaactttttttcccctaaaattgtttagtaatctgtgagccactaaaataaattcctttcttggaatccatctattaaaaaatctttgaacttttgaaaatacttatctcatacataatttacagatgagtaccccaaaatagttttgactaaaatattaaagccagagactctgaattcacaatttgctgccaacaatgataaattatgatgtcatggaacatgcagaatatttgttggaaatgaaaaattcaagatatatatatatgtgtgtagatatatgtgtgtgtgtgtgtctgtgtgtatatatatatatatatgtttcttactcctaaggaagttcctcaactgtggaagagacagaaaaactgatgcacattctcgaaaatataactatcatcaatttgattatctataattaataataatttctattaattttttggagaatctgagggttgtcacacctgctatctcaagctccttcctctttctgagaagtcttgcatattccattttgtatgtcactttttctgtcttatcactcagctctgacttaagggtttccaagatggaagtgtcaggagaaaaagaaatcactgtttttccttctgcagaagtatcattaattttttttcctttagtccatccttgacagcaatgtcataattatttttcccaaagtctatgttaattcttagtttaaaatgttaaaatctacaattcaagtaggaaaagtggcagataagagacaggactaacaagcagctcccacttagatggacagaacagtgtctggagactcacattgtgaacttttgctccaagaacatcacaggaacaaatcaggaaaacagaaataattcacagaccctttgaaacaagcagcttgcttctgcaaatgccattagacagctgaaaaaactatgagttcccaaagtgtgaggggggaaaagtcaccctctaaacacatatccccactgtgaactgaaaaatcctgatcatgggagaaggatttaactttacttagagccaaaacagatttaggaagccaaatgaaagataaaagtagaagcagcagccagaagagtcccataggcacttccagtcttcaagtgaagtccagggaagccatttctggccttatctcacagaggtccttggggaaaggaaagcagctggtggaatttgggaggtgcacagggtgaggtaagctcctaggtgaactttgtaataatttcgactgagcacaaactttcctgagcagaatcagggggagacggggaaaacaggtagtgcagatacaagtgcagaagccacagatggtgtgggtaggcaggcccaggcctgagagccctgcttgctttctcaattgggacgcttatagcctggggcaagatttcagccatgctcacaagctgcctggatataaactcagtgcagttctggaagcatggtgggagtgagattggccttgctggctatgtggcatctgggtgagccctgtcactgccagctttcccccacttccctggtgacctgtacaatgcagcagaggcagccataatctccctgggaacataacttcattggcctgaaagccaccccaaaaacccccacagtggctgcagcaagccctgcccaaggagagtctcagctcaaacccacctaaccctgcccctacctgatggtttttctttgcccaccttggtaaccaaagacaaaagacataatctcttgggagctgtgtgaccctgcccatcacctgagaaacctaagcactcatctggccagtgtagggcaaaattatatccctcttctactgctatcctcctttcactctctttaaagcaccacctcctggctggaggccaaccaactcaagtcattacagcaactcataacagaacaaccctgcttcgaagaaggaaaaaacaacagctaattctaccacctgacacaccctggctagccagaggtcctgaatctgtccacatgacaacttcactgctagcataaccaacattcaagaaaaccagtgcactaaacaaaactacaaccaaggactcccacagagtccactttactcccctgccatctccgccagagcaggttccggcatccacagctgggagacctgaagatagactgcatcacaggacactttgcagacattccttagcaccagcctagagcccagttgccccactgggtggctagatccagaagggtaataacagtcacaggagtctggctctcaggaagccctattcctagaagaaaggggagagcaccacatcaaaggattaccctgtgggacaaaacaatctgaacagcagcgcttgagttccagatatttccaatgaaacattctacctaaatgagaagaaactagaaaagtaattctggtaatatgacaaaacaacattctatgacacccacaaaagatcatactagctgtccagcaatggtctaaaccaagaaatttctgaaatgccagaaaaagaattcagaaagttgattattaagcttctcaaggtggcaccagagaaggatgaagactaacttaaataaattaaaggccgggggcagtggctcatgcctgtaattccagcactttaggaggccaaggcaggtggatcacttgaagtcaggagttcaagaccagactggccaacatgatgaaaacccatatctactaaaaatacaaaaaagtagccaggcatggtggctcaaacctgtggtcccagctacttgggaggctgaggcataagaattgcttgaaccccggagacagagccaagattgtgccactgcatgccagcctggacagcagggtgagactgtgtcaaaaaaaaaaaaaaaagaaaagaaaagaaaggaaaaaagaaatacaaaaaacatataggatacagatgaaaaagtctccagggaaatagatataataaaggacaatcacaacttctggaaatgagtgtcacacttagagaaatgcaaaatacactggaaagtttcaacaatagaatcaaacaagtagaagaaaaaattcagagctcaaagaagacttctgaattaaccctatataatgaagacaaataaaaataatttaaaaaatgagcaaagaatccaagaaatttgggattatgttaaatgaccaaacataagaataattggtgttcccaaggatgaagagaaatctaaaagtttggaaaatttatttgagggaatcaatgaaaacttccctggtcttgctagagatctagatatccaaatacaagaagctctaaagaatacctggtaaactaatcacgaacacatcatcacctaggaacttacatagtcatcaagttatctaaagtcaagatgaaggaaagaatcttaagagatgagaggcaaaagcatcaggtagcctgtaaaataaaacctatcagattaacaggagatttctcagcagaaaccctgtaaaccagaagggattggggtcctatctatagcctccttaaaataattatcagcaaagaatcttgtacacagcaaactaagcttcatacatgagagataaagtctttttcagacaaataaatgctaagagaattattcaccactaccaagccagcatataagaaatgctaaaaggagtcctaaatcttgaaacaaaaccttgaaatacacaaaaatagaatgtccttgaagcataaatctctcaggaccaataacacaatgagaaaacaatgagaaacaataacacaatgagaaaaaaaacagggtattcaggtaacaactagcatgatgaatagaacactactatgtcacatctgaatactaacattgaatgtaaatggctacacttaaaaggtacagaatctcagaatggatcaaaatcccaaaaccaagtgtctgccatcttcaagagactcatctaacaaataagtactcacctaaacttaaggtaaaagagtagaaaaagatattccatgcaaatggaaaccaaaagtgagcaggggtagctattcttatatcagacaaaacagactttaaaggaaaaacagttaaaaaagataaagagggacattatataatgttagaaggattagtccaacaggaaaatatcacaattctaaatacatatgcacctaacatgggagctcccaaatttataaaacaattaccgctacacataggaaatgagataggtgacagcatagtaatagtgaggaaacccaatactccactgacagcactagatagatcatcaagacagaaagtcaacaaagaaacagtggacttaaactataccctagaacaaatggacttcacagatatttacagaatattctatccaacaactgcagaataaagattcttttcttcaacacctggaacattctctaagataggctacaaaacaagtctcaataaatttaagaaaaattgaaattatatcaagtactctctcagcccacagtggaataaaattggaaaataactccaaatagaacccttaaagctatacaaatacatggaaattaaataatctgcttctgaatgatacttgggtccacaatgaaatcaagatgaaaattaaattctttgaactgaatgataataatgatgcaaccaattaaaacctctaggattcagcaaaagcagtgctaagaggaaagttcatagcattaaatgcctacatcaaaaagtctgaaagaacacaaatagacaatctatgctcacacctcaaggaactagagaaacaagaataaaccaaactcaaacccaggagaacaaaagaaatgacaaagatcagagcagaactaaatgaaattgaaacaatgacaaaaaatacaaaatataaatgaaacaaaaagcttgttctttgaaaggataaacaaaattgatagactgttaatgagattaaccaagaaaagaagagatacgttccaaataagcttaattagaaacaggccaggtgccacaggtgtggtggcttacacctgtaatccagcactttgggaggccaaggcaggcggatcaccaggtgaggagttcaagaccaccatgaacaacattttgaaaccctgtctctactaaaaaatacaaaaattagccaagtgtggtggcacgtgcctgtagtcccagctactcagaaggccgaggcaggagaatcacttgaacccgggaggcggaggttgcagtgagctgagatcacgccattgcactccagtctgggtgacagagcaagactctgtctcaaaaaaaaaaaaaaaaaaaaaaaaggaaagaaaagaaaagaaacaaaacaagagatattacattcgataacacagaaatacgaaagaccatttaaggctactatgaacaagtttatgcacacaaactagaaaacctacaggagacggataaattcctggaaatatacaacccttgtagattaaaccaggaagaaatagaaactctgaagagaccaataacaagtagcaagattgaaatagtaatttttaaaaatgccaacaaaaaaagttcaggaccaggaagatttatagctgaattttatcagacattcaaagaagaattggtaccaatcctgctgaaactattccaaaagataaagagctaatcttccctaaatcattctattaatcaagtattaccctaataccaaaaccaggaaagaacataacaaaaaaaaagaaaactacaaaccaatatccctgatgaacatagatgaaaaaatccttaacaaagtactagctaactgaatttgacagcatatccaaaagataatccgccatgatcaagtgggtttcatactagggatgcaggggtggtttaagaaatcaataaatgtgacacaccacataaacagaagtaaaaacaaaaaacatacgatcatctcagtagatgcagaaaaagcatttggcaataatccagcatccctttatgattaaaccagtcagcaaaattgacatagaagggacataccttaagttaataaaagccatctatgacaaacatactgatcagggaaaaatttaaaacatttcctctgagaactggaacaagacaaggatgcccacttttacctcttatattcaacatagtactggaagtcctagccaaagcaatcagacaagagaaagaaagaaagggtattcaggccgggggctcatgaccataatcccaccactttggaaggctgagacaggcagatcatttgaggccaggagtttgagacctgcctggccaacgtggtgaaacattgtctcaactaaaaattcaaaatttagtcaggcacgatgacacacacctataatcccacctacaagggaggctgatgcacgagactagcttgaacctgggaggaggaggttgcagtgagccaagctcacgccactgcactccagcctgggtaacacacacagtaagtctctgtctcaaaaaaaaaaaaagaaaaaaagaaataaaggacattcaaattagtaaagaggaagtcaaactgttgctgtttactgatgatatgatgatatacctagaaaaccctaaagactccttaaaaaactcctagatctgattaatgaattcagtaaagttttagcatacaaaatcaaggtacacaaatcagtagcactgccatataccaacaacgaccaagctgagaatcaaatcaagaactcaaccccttttacagtagctgcaaaaaataataaaatacttagcaatatacctatccaaagaagtgaaagacttctacaaggaaaactgcaaaacactacggaaagaaatcatagacaatgcaagcaaatggaaacacatcccatgctcatggatgggtagaattaacattgtgaagatgaccatacttccaaaagcaatctacaaattcaatgtaattcccatcaaaatacaatcatcattcttcacataactaggaaaaaaaatcctaaaattcatatgggaccaaaaaagagcctacatagccaaagcaagactaagcaaaaagaacaaatccgatggcatcacattacccgatttcaaatattctgtaaggatatagttaccaaaacagtatggtatgatataaaaataggcacatagaccaatggaacaaaatatataacccataaataaagccaaatacttacagccagctgatcttcaacaaagcatacaaaaacataaattggagaatggacaccctatttcataaatagtgctgggaagactggcaaaccacatgtagaagaatgaaactggatctctgtctctcaccttacataaaaatcaactctaagacgacctgaaactgtaaaaattctggaagaaaacatcaggaaaaactcttctagacattatcctagacaaagagttgatgaccaagaacccaagagcaaatgcaacaaaacaaagataaatagatgggacttaactaaaaagctccttcacagcaaaataagcaatcaccagagtaaacagacaacccacagtatgagagaaatattcacaaactatgcatttgacaaaggactaatatccagaatctacaaggaactcaaacaaatcagcaagaaaaaaaaaagaatatcccatcaaaaagtgggcaaaggacatgaatagacaattctcaaaagaaaatatacaaatggccaacaaacatctgaaaaatgctcaacatcactaattatcagggaaatgcaaatcaaaaccacaatgtgataccaccttctgcaagaatggccttaatttaaaaatcaaaaaataatagatgttggcatggatatggtaaaaaaaggaacacttttttttactgctggtgggaaattaaactaatacaaccaccatggaaaacagtatggagattccttaaagaactaaaagtgcaaatactatttgatccagcaatcccactactgagtatctacccagaagaaaataagtcattatatgaaagacacttacacacgcatgtttatagcagcacaatttgcaattgcgaaaatatggaaccagcctaaatatccatcaactaataagtagataaagaaaatgtgtcatatatatatatatggtgtgtgtgtgtatgtgtatgtttgtgtgtatatatgtatcatggaatactactcagtcataaaatggaatgaaataatggcattcacagcaacctgaatagagttcgagaccattattctaagtgaagtaactcaggaatggacaaccaaacattgtgtgttctcagttataagtgggagctaagctatgaagatgaaaaggcataagaataatataatggactatggggactttgggggaagggtgggagggggttgagggataaaagacagcacattgggtacattgtacactgctcaagtgatgggtgcaccaaaatctcagaaattatacctaaagaacttagccatgtaatggaacaccacctgtttccccaaaactattgaaataataataataataataaatattaaaatctttctattactcctcattatgaacactgagatttctatttaaattttttagataggctcaccaattgacttaattttaaagtgtagaactagatttttggaggttttaagaaattaatctcagtctgttcatatgcaaacgattagttgggagaaaagaagctgttcgtagttgatgatgattcccatgtggatgtatatataaattaggcacacagtatataaaaatggaaggaatgcatttgttgtcaaacttcctatactttcccctttgcgaagcatttgatacttctcaaactatcaatgacatagtaatctttttgtagacattattttaaagctttgttaaggtataattaacatgtaacaaaaattacatatatttatggtgtatttgtgatgttttcatatatgcatacattatgaaatgattaaatcaaggtaattaaaatattcatcactccacttatttttttctgacgagaacgtttaaaatcttctctcttagcaattattatgtgatacattgttattaataatagtcaccaggttgtacaatagatctccagcacttactcatgctggctaactgaaactgtacccttgactaacatctcccaagccctcaacccctttctcctacccctggcaatcaccgttctagtccctgactttatgagttcaacatttttagatttcacctattagagaagctttcagttcacagcaaaattgagtggaaagtacaccagagtggtatatttgttaacagtcattgaacctacattaacacattgtcacccaaagtccatagtttttagggttcactcttagtgttaaacagtctgggtttttacagatgacgtgtatccaccaatataattacatacagaatagtttcactgacctaacaattctgtgtgctctaccttttcatccatccctccctgctaaaccctgatctttttactgtcttcatggtttgccttttccagattgtcatgtagttggaatcatacagcctgtagtatttttttagattggcttctttcacttagtaatatgcatttaaacttccaccttgtgttttcatgacttgatagctctttatttttagcaccgaataatccattgtctgactttaccatcgtttctttattattcatctactaaaggacatcttggttgtttccaacgaacagaactgctgtaagcatccatgggcaggtttttagtagatatgttttcaacttatttacatagtaacttttattgtccatcttgtaagcctgaggtttgaggactaggtttgaccttcatttcaaacattagtttatattactccagagatgatttcagataattcaaagtgctgtacttatttgccaactttgttagttaagtgattaatttcatgattttagaggaagaaaggtgtactaaaactctgctctgagaaacttgttttatatttcctttttgtgtatgtgaatattcctatggcattacagcatgaatattgcactaaaattttgatctaagatctgttctatataaagtggaatttatcttggagagggagaaaggagaaagggtcaattttggattcaagcttagtgtgttcaactgtcctaaatcatagctcactgcttgaggcacagggtcttactgcagagtccccaggagagggttaagataccacaaagttttttttccctttttaaacatttctataatttttatcttaaagactatattttcatcatttttcaagccacttggttgttatagttagataccttgatactatgaatgttcaaggaaataattttattgaaagagattattttttctattaaatatacagtgaaactaaaagtagcaaggggatacaggcggaaacattaattccatcatggaaagagtgagtttattgcctgcctatttgaaccgtacactctatataccctttggaaaagaaaaaatattagttcttggcaagcctcatgtcttcatttatgtatctcttctgttttatatctcaaatgtctacttgatgtaatcaaggggagtagtatgactcaaacttttgtgaagaatgaattatttaaactaccagtattaaattttcagttcgcacaatgcaagggaactaaagataccattctctcagtctctttttttctcttcacttgagtaggtgaaagagaatatttgattatttgttttagtgctgcctggacaaacatttgggaaataaatcaaatgtgaaatatattaccttcaaggcattggtgggctatcatggaacagttgaaagtgtaggagcacaagagaccaaatgatttggtttgaactgtgcataagctcagtttcttctctggaaaatgagtcttcttttacctacccaattcatttggtgctgtttttttgagaattaaatgggacaacccatatgaaagtgaacgttgtgtacctagagcactgaaggcacttacaacatgagtaccctcctccccaacctcaccataactttcagaaaacagtaagtcagtacctcctgcgtgtaaagcaccacatttggcactgtggcagtataatgctaaataagatccggttctccagatgcagattattacaacactataaatagaattagttatgaatgcgcttcatgacaccataactaggacatactgcagcatatatgtacaatttttgaaaatgactttcatgtttgtatgtcttagtaactacacccagggtaactactggatttgatgggagttgagagacatggagatgatttaggagggaagctagtcatgtagtcaaacaccacactttataaaactccaaattataaattcacttctcccactatgaatgtactatctaatatgatagccactatccacatgtggctatttaaatttaagttgataaatgaaataaatgcttaaaagttcaactattcaatagccacatgtggctaatggctagctaccatattggttagcacagatataggacatttttatcaatgtagaaagttatattagaaaactattcagaagctaaggttcaaatttagggtaaagataggaagaagtaaattatttggcagtctatttctgaattcttgtacccataacggaaataatgcaatgttggcaagaaaatatgagagaaggaaatcatagatattcagtattttttacttgcatttatgaccttttttgaatgcttactaatacactttaattaatttgcacccccatacacatagtcaatgggttatacatcttgttttatgaacatcgtatagcagaggacactgaaatacagattttaagtacatttcctaatcatagcatgaagggaaatatagctgaatttgaactcaagtaattggactccagagccctacctagaaactaatctgaaaggcagtgggttgaattagtaataacagcctttagaggaaaatttaatttttttctgtttattgccaccaatcttggttgtttcctgatgggaattggaagggcacttttggaatgcataactgttctcttatagggtcaatcaaccaatgtataagtattttagaagctataagtatgtatgttggattaatcttgctgagagataaaatcagtagtcttgatattataaattttactatttatcctgttgactgcttgcacacaatcccaatagcttattggtagtaacttctcattttgctaacacaaaatattgaatcctacactatggacactgttgtacaatatagcatgactcttgctagtgagtgagtgagcctaaatttctatccaatttaggttcagcttgactgttttctattcattattcatattcagtaagtttcagaaaaggtttgaaggtattaaatttttcagttatgctttcctgaatttattgaaggcattttatgcatagttatgccattaacttagtgaattttgaaggccctgggaacatgtcccttggggatgtaaaaattctaatacagagtatttggtcctgttctcaagccgattatgatctagtttgaggaggcagtctaacaattcattcattcattcatctattagtttttgaggacataatattgtctaaaaaagctttcatgagtaaacaaagataatatacaatttaaatgctgtaattctttggagaattaagcagttagttaatggaaaactaatccatattagtttccattaacatatcatttccataaacatatcaggtgagctattgaaggttctcttttaaattcttgataagcagagatccttatttctagttacgtgtgatagacttgataggactaatgagtgtgacttaaaaaaatcctcaaataaaatattttatctggatgaaaattggaagcttctattcacactgtttactatttcccagtcttcagctggcatgggaacactcaatttaacggaagcaaatagcccataaattacctaaatgccaagtagttagatcagtgttactgctaaattcttctacactggggattctcaagttttggagtatcaatagccagctttcattttatttgtcttaaaatgacttacctgtcttccaatatgattgcactgaattttaagtaaattctgagatgctggcatatgataggtacgtgactttgtaaagggaaaataaatgctattttcatttatacgctcagtggttgtccttgtaatttcttcaagagtgggctgaatgatatttgagggcttgtcacttgtgcatattctttcaaaatgtatcccttagtggattaagtgtcaaatcaatctcttgcttcttcagtgcaaaatggatattttgttcctttttgccacatagatcatgtacctcatgtcatttagcaaggctgtagctatgtgaattattttatagttcctagattatagtttttacatgcaaactcgtatattgatttgaagtggtagttttttctgcccgccagggatataggtggtagatcttaaagtggctcattgtttggatttaattttgttcttttcctaaacatagcttttaccttattcatgtcataaaaaagttttaccatcatctcttggagattttattcagcatattatttttataatatgttttggctgacataacttgcctactactttgatttttttttaaatttggtagtattgataaaatataaaagtcactaaaaatcctattacttgttttggaattatataaaataagtaaatgttccttgatacatcaatcaattcccttcctcaagggcaattactatcaatttatgcatgtccttcttgaattatttctaaatttacatactataatcatgtaaatatttatatatgtatcacaacatatttacctgcaatttaactttatggccatctgtgttgcatgtgtatacacacactaatgtgtacacatgtacatacatcataaaatgatacatcataggaaaaatatctgtttgcaaatttgtttctgcttaagagtatattctgaacatatttctggttcaatacatgtacatgtgttgtattttttatgattgtatagagtttcattgtatttatgtattatatgtcattctaccagctctcttgatgtatttttgttttttgctattcaatcagtgttgcaacaaatatacttgtacatatattttaatcatgaatgctattttatgtgtagaatatattcttagaagtgaattgctagatttaaggaatttatattttaattttaatacatactaattaatgtttatgaatactttacaagggaaacattatactacactatttctgattgtttttgtaagtcatctaggaaagcattcttttgaaaaccattacttgatatctggacaaaatcatttaaggaaatatttctgtatagggtaaccctatatatggtttatatagctatagtgcctgaagtatatatctgtgcatttatgcagaaactttgattatatctatcctaaatcaaattcgagttgcaacaaagagatggatctttgagattagacagacacccattttaagtgatgtggtaactgaatgttttaagttattatgtataaccacaaaatccctggaactctagtaagaactctagtaagagttgcatgttggcaggacttcaccaatccacctaagccactattttttttttataaccatccttgtaaatgagttcaacaatcaacaatattttggttgtatttaagggttcactgtgaatataagaaagattttataaatttaaatcacaaagtgcttctcccttgatttttttgcttgttgaggcaaagtcctatgtagcccagttcacccgaagtcatgctcattctttcacatcacaaagaattacattctttagcttcatggaatgtcatggaaataatttatttctattaaagaaaaaagataacacttggtatggttccaagggagatttcctgcttaaaattttacgagatggttaacagaaaagtctatccaggttcacccccacccttatcttaagcacattcttatcccagaatagaaatgatgcagaatgtaaaccatgcatttcaaggtcagatagcagagttcagaccagaattatgtttgtattatatgctatcgctatatcctgtggtttaaaagaaaatagtctggaaaaaagtctgtagaatgttatatttttgatagaatatctcactctgtcacctgagttgaagtgcggtggcatgatcaaggttcactgcagcctcaacttcctgggctcaggcaatcctcttgcctcagctccccaagtagctgggaccatagatgtacacaatacctggctaatttttacttttatttgtagagataggataccattatgttgcccaggttagtcacgaactcctggactccaatcctcctgcctcggcctcccagagtgctgggattacaggcatgagccaccacacacagcaaatgttatcatgacattattttttaacatttccctttcttggtattgatgactgagacttgtgatgttaaataattctgctgctctcttttgactttataattcttgtgtaatttttacagtatgtgtttatacctctaagaatgcaggtgtatatatgttatatgtatatcatattcatatatttgtatttctcccattcctctttcaccaatgagaaatacatttataagtactttgtgaaaaatactgatagaatgcttagatgaaagggaaggccataaaaattatagaagagaaagagaagcagcagcctgagccaagaaaagtacttaactatcttaacccctaggtactaaaaagaaaaggatatgtgcttgcaggaacagattttcagtcccttactgccaggttaattgcatagcattatatttcctttctagggttctttgcaaacctacttattggcatgaggtcattccgaagcattttgttgaaaacatgtttttaaaacatcattgtgctaactttgacagatttctcctagaacgaatttctttatttttcagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggtatgtattaacttcagaattttagttgataagatacgcaaattatcttttgtctttgtcagtatagccatcaaaaagttttttgtatgatgtcattttgcagattattagcttaaaaagtctgagtttgttgaaatcttgcaggtttgctgctaacttgatactttgaaaatagaaaaatgaatatgccctcttactattggttacctcatggatacaagaatagaaacagaagtagcagaattctttccaagctaaatataagggccattagggcaaaattggtgcaaaattgtggatatttggaaaacagaggaccaaattttacccccaggctttgatctggattaaagggtagctgtgcatgttctagccatagagagcactcttgtcttttcacctctacaacagtatggaaacactattgaccataagctctacctttattgaacgtacagattactcattcatttatttattttttagtgagttaaaaatcaggcaagataacaagagattaatatcatcaaagatgttgaattaaaagacagataccttagtgcctacacctactgagataactgcgtagatttctgtagttgtttctgattgaatttaggcaaagtcacttccaaatcatagaatgagcttatttctttggaagaaaacatacattggagcattcagtgtttcaataccactccatacactaggataacatgttcaaactttccatgtaggctccaccacagtacaactcaaatatgtaaaatattagaactaaaggctcatttttgcaaaatgcaaccaaattgagaaaggagacatctagagaaaaaaacttcgctttctttttgcctgaagccttaaaaatcaatttaataggtcatataataacaaatattaatatcaaagtaaggtgagcatccttcagagagaacaagtatacaaattcccttccaaacagccaaaatgcctattgcccctaggccccattcccatgcgtaacctaggaaatttatggaaacagctgaaatcttactaattttatgtgcttaaggaaatctgtatttgttctcagaggagttggcgtgatatggcaaagaaataccatcaaatttttgaaaattctcttagcaaagatgggaacagcataaatttagcctgggggaatatgctagacctgaataaaaaaaaggaaacagaataatctcacagtagtctgctttacacaatagtgtgctcatgaaatgctcagtaaataaatcagcttttgattattattaccatttcctcatatcaaagtaaaaaaatttggtggaagatgtgtgcgtacatagataatacctgtttttcagtcctgtggttaatttacagatcaattttaactttcaggtttgtaggaaaccatgcgagtggaggattataggaagggggtgtaaaagaattatttgcacaaacaattaaataaaattgcttacaagatctggtaaatgttaagatcgtgtaaaaatatatagccataaaatcaagtcttagtaacaaggagtacactctgcatgtgtggacgattaacatcacgatttaaaattctacagtgcctctgaattgccaaagaacaatcacatggggaaactatcgttaatttgctagtttgttcattgtacaatttttcattaaagaagcattttctcagtgattactataggataaattggttaataaaagctatgaatgtaaatattgtcttgtctcattttctcattgtccatgacttcttttgttgtttgaactaatgaaattttcctgtggacaccaagaagagtccatctaatattaaatcctctctgctagaaatagcactataggtgaaggttctaatgtgtatttactttgatggcttttaaaagccccatccaaataatactacattttaccctaaaattacaaagtttaaagcaacttatataatgaccctggtatataaatgcatactctataacaaataaaattatgtcaggaagaacttttagatggcctacttcttcagcctgtttgaaaaaatatattctgacattataaaaagcccataagttatatatattatatatataattgtaaaaatatttttgtacaaatttttaagtctataaaaatttaaaaatcttttgtaaacttctcagtaccaagttaaattaattagttaggttttccagttgctgcttaatgaaaagataaatttgcaatttctcctgctcagaatagaacccaaagtgatatgtaataggctctagggatgtaatagaagggggtcaatattatggcattgactttaggattagtcagagaaaggaaacagctgtgctcataaatgttcatgataatcaggaggaaggacaataagaagttccatttccacaagtggaaccgtttctccttttttttttttttaattattcattgtgggtgaggaagagattgagccgctgctgatggctttggactctacttgcagaattgactttcttgcaacaataacactgtgtcctctgcttgatgtcttttcacacttcacttttgaaaggaaatttggggcaaggctttttttttttaacctcaagatttcatttcagtggcacagaagatgaagcacatcctttgtgtcctagtgttttgaacagcaaataaaatgaaaagatgctctgatgaacgggaaaaatgtgtttgaatgataaagtagatcactgtactgagtgtgtatgaagaggcttctgtgtttagctgttcaaaggtctttgcctgcataaagcatccttatccttgtggcaactgatatgctaccctctgttgcagtgcttttttgtacaattatttgtcagaggatcttgattcacaactcactgttctcttttcacaacagctaatggcaagaaacctcagtgggtgagggaaggtgtgcaagcgatgaactggggagaagggagagcaactaattccatatgtttatgtcatgcttcttgtcttttttatgcttggcagataacttcctatgccatatacagggtttaacctattatttatactctatgacattctttagagataatttttcctctgtaaaatgtcagttcttagatcatgtgttcgctacatcctgaaatctttcagaaataaaaccatagaaaagtggagatgaagaacctatttgcaaaagacttataaaaatccaattaagatgttaaaatgttggaccccttagtaataaggtagattttattcacatctaccttattactagatgtgaataaaatctaccttattactaaaggtagattttagctatgaaaaaatagctaaattaagaaaattatatagttagtattggtaagtatatattgtatcagaatcttccatacattgctgaagaaaattggaaattggcatgctttctttggaaggcaattttatatcaaagacctcagaagtatttatacactttgattaagttgttctgcttccaaaaatgtattaaaaggcaattagtagagataggaaccagaatgtctactgaaacattaaaaaaatagctggaacctatgatatttggtagcagcttaaacaaattgtagtcatccatagatgccatccaaagacaatattcttgaaactatttaaggatatgggaaaatatgatatatgattaacatgaggtcacccgtttgtatctatatttaacaataaaatttcacattcagaatttgaaggaaaaatagatagtaattaggttgtaaattatatcattttcttcaattatctattaacaaacttaagatagtgaagaattatggcatgtaatctgaaacatgaacaattgatttatattatgatgcaattggaccaattagcctagatatttattgacataaaattttatacatcagtatattaaaaggatttttcacattgttgaagttaaactgatactttaagtgattacagaattctatgttgtatcataacaaaggtttttgtgtggtctgcagagcatgttgtaaccataaaggtctacatataatactcactctgacccctgctgttcaaaccatgttgacgtataagtgacaagagaaacatttcttttcattactctgatatattaagatcaataacattttcattagattcctttaaaatatttaggattgtgctttaagttaaaaagatgaacttaagtattttcttgaattcaaaagtatgtagttgatcagtctataaacaaaatagaccccaataattattttataagaaattaacttttagttgtagagttaaaaatatatatagctatagaaggctctaggtgtgaaagtatttatattttcagtttcaccgaaatgtaaaagttattggactgtattaatcaataatcttcctaacagtaaatttagtaatttttcaaatgttcatttaaataaataatttaaccacgttttctaaaatgatgttgagtgtttttatggggctaagttttacaatttaaattaagatcagaaatctatactttgttttcaagcttaaaaagagttttcaattatgaatcatgaaattgatgcttttatgtcattttttactaagatattttaagtaactaaccattttcttaaattactgctagtcttgctgtacagtttattatttgtaatttgcattggcctatcaatttagaaattgtcaagttaactttttttcctagaaatttgtttattttgttttatttatacacattctggtgagctgggagatggcgaaaaaagggatggggaagtattttaaaaatacacactttttttgcttgctataattgtgtcaatatcattatgttattggataattataggatttggaggccagtgactatgcttcatctatttctctgagaaagaatctactcaacaagaaaagggtttgctatctgcggtgtagcatgcaaatgtgtgtgatttgtttgagtataacttttaaaaaaatttattttctgtgtttgtgtttgctgtgtggtactgtcttcttttgatgcatcatcctgatgaggaattctacaaatttttttttgttttgttgaacattggtgagcattttgcttcaggggcaaacattgtctacctgaagtaaaaaggtttgtgtgtggatttttaaatattagcattttccatttcatttcttaaagtcacgtgttgcatcagaaaaagaatctatgcctgcctttaagtgtttgataaatcattccttattcttgtttttgtctatattgaagactataagagtatttttgtgggaaaaaagctatattacttttatgagtattaatttatgataataatttcaggatactcattcagccctggattatttatattaatttctttcccaggatcattttattttagactttttgttttttaacacatttttgttttatgaagtacatacttcattagtatttcaattcacttttactctggaactcagaaaacccttttcaaatctggccctctcccctatgtcagggaagatgcaggagggagcagttaaatcccttacgcaatgttacacaacttttaaatggcccagctacagtttgaattcagctccattcaccttcagaaatcatgccccatctgttatagaaagatgtactttgtctgcgttcattttagatgttattagaattatttcaagcaaaaggaaaaaatatataccaacttagaagagactcacctctgattgctattctgagtgatagtggcttaatccattattttaacctgggtgctgggtgctagaggaaaaaagagcgctcttttttccaggatatttctcaactctggggcaaaggcaatgaaattcattcaattctgtagggcttccattactgatgagattatgaatggacactccttgttcaaatgatttatatggatgccatattctattttaaatcattcttactggtgattctgagaaatgtggatactcacacacatcattattgagcttgtgagattcttctttgtttgctttttccttcttctcagcagcctcagatcagttttatagcccctaaattgctatccctatttatcacctacatttaacctcacagatttttgtgtgggtcttactcagagtgacatgacacagagagtagtctgtgactgtcttcactttcttgggaagcatgaaagtttttatgtatcttatagattccggcaggagagaaatgcctataatatttattaagggctaatccaacattcgcattatttcccctccatttatcatcatcatcatcatcatcatcatcatcatcatcatcatcatcaccaccaccattgctatccttcacatttgtggagcatgttacatatatcaaagcacacttaaatattttcagcaaaacatatgtaggaattataactactatttattattataacattgattaatacagtacttatcaaactttagtgtatatacacatcacctggaaaatttttttaaatgtagtttctgattattagagctggataggtccccaaatttgcatttttaataaactcccatgccatgcctatactgctggtctctgggtcacattttggtgcaagagagtaacatttattgtttaccgggtaccatgtgttcttaaccatatggttacctcataaaggagtgcaagtagaagacatggcacttgttttagagttgaagaaattagccttaagtagaatccaattcttctgacttctagtttactatttcttctactataccactctccttggcatattagaaccaattctctactctgggaaagtaggcagccattaatttataatatttttataagtgaacaacatttatcctaaagtatattttttcaagttcccttactaaataaaaggctaaaaagctattttcttcgacattaccattaatgttgtaacctctagttatatagaaaccaaatggacaacataatttttcatgctttcatttctttgcccatctgttaaaacttaatatatttaactaaactatacattcatggtctaatgcattttatccttgcagattctgtgacattgaaattctaccctcttgctttagtggaaagcctcattttctattcctggagctaacagcattccatttgacatttgatgcccatgagattttttttaatagaatctaggttatgagagtgagtctcttgccacatatttttgaatggaaacctgtgttacttttcccagaggtgttttacattatgcttttcttgaaatgcttttgattatttaaaaagaagccgccaatgataaaaccatttgtgtaataatcaccattgactagagagctctttatttgttttgaagagaatttgttcagaagaaagctacagcaatcctctcttctaccccaactcaaagcaaaagaccttgttaatgttacaatgatcaagtggggaaaatgtctcctactataagttttaatgtaactagatgttcttttgaaaaagataaatgatgacatgtgcttaaaatgagtagtacatatgactgcatgctagggctttagtacaaacacagtacaatgatagttgcctgtctaattatcttgacaaaggtatacattcagttattttatcttctaaaatagacaatacatgattacataaataattattaaaagtgaactctactaaattattttaatcacaaaagaaaattaaaggcaaggtatttggtgtttcaaaaactgacatatgtcctaatgcaattgttacttgaactttgtacttagcatcaacttgtaattgctgaaggatatctactttatatctttacatgttggccaaattgactcatttaacctgaagtttgattaaatttagaattaactatatctgatataatataaaagataaacatttaaaatatactcattataatagaaccaatctaaattatatctcctaacagtaatcttctcttcattccagagtttctctcactgtctagtaactgacacattatgatgcacaaaaagtgcttgcagggaaaaaagtgaattaatattaatcgactaaaccaaataaaataataatgaaaagaaaaaaatataaaactatcattgggctgttattttctatgtgccaagtactatgctaagcataacagtaaatattattttgtttaatcatcacaaaaatattatgaggtgggcactattgttttcctgcagaaaaatgtgattttgtagaataacctcccaaaataatatgaccagcaagtattagtgctcatactcacacccagatctttgtggcttgaattacgcaaccattatactcttttcatctattaactttagtttagaccttgctctagtgccactaccaaagtcacctttttagtataatatagatactacatacagacatttgaatttacattttatagcaataaggtaagagtgcttgcttttgcaattaaacatttgcatgatttaaattcttgccttttctaaagatgctaggtaaaactttagcctttattcagtttgttcatcatcacaacccctatcaccaccaccacataaccacataactatcatcttccttgtcttacaaggcattgtagtcactaagtcctttctctgttctaagtattgcattaagttatgcaactctacagatttatcttagtcattgcttgctggtcaccaatcattcttttttttttttttttttttggtccattagtggccaggcttggtatattcgtatttgaaaaactattaacatatgaggtaatattacagatgtgctttaaaagcaattttattgctttataaaaaggcaatatttacacaaagaagtgaaagtaaaacaccatttttctgttagcattttcctaagaaatgatgctggggaagaggtttatctgtcttaaattttaacgggctgattctgttaatgaaataaaatgaagaatcatgcagtttcttctcagtttgccaaattgcttttctaatgagtctgtgatagagttgatattgagttttggcatgcaaaagctgttttaaattggcaaatgaagaagcaaagaaatacacaatattgatgcatcctacatgtgaaattgtctttcttacagcactcacattattatttttcttcagaatgaatttgattttccaaattagtactcagaatatgtacagtaagttggttaaagaaccattattatcaggtattatcttttatagttggttattagctgcacattgacacaatttagtcagttaactaatagtttttatattttgacactcttgtcatcaagaaatgcatgacattgtatcaaaagctcttgatgctatagccactgcttcacacagattttacttaggatgagggcattagctttaaaagtcctcctctcctcagtttttacatacttctttctcccactcaaaactcctttttgttattttgtaccatggatatgttaaaaaaaaaaaaaaaagtctgaatcagaaaaaaattgatgatctatacaggaagatccattttcacttgtttatttctgtttcgtaatatgtgttattgttctctgtatgaaattgatgcctgtgtggcattacagcccttatgttactttgtgctggaatttatttaatatactaaaccttatgaagttgatatcattctagccacagtcaacttgtagtagatttgaaactggaggtagtaaatatcttcattttaagcccttttaattaaaagcaattaaaaattccctaactaggactttgtgacaatttactgatggtcatctgaatctaaaatttgtgttatcagtaatagaaatatcctgcaattcagattttccataatcggctatgggatttaaaatttaatggtgggattagaattctggtaggattcaaatttattttaaaagctttaaaatgccactttataaccaaataataatacatttggatgtctccttaaaaccaaatgaaatcacacacttttacaatcaggtaaaagtgtttattctatttactacacacacccagcaaattccactgtgctgtcagtggatcaaatattgccactatcataatctgtagaaagaagaaactagaatatttaagtgaatagaataatactggaaagttaaattattacggaattctgtgtttaagaataaaagcaatattgctctttttcttaaaatctatcaataaacaatcaataagctaatattttccttttttagaatactatgtgtcagtgtaagactgttctcagtgcaaattttttccaatctctcttatctttattcagtgctgaataaaagaacattgtaaaaatccccacattttgcttaaaaaagagaatagtatgctcttttacatgctcttcttgtaggcttgacaaaagaaagtatgatttgtcacattactgaatgtctatcagtaaagcaaatgcactaattaatcacattatattataatagaaatatcaattcaaagtatagccttctaatttgcttctgtgatgggcaaaacttgctaatggtgcattggtacatatttccaaaattcagtcagttgaaattgtttctttctaaaatattatttaatcagatttgattagaagggcacatgaagtgacagggtctcactttgacattcatctttggaggataacaaaggaatgtagtataaaatgtttatccttatttcattttttttcctgctaaaatcactgttggaggtaggcccatgatattaaaatggctagcccttgctccatagttgtgatttgtgtttttaaatatcaattattgacaggtatcataattacagctacataggcatccaatattgatgtaccagtattaattaattgaataaaacatttttagggtgagatttcctgagggtttcctgagatttccggggtgagagttcctgagacgaatagctttcaagaggaagcataggcagagttttgagaactaatttaagcctttagtagagctagatgtattgaggtatgggatgggttctatgactgtcagaatgaagactagatcctttcctgggagcacgaggaatgagggtcattggcaagcctgtgctgttgagctgcttattccttctattgtaaaggtgttcgcctctgtcttgtctttcagtcctccacaagcaacccagagaagtgtgtctctgtctgctagagcttggccggattgcagccaggtaggtcaaaccactgcaactatgtcaagacattgacgatttcagcatccaagcaacacagaagcttgctggcttttcattgctaatgtttaacctggatgttgagaagctactcattcacgatgataatatgaacttcttgagggcagcagttaaccaaattaaaagtgtgccaccaatattcctaacctcaagatcttgttgtcaaagccactatgtctaagcatttgctaataaaatacattttccctccaaaactttcctggggaggggaggacattgtacatgcagttttatatgacagttctccttagtggaaagtctattcccatattctatcttcctcctccttcacctccttgcttcctttttactttttaataattttcagcctccccttttattccttttcttcattaccctcattcaacactttgctcttttagtttccacttctgactaggatgatagttttaaaattatctacatttttattaggaaaagacatagaatgttatccttatgtagaagcatctttgaaacctgttttttttctgtaggaaggaaaaacaagaattaatttcagaaatcatagctaaataagcagaggaaggaactctgttagctaaagcaacttgctttggttacctgttttcccatttattatcttgcataccatcagacagggcttctggccagcccatgaagcccaaagaacaagaaatgaagatacaaatgtttgaagaagtcttgatgcaaattaaaaattcaagattaattagaaaatggtttcttatccacatctgggtatacttttagggttgagatcagatgaataagtaagataaagtgagaactaacactgaatgaacattctcaaagaatttattaataaaatcaagaaaaaaaataggtgaacacaccagcaatttacaacttggctagaaaacttgctgccaattaatagacctttctttgatccaatagaaaattaacctgtaatcagaatatgtaacctcaagttctttaaatcatcatatcaatataatcttcatgaattgtgcatcgggtataaatttcattttgccacaataattgggtgtgcaaaagattgctttaatgtttttcaattcaaattaaatatttttgagccttacctcaacatggagtaaaaaaacaatttgagacatgtgaaggtttttctatttaccccacactcttcccagttaattgtgggaaggcctctgggggagaactctctagtcttggtcctttcagatgtctactgctcaggcatagttcaaacttgtggcatctggctgtttcttaggacttcgttctctatcattgctgccacatacttgggttctgtgaaggagcaggataaagatatacctcttgcttctagcacccggccacacctactcccccaccaaccttggggcttctggcctggaagacaaatggccttaagtcaagtgaaaaccaaggactcggcatctattgcttaagaaaggggaagttggccgggcgctgtggctcatgcctgtaatcccagcactttgggaggccgaggcgggcggatcacgaggtcaggagatcgagaccatcctgactaacagaatgaaaccctgtctatactaaaaatacaaaaaattagccgggtgtggtggtgggcgcctgttgtcccagctatcgggaggctgaggcaggaaaatggcgtgaacctgggaggcggagcttgcagtgagcctagattgcaccactgcaccccagcctgggcgacagagcaagattcgctctcaaaaaaaaaaaaaaaaaaaaaagaaaggggaagttaaaaatacaaggggtaggaaatcaaactaaataaaatttcaataaatgaactgctgccaaggaaatgttcaagtaaaagaaatatggattgtctagagttcctacttaaagagagaacagacaaaaaacttttttttagttgactatcacattagaatactctaaaatgccagatataatcttgttacttaaatattctaaatatttcatcagataagcctcttgcttctgaaagttgtgatacagaagtaaagagacggggttatactgtctctagaattaggtgggatttataaattttcctcccatttaagtttatagcatttgccttatttctggattttattttatatattgttattatatattatattaaatgagcacggtgattagggagcccgctgaataaacattttaattatagccaagtcatcaaagaagaagacaagctgcccaattagaaaatgcctttaagaatcacctttcctccagctccgagtctggcataaattgccccttgttacaggatgtaaaacaaattaaaatcttggttaatgaaagtgaattataatggccttgtcattttcaaggtaatacattatgtgaatagttcctcccacccaaatattttaaaattgtgatttgggtttgttccatttctgaccatgattcatttccacgcaacctgataaaagcagtgattattcacattaccaaaaactatattatggattttacaaaagaagttccataaggattaagataacccttacattaaaatatttaatttgtaaatttggccttttatcttcttgactcaacttggatggtgtgaactattgtgtaccttcagcaataaaaaaaatcctaataaattattcatggtgctactattattctagtgtgtgacatgatggtaaatagttgaataccagtaggatagattgaacatttaagtaagaatgtcttaagtttctctctggatacatttaaagtttttttgattttgttgcaaattcaaacgtgttttacaaatggcaacccaataaactcagatcttactgttttacccctgtgttgaagcataattagttgaaagaaaaaagggaaatttctcttaatctaattttactcctaaattttgccttacatacattagacatatatctaaatgcttaaatttgtgcttctcacagacccatagaggattatacaaattaatgacttaaaacagttttaagcagaactagaagtgattttgggagagctctcaataatcacaacagtaatttgcacacagagcagatgagtttagaccttaatgaagtctccagtacaatcttgtgagttttgtgtttttcatcattgatagacgatgtattcttatatttgattctaaacacttttccagattacataaacataattttaaaaccataaacatcactttggaaatgattcccagtgagtttctgattctctgccatgttttcctctcgggacacttaggaagctcctttgcgagctgtgggcttctctgagttctgagatggctgaatgagaccacttatttttgttctcatgggtaaaacttacttttattttcaactaaatagagctatcatcactgaagagtgaaatccctctgctaatatttcagaaaaatatcagtttctgaatataaaatatgtgtttgacttgtgaaaagtaaaactctgtgtaaaagcaagttaataaaacctcaaagatatttttactgacagtgttttgatattcattgctgaaaacaaagttagtataaattcagcattttttgactgtagaattaagatgatccttataatagaagtaaaaaaaaaacttttgatattttcgtttagggtcataatcaataatcagtggtatagtggagttttttatgaattttattttttagtatttctttgatttggagcaaaatttatgatcatttaaaagaaaaatactttcggaacattttctttaatctgtgatttttattcattaccttttaaaaggaaatgttacttaaaagaaaaaaatattcttatacaaagatgattaactgacccatcctatttaaagcacttgaactaactgctgagaacatcatatactttcacatggttgaaatttccttccaaatctaaatcaatctttaaattgctttaaaacagaagataaatgaggaaaaaattatcttgcaggaatctataaactgtctgttatatgccttaaaaaggacagtttctcgcactaggctgtaaaatttgtccctctaaccctagtaaaataggatccagatgtcttttgtttgaaaactctagactactaaatagtttgagtaaattttctagtttaggcctcagtttggggtcttagtaattttacctagagctcaaaaactgtgtcaagtgccagaaaaatgagaaatccattcctaaaacctcatcataaagtcattaaccataagacctgttccctatcactttaaaaaaaaatgagacaaaaatatgttgccctttgagtattcgccctactttcattatcactggggtataaaggtatgaggatatgattttagtggattctaccttcttggtctctttagtgtgacccttaattagtttgagaacaacagctaccccattctaaaactctgaaatcttgtggttggaagggagtggaaaatactataaatgtgtgaaaacctcattgacaaaataaaaatgtggagtggtatagagttcatggaaaccagaatgaagcagccttttggagaacagaaaaaagatctatttgatgactaagttgacttgcaggtgcaagcccccaacccaaagggaattttgtgatttacaatctgttgacatctccagacagacaggaagccagtgaatcgtatttaagtatgcatttcaggactggctgactgtaccttaggcagtttgaagtattcaaaagccaatataagcagagatttgggacttagtgttgattttttatgttcagcggcataactaattttcagcattcccagataaagaaaaatctccagagaaaggttttccatgtgtgactttgttaccaattttattcaaacctagtctactttgtttatattggacatagagccaagtctgttgttactcgaacataagtattattatttcactttgtaaaaaaatttaaaaattatgcaatctattcctgaaaggtggcatgaatccacctacaattacaaatgaaatcatattttccaattcacctaatttaagtttcaaatatgatatttttcacttatggatgacttttaattggctgtgacttctcacgtcttaagttactctagcctcactaccaagtttatgctattcttttaagaccattaaacataaccaaattttatagcttcctggaactaagatggcagaaaagtttacagagtttaaaaggggttgcttgacaaattttacccagtgagttagtagcaaagctgaatttataacttgatctgctaaactccagtactgagatagttctgacatttcacaattctagggaaatttatttaaagaatgactacagtaaattttttggtaaagaatataataatattactttgtattttaacaccttaattttgaagttaacatgatgtcattcagtggtataatatattctaaaaaccaagaattttagcaacagaaccttagtgctgcagtttccagattgtacaacacttaatttgtcaattaacttatcaacaatctcagatgttgtgccatgtgtcagagactatactgggcacatgaagtacactatttaattccttctaataatactaaaacatagaaattagaatttccattttatatttaaataaaactgagtttcagaaataatatatgtcaagatatccagcaatgtcagatgcattgaagatgctcagtagcagttgcttttctaagattcttcctcttgcctccctccctccactgctacaacagaccttgagaacaggccattttcatttctacttttctgatggaaaatagactcatcgaagttaagtgatttgtgaaattttagaagtaggttataaaggaaatagaagaataagaacaaactaacccaaagctagcagaagaaaagaaataactaaaatcagagcataactgaagaaaattgagaccccaaaatccatgcaaggaatcaatgaaacccaaagttggttctttgaaaggataccaagattgatgcaccactagttagactaacaaagaaaaagagaagatccaaagaagctcagtcaggaatgacaaggatgacactgtgattgatcccgaagaaatacaaaagatcctcagagactattatgaacaccctaggtacacaaactagaaactctagaggaatggataaaatcctggaaacatacaacctcaaaagattggatcaggaaaaagttgaaaccctgaacagaccaatattgaattctgaaattgaatcggtagtaaaaagcctaccaccaccaccaacaacaaaaaagccctgggccagatgagttcacagctaaattctaccagacatacaaagaagagctggtacctattctactgaaactattccaaaatttaaggaatagggacacctcccaagttcattctgtaaaaccagcatcaccctgattccaaaatctggcaaagacacaatgaaaaaagaaaactacaggccaatatttctgctgaacacaggtgcaaaaattcttaacaaaatactagcaaactgaatttaacagcacatcgaaaagttaattccccatgatccagtaggttttattcctagaatacaagattggttcaacatatgcaaatcaataaatgtaatttaccacataaacagaattaaaaacaaaagccatatgatcatctgatagatattgaaaaaactttggataaaatgcaacatcccttcatgataaaaaaaaccctcaactaactagacattaaaggaacctacctcaaaagaataagaaccatctatgacaaaaccacagccaacatcatattgaagcaaaagctgggcaaaaactggaagcatttcccttaagaaggggaatgagacaaggatgcctactctcttcactcctattcaacgtggtactggaaattctagccagagcgatcaggcaaaagaaagacataaaatgcatccaaataggaaaagaagaagtcaaattatctccctacaaaaaagtaaaataaaacacctaggaatacatctaactagagaagtgaaagatctctacaagaagaaccacaaaacactgctgaaagaaataatagatgacacaaacaaaggaagaaccaatatcattaaaacggccatactgcccaaagcaatctataaattccacaccatttctatcaaactgcagctgtcatctgttatggaagtagaaaaaagtattctaaaattcatttggaaccaaaaaaaaaaaaaaaaaagaaagaaaaaagcccaaatagcaaaagcaattctaagcaaaaagaacaagccagaaacatcacattacctgacttcaagctataccctaaggctacagtaaccaaaacagtgtggtactggtacaaaaacagacagaacaatgaaacagaatatagaatccagaaccaaagctgcctacctacagccatctgatctttgacaacattaccaaaaataagcaatggagaaaggactctcttattcaataaatggtgctgggataatgagtatccataagcagaagaatgaaactggatccataccaatcactatatacaaaaattagctcaagatacattaaagatttaaacgtaagacttcaagctataagaattctagaaaaaatcctaggaaatactaggattcctaaatactagagtaaatctgcaaaagcaattgcaacgaaaacaaaaattgacaagtgggacctaattaaactaaagagcttctgcacaacaaaataaattcaatggagtaagaagcaacctacagaatgggagaaaatattcacaaactacacacctgacaaaggtctaatatccagaatccataagaaacttaaacaattcaataagcaaagccaaataacatcattaaaatttgggcaaaagacatgaacagacacttaaaaaaacatacaagtggccccaaaacatacaaaaatattctcagtatcactaatcatcagagaaatgtgaatcaaaaccacaatgaagccaggcacaatggctgacacctgtaatgccagcactttgggaggccaaggcagacagatcactggaccccagtttgagacgagctccacctctatgaaaaattacaaaaactccacctttacaaaaaaatacacacaaaaaatttagccaggcatggtggcatctgcctgtagtcccagctactcagagggctgaggttggaggatcacttgagcccaggaggtcaaggctgcagtgagccatgatcacaccactgcacatcagcctaggtgacagagcaagatcatgtctcaaaaacaaacaaacaaacaaacaaaaaacccatcagttactggtgaagctgctgagacaagggaagacttatacactgttggtgggaatgtgaattagttcagccactgaggaaagcagtttggagattttgtgaagagctgagaaccactattcaacccatcaatcgcgttactaggtatatacccaaaggaaaataaatcattctaccaaaaagacacaggcactcatgtgttcatagcagcaccgttcacaatagcaaagatgtggaatcaatctaattgcccatcaatggtggattggataaagaaaatgtaagacatagaatactatgcagtcatagaaaagaatgaaatcatgtcatttgcagcaccatagaggcagctgaaggccattatcttaagcaaattaacacagaaacagaaaacccaatactgcatgttctcacttatacatgagagctaaacactgggtactcatggacataaagatgggaacaaaagacactgggaactctagagtggagagcaagggagggaggaaaggctaaacaaaaactaatttggtactatgatcactacctgggtaatgggatcatttgtaccccaaacctcaacattatgcaatatacccatgtaacaattctgcacatgtacccctgaatctaaaatacaagttgaaattatttaaaaaataaaaaaattaagtaggtcaatggaacagttagttcaaaataactcagagaagaatgagaaacaaatcttaatgtgagtattgttggtacttgtcaagagcaaggtaaccagatgctgtctagaattcagcataatcaatgattactagaaaactaaaaaaaatgtgttctagttttggacaaggttgaagtcttctagattaacttggtcaagcatttttgtacatttaatacttacatgctttattaaagccttatatgcagttagggattcaaaaccataagactgaatttatattaagaaccttatttttatatgagaatagagaatttttttacattcaaatggtagctgttaggttattgccctgtgccaagatcttatgtgagatgcttgtgattcttggaaggagacagacagtgatctctaccactatgtttgcagtctagcagtttccaccattgtcctgtcccataaactggtacctatgtacaaaagtttagaaatatgttcaatggtgcctacagtcttttagcaagtgatatctatgtaagtaaacattaatctgtgaactagagtctgttctaaaagcagtaattgttcagtagaattgggctcactagactgttttgtttaaattttccatctctcaaagggctcctaacacatagcacccctctttactatctgaattctgaaaaaaatagaaaataaaagacttgcatgtcacctttacagctaaaaagatccaagccaatagacatgcttggtgtctttaacagagctccagaattaggccaactaactatctagtcacaagcaaagtggggggtccatgtggagggctcccggtggacagcttcttccccagaagtagggtaaactaagtaaagcatgctcagtttattcataaatttactaattttataaatccctttatcttgtagtggatgggtaatgaagcagaaaagccaggaataaaactacttgagcatccactgcaaaaacaaaacatcaagaatagggaaatcgctttcccctcggagtatgtactgaacatatgtgtaatggtatcagttaaaataataagcagttagaataggacaattacttaaggttaaatctaatgatgttttcatatactgttcaataagaagtactaaaacattgtcaacatattctctatctatagattatttactttgtatattttttaaaaatagataaaaaagtagataatagtagattaaaaaaaacatgtttttaaatctccaagtgacttttcccctcctttttaacacccagtcacctgattaaagtcagagaaactgcatttaagtctttatcctgctccttgctagttatatattttctctagatctctattatctgtaaaagtgagagggtgtaaattgatgatccccaaaacccttcacaactctcaaattctagaattattattggcctcccccacctaggtacagttgatatgtacctaggaaaccaaatctaattttatatttagctaaagaaatatatgattacaggagatagtaactatgtctctccctttgaacttttctggcatttataatttgcaaaacacatgttttatacattgttactctaaattatgtctctgtttcctctatgctcagttgtttcccaaaacaatatatatgctttcattatgctattcctaggatcataacctatgacattgtataacccatagtacaatgttctggacccataggaaatatattcaaagttaattcttttctgctaaatcatttaaagatgtttatttctggggattgctgtttgcaaacttgagtctgaccctctggttgtatttctatttttaacaaacttaggttcaaaatagtttcattacagcactagtatcagtaaacctggtaaatgtgaatgctgaagaccaaatttacatggttattcatgttgctgtttcattaatatattgcattgagtgtttttatttatttttagtatactatgtgtgtccatatatgtacacgtatgcatacacagcaggtatacatgttttgcctctgcttagaaggatgctaattcaagagcttacaatttcaatgccagaaaaaaagtgaatgttatttttaaaagtcagtgatttactcccatggtgctcatcatcacatgtaatatatggtaattgtatcattataagttatgcatatgtaatgatccagggtctttttaaaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtaagtaaaatcagtcagacttcttaccaacggttagtctttcttgcactacaaaacatattctgtgcaatctcgtatcagtctaatctttacctatatcaattttcttgaaatttattttaagcccatatgaaaaactttgtagtcctacaattcattttgagattcaaaactgaactagttgttcaaaataaagtgtcatttaatgctgcagaccaatatctaaaactttagaataataagtcaactccctgaaaattgtatttgaaaacatgaaagtctctttgtcactggatcaccattccccctttcacagatgagaagtctgaaaacaagatcttgaggattgttaaagaagggaaagtaaatgtatgatagagaagttaagtgccttttatggactaccattgtttttcaagtgctctcatatatgaaaggcaggttccctcttgagaaatggaaacatagaaattgagtaacctgctgaggggaggagaggagcttagattccaacaaaagttttgtctaactcttcaaggtcgctctacttagcagagcccttgagtcacaatttttggtagttaggaaatgttttaacagaatcacagtaaaccgtttttaggtataacagcaaacatggtgaattaaaactctcaagtgaccttggttgtctgttaagtagttattggttatgaaaagtagtgtgcttgagtatgtgtgtgcatatgccctccacatatattttaagtgcaaatataaaaaaaattaataaaggagataaatcatgagtgactgggatgttgtttatgcaaagtttgtattgtgggagttgtagttgcttattaattttatagaaaatggcaatgccagaggcattagagtgacgtatgtctcacatacatggggagagtccttagaaactagcaccaaccacaatgccagctgtgaaaataggcagaactgaaaaggactggtggtccatagctgtgagtttcttcctccaggatatgagcagaaaagagctgggaaaatggttggacactacaggatgcagaaaaagagatttctctgacttttgcttttctccatgtgacacgatcaactatattgcagatttagatgagccgaaatataacagtttgtctgatagattaagaaccctcatttctgttaagggcagcaagcatattagctcttaaaggtatcttagctagtttaatttggtttcttctgggtaactgttcaatcactcaggaactaaagaagaacaggaaagacattttgatttaaagctactgaaaaggattttaaaatcacataacttttttgaagaattggtcatataccttgcttttcataggatttcactttttattttgtaaggaaattgagtaacattatattattagtagataatgatctattgtttatatattgatgagaacattttttcttctgtgtcaattatactttttttattagacttactttagggtaagatgtacctctagtctttatgttataaatatatttccctggggcaaatatacttccttatagtctatttcctttcagctatcaccttcattcatttttttttaaatgccttatagtcagggttccagaccactaaagagtatctggctaatgtccctcttatcctcctattgaatgaattactggatcaaatgaatttttttagtccggaaattatgagattgcttcctggtatttgacactgttgaccactccattcttgaaatgcatctctacaacatttctgctaccagaaggataaaactaaatgcactttggacttgattaaaattatatagggtgctctataacatttgggtgaaatccaagctcgttcatatgtcatatagtccatagccctccatgttctggcctactgtgtgttttctggctattttgtctgctgcattagtccctgaattttgatgtagccattgttgctttctcactatacttctgcctactcacctgttacactacttttaaacacctttccatcttttaaaattcaggttgtgctaccccctatataaagatttttctggtatctctcatcccaggtataactggcaaatcattccttggtgctgccaagtatttgtatctatttaatgaagcatttacctttttgggtataaatgtcctttcatctcaaggtgcagactttgtactcaaagacaaagaccatattttatcgatctacatccagtactgtgttttttggatatattatcaatgtagctaattaaggttgaaacttctcccttattctgtttatccatgttggccacatgctctggaaatgcatgcacctttcatttctactgtagctttttagagggtggagatgctgccacttgaagctatttctgtgaacctagaagtagctaggatgattttctttcttcactagcttgtcccctatctggcaatccttgagatggggagaaaaagaagagagggcaagaaggtgataggaaaactatgaaaaggacttcagagtttaccaatactccagttcagaaaaagagagtgaaataaagattttccatacaatagtaagccagtcagtcaatacatggtggttctcccctactcccaaattgtatgctctcagttgagaacaatggaatggatttctcaggagctttaagccttcttcaaagtttaccagaatttagaacgtaaacatctgctcaaagttttaatcaaatgtaggaaatatacaatgtggatatttctgtaactttgtcagctagaatattatgtttcacaagtctttaaaatggcatttttcaatcaatgtttgatcaaacacaccacggttaaattagtttgaaaaatacaacttactatatatagattaggactgtagtcctcatgcagagtctggtgataaactttggcatatcaaaggctctagtgagttccataataagatcttgtttaacctggaatcttctaaacttatttgaccacagaagtctcttattccttcattttacactggggaaaactgcattgaactatttgcattctgtttgataggtttttttttactgaagtgttttatttcaggaacagtggagcagagagaaaagtaatctgagcttcactaatgttttaaatcagaaattaatacatctaatataaaaggaaattgttcctatagtaactgcttcactgcatgtgaggcacatatagcagttcggggttgaaaatgatgtactccaacatgggttttagaatagaaatataaaatagagattgcttgcagagtttctgcgtttagttaataatattggctaattttactctgggaaagctattatctgccaccccaaaaaagaaaaggaggaggaaaaagagaaagaggaggagtaaaagaagggaaaaaaaaacaagaagaagaaaaaagagagaaagcaaaagaagcagatctgtgttaagatattatagtccagtgaacagtttcagcaataactgccagttttgaaaccttcaatgtttcttcacatttctttgtttgatacttaggggaatagtgggaaaaaataggtgaccctttatgtggaaaatacatcaccttctttaatcaagatatcatgaaagaaacacagtggtttccattcagattaatttattctccagatgtcctgatagagtgattcagctgtgataaaacggtggagtcaggtttagttctcctcttcgcgagctagttctcacacaatgagttgaatacagttctcagaaatcattcttactttcttcctcttctccatcaacttcctcagtctggggatgagagatagtataattctgagtaatcaggctcctcttgaaatcccatttcagcagaaaactggctgggttcctagccaaaaaagaacacctgccagactgacttttccctaggtaatgtaagaagcacagatgtcatcagtcactgtttacttaacaatatatttccactggccacagtctggccttgtttcttccatttctgcttccacctctcatacaactacaaaaacagcccttgacttttaaaatgaactccattttcaaagctagaaaggcatttgagaagggcaggccacttgagaaaatgtttcttgtattttatttcatttgataccaagagtttctgtcttttgtctaagaagactgcaaaatggaattactttccatacagacttgtgattgtcattttttagtggaggaaccagttgaacatcaatttactctttggttaattaccacatggcagcaaaattgtgccaagcatgatcctcctaaagttcaggcctcaggccatgtgctttcttgatgctgtcagtctgattttcttctggatgatcgaccccttctcccaatgcccctccctttcttcatccttgctttcctcatggaagcccttatttgtggtgataaggaaaacagtaccacttctagcaatggcataaacatattttacatgtatatacacacatttatatttaaacatattttataaacacatatagaaagagatacacatagaaaaatactgaaaacaggaactatagacaacattcattggtcctgtgaccctaccctcagtcctagaatgtggttctgcattattggaaggaaatgatgtgctctttattcaacttttatatatcttgttttattatcatcgtcccattcagaaataacctttcaaaaaatctcttagaacagaaatctattagtgttggggtgaatgtatctatagaccaagtataatatgacagaacaaactcagaacacaaagtaattgccctaatcactaacttaatgttaagtagttttctcattttttgatgaaagctatttttaaggttctttgaatccatgattattttgttcctctaatttccccctgtgacctgtatagattcatgttcttatatatctatttagtcaatgtgtatttaatgaatatttatttgccattaagatgtgctttacatcaatgattttaaaatataatgaaataccatcttaactccaaaggaactcagtctagcaagaagacattaaggttaaccactaaatgagatacaatatgctatgataaaaataagtgccaaaagccataggtttatatgtcagcaaaattaaggatggcaaaaaggactaatggcaatgtatatattaaagttggttcttttgttcttttccccccaaaatagtgttggttctctttgtatacatcctcactgagtcataattgtacatgcgataaatttatgagataaatttaatttcagggtttttttcctttttttttggttattcttctattgtcttatgctttcaaactttctggaacatttcttattctaggaaaaacaagttgtttaattcctttacattaacattcaattgagttcatgttttactctctgcacagtttttgcttagaaggctgattaaagtcaaaaatcgaattatttgaaggaatgattgcatttctttcatgacataaatggggtagaccccatgacatctttgtggaagaattcgggtgaggaaaatccaggccaatttctaaatttgttctatctagcttctaaattcagactgcacatcatttacggctttctgtttcttccatggaaacttttcctcaaaacacaggagattattgttttgggttgtttggttggttggttagttgaagagcagacagagtgggtggttccccatcagggaaaacataaacataaaattgttcctaaaatcgtggactattatattatcatctagtaatcacaactattcataagctttatgcacatatcatttagattatgtatttttagaagagtgggagaatagatataacagggataaaaatctgatattcaggcatcaattacatagaacacacataagctataaaacatggtcaaagaagtagggtttgataggtaggaattactgagatggagtgagttgcagggtaaatctgagtatatgagagattaattcttagagaaaatcttagagttcaaaataagatgaaacaatagtctccttaaaaaaacaacttgttaaactcactctcatttattttgaaactgggtaaaattaatatgattaaaattatactgaagtaacataaactctatgttaacatactttctattctggttttcaataggttgaccttgacaacccaaatgtgcatggtctttttagtcctccaaaagtaggaacccagctgattatgtatagtctataatttcagttggtttcctgctcattatcctccagcatcatcactgtcattagctaacttatgccttagtgcagtcatttgccttcagatgtctttggggcctgaactttacatggttatgatttaatgtgatattcctatgctcacatgatgtccatagataaataacaagtttaaagtcattaagggttcaggggccgtggagtccttggagcaaattaacataaatgcagcctaattaagacaaatgaatgtgcctgctcttctatttcaggtgaaacgaatttctgaagatcctccttgcaaatgcccaaacaagttctgtgtggagcggctctcccaaggaagataccgagtgggagaaaagatcctcttcattagggtaaagttttacttttcacttatcttgtttttatgggaagattcagaatttgagttaggggaaatatgacagataagagcaggaacttccatatggtgcttacgtttaaagatacatggtatgaatttttttaaagtaacatacattataatgtactactgaaggctaaatacaactgttttctctttgtacatataccaaaacgcatatacaccaaagacaccatggagatcaaatagatgaagaaggctttccacttgtgttatgttttgctaagaatcaagataatttaatctctcaaagtaagtttgtggcttttactaagaccaataattctttttttaaaaaaaagaaaagaaaagaaaatgaaaaatagagatacattcctagaaatctgcagttgtaaataaaagtaatttgctgctttatggtttagtcatttctaaaggaacagaggttgtgatgttttttaaaaaagctatattctttcctcagttgaaaaagttaaaaaatatcctgctgttttgtagaatagaatgatttgaatacgtacatctagtaccagcaatgtgtagtctcacaatactcaaatctgcaatgactctgttgaaattttgcccttgtaaagttttcttaatttctacttttgaccaaaacttattggtataacaggtctttttaaaggccctgcaacatgtagttgcaaaaagaaagtttaatcataattttagccttaaaatataatgttaatggttttgaattttaatctaattttagattagcatttactaatatatttcttaaatttccaggaaataattgctattctgctttggaatagcagcaaaagtatataacaatgtgttattattggagtatgagacagatctgcgtagatggcctcactaggaaaggcagttgtctgagttgcttattgttcttttgttctttattgcaaggatagcatacatattttgttaagtcaaactgcctgctgtcatgttagtacattaaataatagtgatctagaatctccacagatgtgtttaaattttaccgggttgacctttctcaattgataatcagtctcctttagaatattaggctccagagcttagaatcaaaacagagagagtcatttgtttaaacagttattcctttttgtaataaaagtgttaataaagcacatgattaataaattatatacttctccctgcaatgtaacctaatatcttcagtcaaaaatatatattacatatgtttatttgcatctgtgatttcagatgcaaatttagtcatttgtcaaggattttaatgtccacatttgtgaataacatgtttttatagtccttactatataaggcaggttttttgatattccatttttcttttcaagaaatagttatcttttgattaaatctattcatgcattatttatagagaaattgagatttgctgtactgaaaaaattgtatcaaatttcttagggatattaatttaatatcaactaatacataagaacatattgtgcacactcagtttcttacttctaatgttccaggtgaacctgcaataagagagttaactgtgatgtggttattcactgattagtccagcaagtaatggcatcatgctattatgacatgttttagaatagtgtcttaacgaacgttaatcatttattctcttgatttttatactatccacatacaattttactatttttataacatttccctttaaaatgaaacgttttttaaaaacttaatttttagcaaagataaatttctgtcactgcctaaattacaaaccgaaactatttgtcaaaaaaggaaaacattcttgaacatatattgattgaaatacctatcctttggcttgtcataagttcatttccaccctgaaggagtaatatgattctaaaaaaggctcctgtctatgtgtctggttatccgtggaggcttaaaaattaaaatttcataggtaggtcacatgtgccttgaattgtatatttttccctatttcctcctctgtgttaactagaaaaactaaacatgtctccttgatgtgcatatgattatgctagtactttcagtttgtggtagggactatatttaattgattgccattctgctccttactaatgtaaggaactggcagttactactcaaaaaatctcataggtattgaattggttttcaaatgatcatatggttgtcactgctaatgttttaactatatttccttgaacacctggattaagtagtaagtgcctgtagtcaaattctcacacatactaggtgaacaactgcctcatagtgtcttcattgcagttcttgcatttcttaaatttgcatctttcacatgggcgtattttaaactttgtcatatcttttttgaggctgcctaatacggtcatatttactgacagtatttatgtatattattctataaagtatacatacaatgacacatacattgtgtcttaacatttgtcccctagttagttgttcaccctgagagcagcagtgtattcatatggtcataatgaacctgtccaatgcaaagaacaattcagggtcacttaaggctaatgagactgtttacctttacttaaagataaaacaattaccagaacactaactcagtaagaattgttccttaggaagtcatagatacgccaggcacagtggtttacgcctgtaatcccagcactttgggaggccgaggcgggcagatcacctgaggttgggagttcgagaccagcctgaccaacatggagaaaccccacctctattaaaaatacaaaattagctgggcttggtggcgcatgcctgtatttccagctacttgcaaggctgaggcaggagaattgcttgaacccaggaggcggaggttgtggtgagccaagatcatgccatcgcactccagcctggacaacaagagcaaaactccgtctcaaaaaaaaaaaaaaaaaaaaaaaaaagagaaagtcatagatacaagattcttttgataagcctgtgcctaacactgttaactcttgactgatgcttaactaagccagggttaacaattccattgctaaccaccttacaaggtttgttgaccacacctaatcactttatgtgtcgacttatgattatgtatgtatatgaacatatcttccctatacattcaaacagatacagtaacaacaactatgaatgaaaaaataagaatgcctgcaaatttcaaaggaagaccgggaagatattttctgcagagaatatctttactaagcatatgtcttgtctgtgggtttctggaaaccaatgtatgaatagatacttcccatacatggctatctaatgtgtacttatgtattaatagaggcatctatgtacttttgtagacaggcttgtttatgttcatatttctccatttacaggtgaggattaatccatgcctaaatgttaagaatcctttagtacagagaaaaacctctgaggatttaggaaaacatcctaataatccattgccaaatgggaattttttttgtttctagcttatgaaaaataatttgtcaaagccaaatttttgcctggtactttccaaagagcaacattgtttttttgaactatcaaatgcagctaatttttatctatattgtgcagatgcaaatgtactctcctccaagatataaatatttcagttatttttcagtgactttgaatttggacagcgatgataaaaccttctgatttctgcagtaacagagatttggattaacagagatttggattattcccattcaaccataatacgtatctttgaaatgtaaataggtggatctcaggactaatgtcttgatttcagggaggagagaattttctcttgttcatttgtttattcagtcagttggtatctacataggcttcaagtatcaagaagtcacttggcaattgaaatccgaatgagcctgtaaaaagggacttcagaaatatgtcttagatgcaataataatgtccatggtatttgacttatcaattccaatttgatggctatgttctacctaagtactccaagttggagtgcagtgctgcggctcactgcaacctccatctcccaggttcaagcgattcttgtgacacagcctcccaagtaactgggattacagtgtgtaccatcacacccaactaatttttaatttttaatttttttttttttttgtattttaagtagagacaggaattcatcatattggccaggctggcttcaaactcttggcctcaggtgatccgcctgccttggcctcccaaagtgctgggattacaggcatgagccaccgcacacagtgtcttccaacagtaatttttaaaatggccaaagattagcagcatcagcatcatttggaaacttgttagaaatgcaaattcttggggctcccccaagacttactaaatcagaaactctgagggtagggcccagcctcctgtgttttaataagtcctccaggtgtttcatacatgtcctgaagtttgaaaatcactttaaaacaatatataggaagggattcagtgtaccaacaacgcaattcaaaatcatttgcatgtctgatcatgaaagcatattagcagtcaggtgctaaaaatgatcattttgaagacttctatgtattgttggaaggaaatgcttaagacgtcattgtaagtgaaaaaaagaggcttttaaattatatttacatataaaatagctctgtgtagaaatgattaggataaagacaaagaaaatgggaataatagaaaatagtttttatttgtcaaggacacagaattatgagtgtgtgattttttttctgttcttcaaatttctgatgatcattttaaaaatatgaactctttaaggtaaaccagcaaacagatacagttaaaaatttgagaataaattaaaagccctttgaaagttgtcaggttaattagcagactgctcatttgaatcgcccttttgctgagcttcctatcttccggaaaatggtggggaggttttttggagtcatggtattatttagactacagagaatttttgcatattgttgtgaacttatagcatatttttcgttagatgaagctgtcttcctttactattttctctctccattttggaaattgatattgtttaggattagcacctggaaatatgcaaatgtttatctactgtctggataatatgccttgtctttccttatctttgcagaccctatcagtgatctacgtactcagttttttctctactaatcattacaattttaaccatttggtgttccattcctttagggctcagtttttagtgagaggaaaataacctaatatgataaacttatctgtgctaatttatgaaatggatgcagacagccccagtgaatagaacatctatgtgataaggtctttacacttaactaagctgctctaatgttctgataataaaaatttctgacaaagtagcagccagtggggtcacatgttgtgaggtagataacattttgtgctacttggtttgctcactaatgtaatgaatacttttttacttaattgcaatttatcactaccctaatattgtaccttagggttgttcaaagtgtgttcccaagaataatagttccagaagatgttcaaaaatattatttgtaaagaaaaattaacatggttaagagttgaaacaggtttctttaattgctcttatttactgataattgcctttgttagcctgtatcagaacacttgatatatctcattataacctcccaaactcgtgtggaaaatgttgttgccatttccattttacagatggggaaactgagacactgaggttgagtaacttctcaaagttctaaggtaataagcattggaagtgggcactaaaccctggcagcttaactcctaaatttacactttttaccactaagcagtattgatcactttacctggaatttcttggatgattcaatatactaatgtgatctgcaagctcctagagggaaatatattgttcagcattttccaaatgtatttaaccatagaaatagtctccctcccacctttttatcccccagagcatcttcctgtgctaggaggtcatagaaacatagtttgagaaagacattgtcaattgaagcaaatggaataatttgtaacgtagaatttatattgaaagttgtccacatcttgccacaattaaatctcatatatttttaaggtattaaggaatatttaatttgttttcatttttaccttcaaattccatttggaaatgattttcaaggacatgactggaaaacctttaaagaaaagacagctacaatttaataaggatcgtttgttccaggcattttaccagctgctttatgtttatatttatatcacaggattctttctaaaccatacaacttggaaattgtttttatctttttattacaggtgaaaaaataaagtcttagagaagttcttaagtaagtagtaaaataagtaaaagtcaaagccgtgacttgccaaacctataacacattccactccaagctgccacctgtgcatgtccattaaatgcaaatatcttattcaaaaggctattcctctataaataatccataccttttataatatatttcatgctcaaccacagtaaagtatttttacacaatttttactttaaaagtattcagaatacaaagggcattcaattgcataatcaatagtgcctaatataaagatatatatttgcctgactatattatgacaggataaaaagtatgataatatttttgttactgtatgatggacactgtataaaattctttatgtggtctatctccttaataggcaaaattaactagaattctataataagacatattgctatctgtcctgatatcttttcaatagaaatcagaagataattctcccatattgccagtatagtcttgttgagtcttctcttgctaattgtagttattttttaagtagactggtattacgtcaagacattttcatagcagaacttcacagttggataaaataatatgaaattccatactgatgctccagtggcttaagggtatttttctagtttaagaaatatgagtacttgaggggcctaaagaaaagacaatgaataatttaattggaagtcagcaaagggatttgaaatgttatggcgttacttcctttgtactacttttaaattaaatcatcacagatcaatagaaaggtcacacacattgttattgactctgtgtaatttcttccttagcataaaaattcttcaggattatgcctgtgtggtaaaaatcaactctctgaaacaaaccaagcaagagaggcaccaaagctctgttgctatagcaactgaacttggcaatgtcttctgggacttgctctaaggaaaggtccatgatagtgggtgatattacgttcttttttgctcttatggcacatactgatttactgtgagtaaaaagtagcatggttcaaatttcatatttttcctagtgatgaaaaatgggctgttgtgtgaaaatgtaaaggagttttaaacaactagcaaagaagttaaaacctccatttatccttagtggaaatgctgcagaagcagccattactcagcagctgaaagtcaacaattcatttaaaaaaatacacatacacacacacacacacacacacacacacacacacgtcatctaatttagcaatgtatgagaatagtggatgccattttaaaattatattaatgcctagatttgtttctagggggaaaatatggccgtgtttgcttctgatgtatataaaatctcagacatttatagtgctctaagccatagtaagagaaatatgagtgctatcaatacatgaatatttccaaactcagttctcccaactgcctcaaaactaaacactaattcaggaaatgcaagcaataacatttaaaatgtgttcaaatgcttttagcttttaattcttttatgtttttgcttcactaaagacactctcatttgttttgtcatccattgatgtaatttacactttggtaaaacatatctcaaaggactttgcagatattgataaatactcttaacctatagtctctaagataggcatatgttttagataaatgcaatataagtaataactaaccattgctgtaaataattcagctaatgtgtttttttctgagagttatcctttttttaagattttttaaaaaaattttaaaaattcaaagcaaactgtcaagaattgcaccctgaaactacatccatttgacaccactttttttaaaaaagcaagaaagacggccgggcacggcggatcatgcctgtaatcccagcactttgggaggccgaggcgggcggatcacgaggtcaggagatcgagaccatcctggctaacatggtgaaaccccgtctctactaaaaatacaaaaaattagccgagcgttgtggcaggcgactgtagtccccgctactccggaggctgagtcaggagaatggcgtgagcccgggagacggagcttgcagtgagtggggagatctcgccgctgcactccagcctggatgacagagcaagactccgtctcaaaaaaaaaaaaaaaaaaagaacaaaaaagcagaaagacaatgaaatttggtatttattacaataattaaaagtaaagacaaaatccgcaaatacttttgcaccaaccgaataatacatctgggcagttttctatattctaatttaagttagagagctcatttcttcttccactgacattaaatgtgaaaaacaataaataaatagaagctcaaaaccaaaaattattcttcattaaaaacttaccactattggccatttagcaatgagtagatttttcaatagtgtctaccttcacttgacctaataagcattcttactcatctccaactcagttagcaaggtttaccatggctttaaattgtgcaatacacatgctaccttacttcagtttgaataattttcttttgccattatgctgtatctagaatcaatgtacaattgctttttcattggccacaaatcatattaaggaagcattgaaaagtcaaatgacgtcattgaaaaactgcacagcttctataatctgcattcccgatttctgcattgctatgaccttcctgccattaagataaatttgttccatatatgtgtattttatatctagtgatgttgtgtgtgtgtatatatgtatgtatatatagtgtatgtgtatattatacagatagacacacacctccatacacatacaaaaaatatatacagaaatatatgtgtgtatagtgaaaagcaacaatatagtagagagttgaaccggtccactgatttgacattttaactgattttaacagggatctcaggttgatttttctacaactgaaattgaaatcccaagtcaaaaattttgtggaaaaatacacctttttatcctatatttctatatacatatactgcattaggccattactgcattgctataaagaaatacctgagattggccgggggcagtggctcatgcctgtaatcccagcactttgggaggccaaggcgggcggctcatgagatcaggagattgagaccatcctggctaacactgtgaaaccctgtctctactaaaattacaaaaaattagcctggcgtggtggcaggcacctgtagtcccagctacttgggaggctgagacaggagaatggcgtgaacccaggaggcagagcttgcagtgtgccgagatcgtgccactgcactccagcctgggtgacagagtgagactctgtcaaaaaaaaaaaaagaaaagacagacctgagattgagtaattataaagaatataggtttaattggctcctggttctgcaggctgtacagaaagcagcatctgcttctcaggaggcctcaggaagtttctatacacggtggaagaaaaagagggagcaggtacttcacacggtgaaagtaggaacaagagagagtgggaggggaggtgccacacactttaaaatgaccaaatctgtgaactcactcagtgcgagagctcacttatcaccaaagggatggcccaagccattcatgaggtatctgccctcatcatccaaacacctcccaccatgccccaccttcaacattgcggattacatttcaacatgagacatgggtaggagacaaatatctaaactgtatcatatactatttaatactcaccaaatgctttctgtgtatctgttgtctaagtgctttcctcggattcttttttttttttttcaaccctcacaactctttgaggtaggcactgttgttatcctcatagtaacaataaggaaattaagtgttagagagcaaattgcttgtcagagattacacagtaagtgtcaaagcctttatttgaatttaatgtatctgatttcagagcccacggttttaattatatgctattcattccatttcagaccatatagacatttggcatgtcattttgtaagtattactgttcaacttttaaaatccattagtaatttacctatactcaatgcatagctcctagtttgcttattcctttgcctatgtgctttggcaaaacaaggaatttaacagccaattcctattctagagtcaaaaaacaaaaaagcacccaggaaacagaatcttacaaaacagcctcaataacaacaacaacataaactagaaaacccaacaaaaatagttcagtatagttatttattttcttttctttgcttgaaaagtcttccagaaacaaaaatttattctaggaatgaagaaactaaggaacatttacaatttactacaattataaacttatatttatggcctttggtcagttaagattaaatcctcttaatttcaataggtatggaaggattttctgagcatgctatggtatggcagagagatgaatttgcattttgtatcattttttacttttattaaagggtctaaactaaacatatgaccaagtgcaaactgaaaacgttggcatagcaactaatgctttgaaagcaagtttcctaaaattgtcaagtaatttttacataacattttttcttaactgtttttgtcttgtttcttgatagcagtacagatatctttcttttatattgtttgtaaagtactttcattttatacattatctcattttagcttaattattactgtatgacaaaaatgagtgtgattgttaatttataaaacttatcgatgaagaaactgcagctaatagaaatttagtaattttcctaaagtaatcctgttagtgattgatccaggttaaattatattatgaaaatttatatctaaattttatatgatttaaacttcacacagcaaaatttccttttgaagtttttttttaaaaaactttgtataaatgaaaatagttcttcactgtgtttttgattttggcattgttttccttaaattacaaagcaaacaatacatagtaatgtctactcgcaatgtttgtaagatttttcttttaactttctgtagacatcctgacaaggatatttctttgtttatatgttctatactgatatgtgaatgattttttttgcaaaggggaaagaaatgaaataattatgcataatgtgttgtgttcttgaataactgatgagtcttctagctgccaaagaaaaaaacctgtgaaataactgtcatataaattgtctatagttctcccatgggttcaagttgcataaataggatgtagctggattcagtaagaaatatgctttgcaagtgtggccattttgagtttgtattgaacatagtcaagcatggtggaaatgctgctgttacaagattcactatgataaattaggattcatttatttagtgctatctttttcataaacttagtgagttaagtttctacatgactggtcattttagagcttgtcttgcatttccctttaatacttgacattttgaatttcaccacctcagtaaaaacgcataatcttggtcctggacccagcaggcacctccttcatctaaacggccagtccttccattgcaagaggtttactgattcacatcaacttttagttcactgaaatggtgtattaacattttcatttgaaggctgggtgtacagtgtttcatgatatagtctgccatcttgttagaagcagaataagatcttaaggagctctttatgtaggttttgggaggaacagtgtgtgaaaatttgggtttacatgttgtcctaggaatatatcattcaattttctttataaagaaattccagatgttactaaaacaacaacaacaaagcaaaatgacaacaaaagccctggcaaggtatttaatggcattttgtctatttctttaaacaaacaccagcaataagaaatcactacatcaaggtgttattcatctcccaattgtagctttcttttacatcactatctcttttacacaccagcttttcatgccaacttctaatctcccagcactacactcacagcttgcccttcaaacactcttgccaattatggaaaactgccttctctctaggccagagtacttgatgatctagtttatgttataggcaagttttatgggaccacaaactccgtgggaacaaattatttgagacatcaccttgtaatgggctttctgaccttttgttgttgttgctaaaccaaactatccaatgttttattatttccttttctcagaaactcataccttggttcacagtctctaactttcactcccaacatagttcatttgtcatatttttcctaaagtctggcttcatagactatggaggaatgcagagaaaatgaatagtctttctaagatctcatttaaaggcagataaaaggcaggcctgatttcaaatttgtcttctagcttttgtattaggcataaggtctctaagaatttcattccagaaccatgacatgcagacaaagtaacacattaatttgtcatcatctaccaatgataacattcatgctaatgttactcagtcctggactctattttgataatcatgctaagatcttaaggaactccttatgttcctaatgaggtccagggttaatagaaaaagtatggaaactcatatggcagacagttttattcacatcacattgcctgtccacctggtaggacttaacctaaggtggtctttagcgttgcccaaggaggcactttgaaccacaggatatgtgtcacaaaactcccctcccagggtgatatttacaaaacaccttatacctcctactattcctctaacaacctatagccaacatgacaggcaggtaggggcatgcattccaaggagcagagcaaggaataacatgtccaaccttgaagaatttatttatctcctgtatttccccaacatcttgtaacaaaaataaatccaccaataagtactgaaagaattccaggtgaacctgaatgttaattgacatcttggcaccagtgacatgaacaggcttttccctcatgtacagcactcatagatctgatagataacatgtatacatatatcaactagaggaaaagtgaagatgaaatattctaaagataaaagagaaagtagccttaaataaattttaaaaattacagctataatactatctaatcatgggaggggaaacagttttcccaaagatgacttgactttgtcatcctgatgcttagtcagagaatctgaaacatatcctttgattcctattgaaagcctttcaacaaattacctttcagataaactgtctccttgtgagtttggaatctctaattttgagttaatctctctaattgtgagcttaagatgctacataaattacattttttaattacaaccaaagaaagtggtagagtagaaaagagtgtctcctgtgtcatgtaactttctgagggtaaatattaggttggtgcaaaagtaattgcggtttttgccatggaaatgaatggtaggcatggaatattatgcagccagataaaaggaatgtggtcatatcctttgcagggacatggatgaaactggaagccatcatcctcagcaaactaacacaggaacagaaaaccaaacaccgcatgttctcactcataagtaggagttgaacaatgaaaacatatggacaagggcaggggaacaacacacactggggcctgtgggagtaggggaggtgaggtgaggaagagcatcagaacagatagctaatgcatgcagggtttaaaacctaggtgacagcttgataggtgcagcaaaataccatggcacacgtatacctatgtaacaaacctgcactttctgcacagctaccctggaacttacataaagtttaaataaacaaataaataaatagcaatggtagggccattactttcataatacagtggtagggcctagacaggaagcaaggggccaacacacgtgagttgagagggaactcagaacaatatagtaggatattcccccaaagtagaaagttttacactgaaattaaacgtttcacttacttaacaattttctctaggactttattacacattctctggagtctgatatgtttctcttgtagaattgagacacagacttgatatctgtcatcttcagcaaaaaatatttccttacaggtattttttattctggaacaggagactaaaaccccagaagagagataattctaacatacatattttaaactgccaacagccaacgtagcctgtgattctcaaagtatatatgtctcaaatatcatttaatgtggattactatgcaatgaaacttcactatatgaaaatatggaaatagttattctcattgtcgttcaaaaagcttttctttagtcttgtcacaaaggatcacagtttgcatttttaggtggcgttcatgtacctttcttcattgaagacggagagcattttatgaacttcatatcttcttgtttcagtagggtcttcatggttgtgactatatctccacagccaaagcaaagcagacatttaaggtaattacttagataattagtgggcaaatctccactttgctttcactgtggtgccttggccttcaatcagttgagggaagttgggcactcagaagttaatattttacttttttttttttcatgaggtactaaaacactgtttcttcttttgtttttcccatgatacttttgaaaaatggcaatctcagatctattgtgggtggctagaagacagtaacctagtaatacaatatttgttattttgttagtgtaattcttgtgctccaggaatgttgagcttattgttaaaaattgcttgtatgaacctgggttttagcttctgtatgcaatatcatcttggcctttgctttcaaatatttggaacaatacatttatagaataaaaaatgaaacaccatataatttcagaatgtctcaattctactcccatttgtagtttaatgcaaaaggaacctcatggacctccaccacatcttttgctcctgacaccataccaaacttccagatgtatcagtcatgttttaacacttcagtatgatgaaagttagagaggatggaaatggaatgggacttgattttgaggtactgaggttgcattgcacataggaaaactggctcatttttagtttttaaatattaataattatatctagaaagcacagcttacttaagtcttgtctgttatacataaatgcaaaataattataagagaaaccccatattataaattctacttaaaactagatgaacatatcttgaaactacattatgagaatttttagatttctaaaagagcacagttaaatgtatttccttaaccatcatttattctatcattcattcactacatacaagagggtgtgctatttgaaagaactgttagaaagcttgaggatttaatttctttgtagcttctgtttcctggtaaagataatgcttaataatgtaaatattggtcatatactattaattattctgacagttcaatataatttaatttattatccccattaataattgacagagacaggatgtgagtttctgaaaatctacttctaaaattccttcaacagacgtgcaaatgtgtcatacaagatacaagtataactcagttgtgtggcagaaacaccagacataacttttcttggagctgttgaaaggcattgtatagacttatgaagcaagttacttgtaaatgaacatgaaacctaagtctgtggagctaatctgaccatgacagccctgacccccatttatcaccaaagtcgattgaacccctctgcctggctggtgttaagtttcccctttcactatccaggtgtcacttggttcaagaggaagatgttggcggacaggttttcttcaaataatatgagtacctctgttattttcactacttaaattgccacaattctccttgcatcttataaaagtattgttttttggtttttgttttttgttttacttttcatcagtatcttttaaaggggtgtgtgtattggactagagagatggtgtggcattttctaaaaaccctaggaataattcttattttggaataaattttttttaaaaatcgctgaagttagtatgatttccataggcatcatggattttatgttggaggtttgtaatggagtttgtgtgatagttttttgaaggcagttcaggtctccatttggaggggctaaaaatcatgcagagttctcttctttccttttctctgccttccgtcttttcccagagatgagtagaaggagggaggataatttgctaagttttggcagtggtatccccattttgatttgtttttctttctaaatgcatatatagaatgacagcattggcattatcctacttaaagtttaaatgcagtaaaatcaagagcaaagcatgcttcctgcatttctcacaccctgcaatgcccaaagaaataatctggagctgagctacaccagtgggctctttttcagtcctagaataaagagaggggcctttagtggatatagccctttctagggtcatctctccttccactcttgaactcaggaagttccagtagagtgctaagaggttcaggctttatcataccttggcacctagggctgaaacacctggagaccagcagaggctacatagtgccaatctcataattctttctcctcctagaggctgcagtcttctgtctgtggtcgcggttcattttcccagtattccccagagtaacttcagtcctctggctcttctgacttttggtaaggaggcttgccaagctgtcttcattcctgaatctcattacctacatctgggcccggttttccctgcctaatttcaagcacttttccaaggatgggacttatgctccagtcatctttgctctttatgtccaatgtcacacctcaatctttttttttttttttttttttgagacagagtctcgctctgttgcccagtcttgagtgcagtggtgtgatctcggctcactgcaagctccgcctcccggattcacgccattctcctgcctcagcctcccgagtaggtgggactgcaggcgcccgccaccatgcccggctaatattttgtatttttagtagagacggggtttcaccgtgtcacacctcagtcttaatctctcctctttagaacaccgtcaagtcttccaagatctttgcagggctggaattggcactctccttggggcttatttgctatgaaatgttttctctctgaagcaagatggccctttctacttgtttttgtttgcatttctcagatcagtttctttcacttgatcatcatttcaacatgatctccttcctgacctcgcttccacagcaggttataaaaaaggtgacaaacaccattttaagcatttagattccagcaattttcacatagccagaggctagtgagggaggcatcgatatatgtaatgtgcttcccacctggcatgcacttcctagacattcccagttaaatacatcagagctccgttttaattttatgtgcaattttattttattttgaaacagagtttcgctcttgttgcccaggctggagtacaatggcacaatctcggctcactgcaacctccgcctcccgggttcaagcaattcccctgtctcagcctcccaagtagctgagattacaggagcatgccaccacacccggctaatttttgtatttttagtggagatggggtttcaccatgttggtcaggctgttctcgaactcctgacctcaggtgatcggcccgcctcagcctcccaaagtcctgggattacaggcatgagccactgcgcctggccttttgtgcaattttatgttcagtgatctccaaatttatttattctgttacaagtatttctctaaaataacccagagctctctcaacttactaggtgttagagctactacaaatgacttatcttcgaacatgatctctttctgattttcttaaagtgaagggctttctaaacaagacctatgtttcatgaaaatgtggttagtatgacattttaaacaaggcattttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtacatttcttctggttaaatttggggttgaagttgccagtagagtttacctatcgtgattttttttttttctgttaatctggatttcaagagtcaagaaaggatatctgcagaaagtcatgtctgagatgagactcaaagaataagcacatgttggctaaacaaagtagaagtgaaagtgtttcaaccagaatcagaaagaaaggagacagcatacaaaaaggcccagaagtaacagaggaggagatgaggggaagagagagagagagagagacctcatcagaactgtagaagtgcagccttgagagttgaggacaaaaggaggagtgggcaacgagaggctggtgtagcaagggagacatgatgccaggcagacacacagagccagctcatggagagctacctgtatgatgagagctttggctttctcctgaaggcaataagaagattctaaataatttttagacgaggagaaacatgagtagattgcattttaaatcattcaggctgtagtgcagataatgaattgaaaaggtataaagttggaggacgagcattccaccgttttggcttggagagtgtggaggtcaagagggtggcagctcattctggggacctacctcttgaaattccaggtatatatattattatctactgtgtgaggctatcttgtgtcttggttatttaaaattgaaacaccgttaagtttatctttgtcctgcaaacgataacagaaaagcaacatgttgattttggcttattctgatacatctgcctggcatggaggaattggtcgggtttcaaaatgtcagaatttctgcttgttaatgagtggtttctttggtgagaattttatgtagaataaaattgtgggctactcacagaaactaaaagagaatgatgggaaatagtcttttaacattttaccactgtaatgagtttttgtttgtttgtttgttatttaaaaaaaaaacctccaggtaatatcaattgacaagagtcaaataaattaataaaaagcacagactagtgctcctatcaacaagtttttagaaatttgttaccctaagctcttattctccagatgttattcagattctcagttccaggtctgcctagtaatttagtacatggcttgtttagcatagaagaactgtaaaaaatatagagctctgcccacaataagcctttcatagagactaagacattatattaaaactgttccttgggccaagatccttccagagcattctttggccatttacaaatttctttacatgagttcattacaaatatacccagaaagcattgattccagatgtacggctgagttaagagttttgggtacgcgttaacacaatttatttaccttgtattgtgcctgttgattttcagtagcagagagtaagtacctactatgtgcctggaactggtgtcatgaattgagcagtgaacaaaatagtcaggtttttatgttctgggagtgggaagacaggaataaatacaaagaccaagggggccagatataactgttttaggctttgtggggtgtatggtttctgttacaactactcacttctattgttttagcaatgaatttgcgtggtggctgtgttccaataacactgtacttacaaaaataggtatgggccagatttgttctataaaccatatagtttgctgacccctgacattgatcactaaataaggaagttcatcttatctactaataagaaagaaaatagaacaggataatatggaaggcagtagttgtggcagcttcggccagagtgattgggcaagagttttttgtgattgagttaaatcagtgtccgagtgattaaagagcaagttgtcaatatcatctatttatcatctatttacctttctgttaaaattttatataaagctaagaaaattaagttacatattatacatttataggaggtaggaaccatatagaacatgctgacatgtacctggactcaacaattgttgccctgtagttgaagagagtttcagaaaatatctttctcaaaagttccagccttctttaattcatactttcctctgaatttctatggcatttattaaatgatgagattcacttagccttgagaaaatgtaacattggttagtgtatgttttttgtatgctgacctgaagtgtgtggacagtgttatatgttagtttctaaactggcctctcagcttggcattcttctgtagctggcatgtcataactattgaattaccattttatgaggatcaggaaagttaaaagagagtgcagctaggagtccaacaggaggtggctcagattgataatttgctttcacaatgcataaaaacttcctatatggaaaacattagctgaaggaaaaggagaggcgtacttgtgaatctcaagtgatctctctaagatttgtaagacgagttgttttatgtgtactgtagttgttgttaaatcctaagccatacaacaaattaaagagtacaagtttatcaacaatactctgtgccatttggctcccttggttgatgcatgtggaataatctgtcagacaataggcattacctcttgtatataaggaactggatagaagccatggcttcagacctcaacgatcagtttaagaaagactcaagagttaattacacaaataaaataagacaaaatgaaaagttccatgaagcagcattatttagagtacatattcattcaacaaaattttgctgagtacttataatgagctgggtatttttctagacactgatgaattgtgacaagtaggatcaatatgatatagatttatctggaaagctttcaaagagaaggtagaaattcaccagtgtcctgagaagtatgtgggattttaatttgagagcaccattttaaagggtaagcatggcagaggaataggaagaactcaagggctcttcaaacaatgaatacagttagtttgattggagattatgtagagaattccagcaggaataatgtaagaaaggtaggttgggggcaattgttggagggccttgataaatccaaaaactttggcattttaacctgaaggcattacacggcaattggagatactgagcaatagcatggtacattgaagtttaagccaattaatctggcagaggtttgtatatacaattgtaggtggagcagaaagaaaccaaaggcaattctgccaattaggaggctatttcagttgttcatatgctatgtgcattcacaaaaatggtagagagaatgggaaaatgatgaacaatgttagtggtattttgggggtagacttaattggctattaatggaatagagggaagaggcgaagaagaaactagaattttgaaaataatgatttcttaaaacaaattactcctcccctagaaaaaaatttagttgaaaagtaatctttccagcttaaaagagttttctcaggtcaaatgattctgctgtccacttgctatataaccttgatcaagttatttaaaatctctgtgactcatctataatgtgaattataatgctactcatttttagagggctgattattcattcagccgatattccataaattattttctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatacggttcaggaggggttactttgggtaaagcttgaagagatggcctctccaaggaagtgatatttgaagtgagatgtaaataatgagaaggagccaggcttgcgaagagcgggaaaagcagtttagaggtaacaggaagagcaagtgcaaaagttggcttatttgaggagcagtatagcagattttttaggaaatgcacacctacaaatgtaatacttaattgtcagtctgtaggtagaaatcatcgcagatttaaaagggtcacatgccctctagtgtcctctatgccttatttaatcctgttaataggcttttccaagtgccatgaagaatgttgaaactgtgtatgtgtgcatttgttctgtgaaatgcattaatatttctttatgtaggaaacagaattctgagaaggcagcttctgttgaagggggatatatttatttatttttgtaaatgagaaggaatggaaacagaggggaacaagaagtgttctgttgaaagggatgacttgcatattttagtttggtctgttcattcttacataaactagggcaaaacaatgatcccattaagttttttgtttttttttttttctcttcagtgtttttcttttttgggtttaaaataaaggaaaaaaaatagaatcagggaatactttgattctgttgtgtgggttgaaattctatctctccacccacaaaaaaattctgaaaaatgggtcttggaatttttttcttcatgagtcctagtcatcgccctcattttgtgcccatctccctagttttggagatgatggagagacaatagagaatagagtgaaaatgtggggatggtgcccacctccacacctatgtctgagttcttgtttgttctgtagccatattggtcttcccttctttcaacacagtgtgttgtttcttgttcaagggccttttgaaatacaatgcctcagctgggcgtggtggctcacgcctgtaatcccagcactttgggaggccaaggcaggcacatcacttgaggtcaggagatccagaccagtctggccaacatggtgaaaccccatctctactaaaaatataaaaattagtcaggtgtggtggcatgcacctgtaatcccagctacttgggaggctgagacaggaaaattgcttgaacctgggaggtggaggttgctgtaagccaagatcgtgccactgcagtccagcctgggcaacaaagagtgaaactccgtgtcaaaaaacaaaaaacaaaaaaaaaaccaaacaaacaaaaagaaagcattacagtaactctttctggaatgtacctcctttctctatccattttctaacatctcattttaattttttttagtggttactcccaatgtcctgtcctacaaccaaccaaccttcctccccaaattaggccactgttagattaggtctcccttttaagggatactgatcccaagcaccctgtaattttctttcatgacattcatgatgtcataatctttgctgtgttttcttccattctttacgcttttgaccttaagagttgactcggagttgattgttgctctcttcccagtgtggtgtactctctagtacattgcgtagtatatacgagttgcttaatatttatttatcaaatgaattgagctaaaacaaacaggtactgtttagacataatacaggattttgggaagttggggaactctgaaaaatagaaaagtaatttcactagctagggttgagattagctatgagggctggacgtggctcatgcctgtaatccaagcactttggaaggctgaggcaggtggatcacgaggtcaggagatcgagaccatcctggccaacatggagaaaccccgtctctactaaaaatacaaaaatcagccagacgtggcggcatgcacttgtagtcccagctactcagaagccagaggcaggagaattgcttgaacctgggaggcagaggctgcagtgagccgaaatcgtgccactgcactccagcctgggcaacagagcagaaccaccttggaccatatgtgtctgagacctaccactgtctctctttctgggcaacagagcaagactctgtctcaaaaaaaaaaaaaaaaaaagattgtaagatttttctattagtagcagaaaccaatcaagcagtagttacttaaagaaggtaaaagattgcttcttcatcataaaattccagagtggtttgatgactctgctccttgaagtccccacagactcagttactccagctcaatactttgccatcactggtggtaggtctcagacacatatggtccaaggtggttctgtgtctcaggcaaaaaaatggagaaaaagatggcttttataaggaatagaatgtttttctgatgaaatgtattgatttggaaacagcttaatcctagattcaggattaaattcaatcagccttctatgtctgtaaatttcaaaaagtatgataaagtaaatgtggttcataaattttaaaaagataatcacagcatcttgaccatttacaaagcaaagcattctgaattagggcatttgacctcataacatccccccagactagatagattaagaggtgagaacctgagaaaaaaagcagatcagagtagaggcagacaatttgcttaattactgcagcaaaaccggaagttgcagagtggcagagtctgctgtcctttggcaaacaagggacagcccacacacactacagacatcctgtggtccacactctatggtcacttagcaaccaagaggagatttctttgtattctgagctattcactgaggtggggatggggggtctcctagaaggcccttcagaactaggccacgtggagagttagattaaatgaaactcaagggtattatggcttttctcacagaatatctatttcctgacatgttcccgcctctgctactgaagcaggtcatgtatgagtgcagctgccactcagcctgattcagacttttcattcacaggtttaattaaaatttctagcaagcaccatctatcatttctcttttgtaatttttctctctgagagaaacaagttcagtgctcatgatctcttgcatggttatggtgcctttctttctataggaagagattagtaacctctttaacaacttatagattttcactgggaaccttgattgaaagaaaatcataattgttagtctgtgtttggagctaaagataatgtgggtaaactccctgaggtttattatggtactcggtgtaacacattataaggtccaaaaaatattatattttttggaattgttttttatgatactgtaatgtaacaaagcagttcccctctaggactgtctagatccctgggtcttgtgcttataaaaattgggattcataggctaatttcagtgttttagaaagacaatggaacttgaacctttaccaatggctatgttgcatggactcaccagataccatgctttcggccaaattaatataaaaattgtttctttatactaatcagttgatggtctgcatttcatgtatatgttttttattagttaaaatggggaccaagttatttactaatgaataacatttgctgataaagtctttcagcactgtgtgtgtgaaaaataatgcaaatattggaaggaattgtaagatggaaccctggtactgactgttttgtcactttgagtaagttatgcaactattgtgggaatgaattccctcatctatataaaggggattaatagtattaattagacagatttgttgtgagagctagagaggacagcctcttaatgatggagagttatcatcagcaacagaagcagtagtagcatcattatcattatttttctttcgaaaccagaagtttaaaagaaaaataaagttaaggggttccttagttgtgaaccaattggaaagtactgtgttttttctttctttttcaacttttattttagaatcagagagtatatgtgtaggtttgttacaaagctatattgcccagtgctgaggttggggtatgacttgaacccatcatccaggtagtaagcatagtatccaacagggagtttttcagctcttgcccccacatccttttcccctctagtagtccccagtgtctattggtctcatctttatgtccacatgtacccagaatttagctctcccttataagtgagaaaatacagtacgttgttttctattcctgtgttagttaggttagggtaatggcctccagctgcatccatgttgctgcaaaaaaaaaaaaaaataataataataatgtgattttgttcttttttttttttttttttggccgtatagtgtctacgtaccatggtatatatgtaccatattttctttatccaatctacaactgatggccacctaggttgattccacgtctttgctcttgtgaatagtgctgcaatgaacatacacatgcatgtgttcctttggtagaatgatttattttcctttaggtacatacccagtcttgggattgctgggtcaaatagtggttcaattcttagttcattgagaaatctccaaactggtctttacagaggctggactaatttacatacctcaccaacagtgtgtaaatgtccccttttctctgcaggcttgccaacgtccttttctttttgacataacaaagccattctgactggtacaagatagcatctcattgtggctttgatttgtatttctctgatgattagtgatgatgagcattttttcatgtttgttagccattgtttgtcttcttttgagaggtgtctattcatgtcttttgttcactttttaatggggctatttgttttttgcctgttgaattctttaagttctttatagattctggatatcacacttttatcagaggcataacttgtgaatgttttctcccattctgtagcatgtctgtttacttccttgatagtttctcttctttcgtagaagctctttagtttaatttggttccacttatcaattttcgcttttattgcaatgctcttgaggacttagccataatttctttgcaaaggctccttatgacttgccatatgcttttcgttcctgttaccccactccccaggccaagttttccagtgacttttgaagtagtttgtacaactgcatagggcctcactctggccctttaaggatcccacttacttactttttttgagttagcacccctttgggaggaggggaaattcttcctttgccatttgtgagtttttactccaatccccatgtcaagaaggatatttcctaggttttcttgtaggatttttacagtttgagacatatttaagtctttaatccaccttgggtgtttttttgtatatgtgtaaggaaggagtccagtttcgttcttctgtgtatgcttagccagccatccaagcagcgtttattgaattagcgtcttttccccattgcttacttttggcaagtttgtcaaagatcagttgattgtgcgtgtgtggctttatttctgtgttctctcttctgttccattggtctatagttctgtttctgtaccaggaccatgctgttttggttactgtagccttgtagtatagtttgaagttgggtaatatggttcctctggcattgttctttttgcttaggattgctttggctatttggactcattttggtttcatatgaatttcagctttttctatgtgtgtgaaaaatgattggtagtttgataggaatagtgttgaatctgtaaatgggaagcagtgctgaatgaagtcaagactcaactgattctgtgtttgtattttctgttataaactatcttgggaaagtaatgatatcatttaagggttctgtgtcttcaactatgagaaggaaagctttggattgatgatagtaagttactagtaaagttaactaaagttcaaggtactttctaggtcagatagttcatattccttaccatataccaacctccccaggtctgctacacatagtattgtttggcaaggcatgaatcttctgtgactctaaatttcattatctgtagaatggatatagaaataactgccttccaggtgattatacgttaagagcctggcatataatagtcattgctcacaatgtaaatggtagctgctcactcagcctttccccacaagcaaggtttcataggttttttaccatcctatgcacatttattgtatatgctccaagatgactatgtcgttcctccaatatgagcctcagaatcaaacccagtcctacaaatatgttctcataagtagcctaaatcctctgtgtatcttccctcttctattcctatgtagaggcattcactttcatttctgagacatttctcctgtctctctttctacctggtttccccaactcattgttgcttttaactataagatctgaggtcatggtttagattcatttgaagaccactttgcgtcttctggcatggctacagaaggttccagtaaacctgacacaggcaatcctgtggttaaattgcaaggacaccttcagtcttagaggacaaaaagaggaaaagggatagcaaaaattccagtgttcctccatcacactcgacatattccaaatgtagagattctgaatgccaagaacagcttgtttggtctgtgtgagtcgtggatgttttgtcatctaagcccgatgtactctcccacactttgcatcattactgagggataaaaaacaaaaacaaaaatccccccatagcactcagaaagtgcatctttatagtccgcatggaaaaagaaggtcagtggcacaaagcatttgatgccctaccacctcctcttttttccattcatcctgggtgaaggaagagtgtgtcttttctcccactcctacctagcctgtctgattcactctgttgcattgtcctcattggaaactgctttcctggactcttgacacattcttactgtatcagagctgtgcttaaccaggaagtgccagatggtactgaatcactggctgcttaatattcaagaacaatattacatacagaacagaataatgtatgtgttgattaaaggactttgctgatgtcttgggaatcaggaaatgcccttgtcacctccacagctgtgccttgacaatttatgcagattacaagttttgtgggggactctttgctaagcatgtttctaccttttttttaaactatatcttcagcacttggttttttgctctaagctgcttgccattcaaagtcctagatatatgctactttcgttgaaaagattgttttctagtgtcctcttccttgtcgctctcttcaggattataagtctataagggagtataggacaaaaactgtaaacatagatagctgtacttttttcggggaactggcataattctggaagatgtcaacatattggcacattcaggaattaccttcatgatgctatggactgtgagtaatatgtagttatctgaaacagtttctgaacatgaaaggatataataaattcaaggcatacttcttggataaatccttctaaaagacttagttttctaaggggagttttggttaaaatccaaagcaaaccaagcagagaactacccttttattgttctatctgtccacaaacagattctgcttctgcggtatccacctcagaatagcttaaaatgttcttaattatgtcccttagttctgttaaaacaatcacaaagcttaccaggcttttatttttgaaaatagatttacatttacatgagttggataaaaaaaaattgtgaaaatgaacttcatccgagctgtcaccatcaatctttattatttttgaaaacaattggccagatagaaaaactggtaaaaattactgagaatgtcttgaagtgggtttttgaagattaaccaataagatcagctgcatatctcattacctaacaagtcctcctatgtccattaatctacttatgtatggatagataagcgtttatccacttattcatgcagaaagaacttatcactgtccactatgcaaggactggttttcagtaatagtaatataggatagtattagtaataagtcatatctcaagacgtgtcttgaacaatttgctgaatttctagaagataatcggcaatgtagtacagaaatgattgtaattgtatctaccgtttacttctatgaatgttggccttgtgtggaaatagacaaaaatagatacctgtctctgacaatgaagttacaaaattgaccacaaaagtagatgcaaatgggtaggacattgtcagtgttggtgagtgcaaacttgtatctccttcagtgctaaatatcacactgttaggtattttcagttttatttttgaggacttttcagaaagaagtgagaaaggcttctactacttcttaaaatctcattctcatagtcactaccctatagattctgaacaatgcatattagaatcacatggataacttctagaaaactacctccataagaaattctgatttcatttgtctgaagtgaggcctgataatccacatcttaacatgcatcccaataatcactttcatttccccacatgaattctttttcttcaccaccatgaaaatacacaattgttcttaaaactgatataatacatttttgagcatttgtctatatttggtgagagagaatagatactaatgaaacaagattcctgctctcaaaaagctcccagacttggagttttctgaaatgtatgacgtaaatccaggctctgtagctatttatgctgtgtgaccctggacaggttgctcaatctctctgatccttggcaattaaactgcaaagggagaaagcaaatatttttcttcataaggttactagaagcattaaatgagataaagtgctcagtagaaagtaatgttgttcctattattcagtatttattatcaatttaatgtgcataacatacaattatatgcgatatatgcagtgcatgtacatatacatagttatgtatacataattgttgtgtgtatgtgtgtatacatacacacatacacattaaatatttgttactttcacacagagaaacatatgtgctggagtgacaagtagatttattacgaaaaaaaaagaaaaaagaaaaagaaaaaagatcagctaaatagtttttagcccagtaaaatacattggagtcactggtgagaagcgttgggggaaaaacacgtttgcttctttagttctgatagaatttaaacaatgcagcactgcatttttattcggggacaaacccacgcatttaatgtgctgctgccacctagtgcttagattcaataactactattttgctaggagtttctttcaatgtcaggtattcagggttggaaaacagcttggtatcttgttagttcttttgaaagagatcttaaatatggttgagatatgtttgtgttagtttattggttcgcatttctttttaaagtatgtaattttgaatagctgctggcttaagtggaatggtttattggcttcttgcttgtcatgtagctcatctttttgaaaggtgtcggagtgcctctgcaacatgaaatggtgtgcgtttccttaagtttgtatttaagcaagatatgctgctctgcaagtaaaaggaatgtagcactacgtctgctctatttgcactgttattatgttatagtaaaatgttatattgtgagtcttgcatgttaattaagctcatggtagtaaaagtgacaccaaaaggagaggccaagagacatgagaaacaagaaattatcactgagatttagaatatgaagaaaatatgtttttcttcctttgacaggaaaagtttcagtatgatttgacttcttcatatgaacaatcatatgatatagaataggatttttcaaactcaggctcttgatattttgaatgagatgattccttgtttggggcctggggctatcctgtgtattgtaggagatttcactgggttgctggcctttacccattagatgccagtgtaagcacttgtatccctgcccctacttgtgagaaccaaaaaggtctgcagaaattgtcaaatgtctcatgggttgagaaccactgatagaaaaagcacactatggtaattacagatcaaaagtgatttttatatttttaattaatctagggtttgtactaattggggacagagcttatgtgatgcttcatgaattgccagcaaattcaagctatttaattacttattccctcatttatatatttgagagagacaacatcgtataatagtcagtagtataagtttgaatctcaattctgccacttactaaattttgtgattaaataatttactatctctattaatactaaaatctaaaattccattttcttcaaccataaactggagataattattgtatttccttcacaaaataagtataaaaattaaatgagatattgcatttaaagtccatatcacagtgtctaccaattaggtaattactcagtaattattaattatcatttaatagatattttaaatccctctatgtgccaggaattgtggcaatcactagggaaatactgatgatttacccataatttcccaaagtagatcagtgtagtgggaaaagaattcaaatataattatatatataattatcttgatcattactgtaatagagaagaagtacaagatcctatgccatgtcattgttatcaggattgacactaatttgatggagatacttttgggaatcaattgctagtcagtagttaattggctgaagtagaaaaagttcaatttcctggggcagtatgcctagatttcatatatatatatatatatatatacacacacacacacacacacacacacacaaacacacacacacacataggcatacatacacatatacacatatatatgtacatatatatgtgtgtgtgtgtatgtgtgtgtatctcatatgagatatatatatatatatatatatatatatattcttttttttttttttttttttttgaggcagagtcttgctctgtcgcccaggctgaagtgcagtggcgtgatctcggctcactgcaagctccacctaccgggttcacgccattctcctgcctcagcctcccgagtagctgggactacaggcgcccgccaccatacccggctagtttttttgtattttttttagtagagacggggtttcaccgcgttaaccagaatggtcgcgatctcctgacctcatgatccgcccgccttggcctcccaaagtcccgggattagaggcgtgagccaccgcgcccggccatgatatgtatttttaatgtagtctttgaaactagcagaaaagaaatatatatctctctatatagagagatatacggatatatattttacttcagaatgctgaccgagttataaaacaagtaaatggttccttataacacattagctatgagaaagtatgtttatttttctaacatggtatgatacataaacatggctctccgggtctgttctggaagtcattagaaagagacaacatatttggtaagcacattttccttctgtctcccttttctcctctgttaaatgggttatgtgtacccctacctactctacctacctaacacatgttacagccaatggcatgatctccatctgtgaatcagcagtgcatcccggaaaaaagagagcaaaaatctggtgggaaattggatgagagtgaggtaattggaacactgagagaaggattctaacatccacaccacccctggtgcagtcaaccctctttagcctggaccactgcaatagcgttcagacgggcctctcctatccctctcgcatttgtgtataacaaacctgcacgttgtgcacatgtaccctaaaacttaaagtataataaaaaaaatagtgaactactcagtgctgtgtacagagccatgctgctttacatttctgtccctctgcacctgatttccctcagatggaaagcatttttatactttttcatccaacaatgtcctacttttctttgatgctcatatcatttcctccaatgaggacactttcacaaaacctattgccctcaaagactcggctgaaagtatcctcaatgttttcttcttctctattttttttttttttttttgacagagtctcgctcagtcaccaggttatttttggtagagacagggtttcaccatgttggccaggctggtctcgaagtcctgccctcaagtgatccgcccatcttggcctcccaaagtgctgggattacaggcgtgagccaccacacccagctttcagtatgttttcttagcatcctttattagaataagcttaacaaagatatattattaaatatagatagataatatagattattaaaattgcattgtaataagaaatttgaaatgtagcatatgcagagaagacctgttttttgcttcagagtgtcaaagataattgggaaataaaacagctatataaatggacatcagaggagaaataaaaataacactgagagcatagataacaaaaccacaaaggtgaagaaattctagcaaaaatagctgctatcagagatcaaatactcaaaatgaaaaagaatagattaggcaagattaaatccccttcctgaagacctgtttgggtaatggatagacagagaagaaaaaaatggtaaatttgagatttgagaatgaatttatggtgaagatactgagtgactggataatggaatttcttgtgaaactgagttaaagatctagaaaaggtgtagaggggatgggggtgtctctaaatggagaaatagacaaaaataaaatataaagggagaggcaagccttttaggtgctgacatcagacatcagagattaccaccaggtccatggtgtagatggatagcacatctcagtttgcaggtctcagtgctgaggtcttcaagatctgacagacatgcttttcgcaactacttttagaagttaatgggccaaagatggaatatccatttccattaaagtgtatgtgttaatcataatatacaggaaaagaaagaggaaagatcttaaaatctggaggccactaatgtgactttaacattaattaattttctttttctgatctcactataataaactggctagatactagggagaatgaatcacaaagtggcagaaaagagatatgggtgaacttaaaagatattggaaccaagaaaagagggcttttaagacaaatgaaggaatgaacagaatcagaatgagttacactattgccagctttgcctccctacacatatactatagataaggcgatgacttcatgaaaccaaagtgttggcaacttaggaatggttctgtatatgaggcccttctacaaacaagcacatcactggaggctgagctgaattgaaaacaattaggaaatataagttagacttatcaatgaggagtgaatattggtgttcctttaacatcattttttagcttaaaatacaaaaggcacaggaaggtgtttatcagaaaactcatagtttctcactgacatgaagtgatatggatatgcaggtaagattctgaaatactaaagatatttgtgcaagcaggaacatatcattgcacacagtgggttactggagaaagaaaaggaagtggctgagggatccacatagctgaagatttgtgccatagtttgtcataagaaaacacatatcatttgagagaggtggactaaacaaatagaaagtagttctagtatgccagctgggccctaattagataaacaacatccctctaacaacagttgaaggaaaaaagacatgggaatgggatggatatatattttttatatcagatgggaataatttatacacatttttctctactacctgtgtgcatctaacagacctgtgcacacacatatgaaagactttaggaaatcatgagaaaaattatagaaatgagagaatagaaatataaaattgtggaaatataaaaatagaagttgaactggtgacaatttttagtgtaaactttgaaaggaataaagttactagaatttctagaggcaaaagtaaatttaagagcaaagagtcaacatgggagctttgggagtttatgtctaaaaactggctgaatttcagcaggcagtttgtagtgataagttcctagggcattcgttatgtatggcttttataaacagcgtttgtgtcatcctccctacagagacctctgggtggccccatggaacaataggctcatttatgagtcagcatgtgaccagctctgaagcaagggtggatagacatagtcagtgatgaattgtttaattcttctggacttcatctttaagaagactgaaaaatttggaagtgagctccaagcttcacctactcatattggaaaatgagtgatgggatcagaatattcagtaaaggaagactttggaattcagaataggtcaaacaatttaaaagacataacaaagatgatatgtatggaagacaaaaacagggattacaaagaggccatggctgagcatggtggctcagcctgtaatcccagcactttgagaggccaaggtgggtggatcacctgaggtcaggagttcaacaccagcctgaccaacatggtgaaaccccatctctactaaaaatataaaagttagtcaggtgtggtgccacacacctgtaatcccagctactagagagcctgaggcgggagaattgcttgaacccaggaggcagagattgcagtgaactgagatcgtgccactgcactccagcctggatgacaagagtgaaactccatctcaaaaaaaataaataaattaaaaattaaaaaaattttaaaaagaacataattacaaaagtgagttttacgtatagataatgaaattggtttataattttcttctatgttcattaactgttcagatagtaggaaaactttatgaacattaaagctttgaaagaagtcaactagtatagtctgggcaaaaaatgattgagaaacacagagttaaagaaagaagaagactttgtgccccagagaaaatgtttggagcctattagatttatagagaacacaatgatgaagctatggaaagtgtgaagagaaataggaagaacagggaatgatgatcttggggagaaagtttctgagagagaaatatgaaggcttataattattcagaagtatgttatagaaaggggaagataaaacaaaggaaaagcaatataaatagcaaagctttgagtcctaattcagtcatggccttgtctgaggatattatgatggttgtgttttgtgatcagaggagttcaaataatgtgtaatatgaaaatagtttaaaaagtaacattaaaggataaagtgaaatggtacaagagaggattttgtaaccataaagtacaattaaaatgttaggaaatggatttgaaattcagtggctagattgtgcctaaggtcagaagactgttccattatctgctactcctgaagtatggtgggggaggggaataagatcattattcatccttacttttgtaacgatttcagataaaattacatctttatatagtgaattgtatgacagcatgccagctagtctacaaaacaagaataagatcttcacagtaataaaacaattttttttttttttagtgaagaaaacattttcttatgtagatattttggaaatatttctgtcttcttgcttttttttaagcagctgagctgggcattttaaacctaattttatttttatgaagaaatacatatacattgttaataaaatggtgctgtaagacttatgccctcaaaacagcaaacctgctcctcctttcttacccctttccactcttattttccctccctagttctccccagaggcagctgttatcactgtttcttcttgtatttatctccaagcttctaaattatttaattatgctgctttatcttagttttaaattttagatattttctgtggcatattcatgaattcagtgtagcaggagtaggaagatgacgatctagccatcttttctctccccttcccccactcaccacacatattacacttcctttctttctatttgctcaacatcattagccatgccataacactggtcaaatcattattcagcatttattttataatgatcatgtaaatattatagtgcaccatgattacttttcctttttgcaataatttcaatttttctggaagtcagtaatgcttcattgtgttgtcctaagtatgatgaaaaggcccttaccaggtccccttagagaagggtaaaaccctcacaataatgtcacaggcaaacatgccagtgaatttatccgtttgatttctggccccctacatttccctagccaggtctgtctcacagtgtcaccctgaaacttctctaccttgttctgttggatccactatttactggatcagagtcttgtgtagattactccctcaatttccagagctcatcctgagaaaatcagtaattcattcatccaacatatatttattcaacatctattatgaaacaaaaagggttctaggaaataaggatgtatcagggaacaaaacaggagatccatgactctctaaaggacttcatatttatgtgtgtagtgtgtagcctagccatatacaatacagagtgctctattccatttgaacttcagacaatgaatacttttcagtaggaatattttctaaatattgtaaaggatatacttatactaagaaaatgttcattgtttatctggattccaatttgactgtgtgtcctggtatttttatatgctaaatatgacaaccctagctgggagggattagactgtaccagaaaacctaggtaaataaatagcatggtagagagtggtaaatgccatgctgcgatggggaaagagaagcagaacagggtaaggcagattgggagtaccaggaggagggatagcaatttttacagggtgattaggataagcctcattgagaagatgagatattagcaagggcatgaaggaggtgaggtgtttactctgaggttatctgggaggaaagattctagacagaaagaacaccaagtgaagaatatctagagtggatctgagtgtttgggaaatagggacaccagtgtggctgtcacagagcatttgaaggatgcagtggtaggagatgaagttagagaagtaacaggagtccagatcctctaggaaacttaggctattgggatagctctgtagtttacacccagggaaatggggagccatgcagggttttgaagagttatggcatgaggtgacttctattttaacaagatctctctagttgctccattgagaaaacactgggtggcaaaagtgaaagctcaaagaccaatttgaaaactgttaaaataatctgggtgagatcaaaaaattttggactaaggagctagtagtgaagatggtgagaacagattgcattttagatgtatttttcctccaatattttactgtgaaaattttcatacacatagagatggtaatacccatgtaactcccaaatagattctgcaatgaaattttcgctgtatttgctttatcatatatttttccttctctccatcctctggctgagtcatctgccagtcagacatttctgtttctgcagagataaaccttcagtctcctgctgtgatgacacagtcactggcattggaaatctggggtggggacatagtaattctgggtgctaaccaatccttataccaattttcaacccattctcctttattaaactgcatttttctcctcacctgatggaggtacctggtgattctaaagcccacattttctatagtttccaggcattgtttggcttgcttctttttgacagctgccatttcaagctttagttccacctctgtcactcttagttacaactcatttgttttccaacttctaaaaatgtattgctctttcttctctatcattttatcctctcaacttcccttatcctttgactttgtaacatttttctttccctttcatttgagtagggttttaaaaggaaggaggcccatattttcaaatattttaccaatagaaagaactgaatgtatttagtaatacttatttttccattttaatgtcaatatactaaagatacattaaaaccagtagcaaagtaatagtttttcagagtatctaggttactattttgttgccttttaagactcaaggggacatcagtttggaaaccattgttgtgtatcatcatcatggagtgttaaactttggctctcccagtgcttacttattctagcctgtttgttggattttggtattagtgtttagaagagataatggaattcagattgaatcaggcaaatgtggccctgtctgcttagtagagggaatggtttttctttgctccatggagcccagcttcccttcctaaataggttattatatctgtggagtggataaattctaatttcactctggtatagaccagctacaaatccttcctctgacaccaacattttctatctcattgctttcactatgctgactgttctgtaaaatatttattatgactttgtcttctctgtctgaaatggtgccatacactggtaattagatggagactaagccttcttaatttcatttggtgcagggctgggaaaatggagcccttacataacaacgagatgaggactgaccggcagttggcgttaagtgctcctacacatatttccaagcagatgcaaatggaacttttcaccagtccatcatcatatgtcacttgcttgctgcttttcccatgtttgcttccagaaagaggctacttgacagtcatttgtctctacaatgagcctactttatgaagctgaattccctcccccaccagagggaaacaattacagcaggccaggaacttttttctgttcagttccaatagtcagaatatttctgacccaaggccctgtccatgttgggagattggttctcaacatctagggcactatagtagttcacccttcaaataaagatttgaggattacatctttatgtatgtatgatttatcactggagacaatgtctcacaactgggcatcagaagactagtgcactgtgtgtccttgagctacccacttaaccactatttctctatccagataatggtaacattaatacttgcctactgagccactgggtagttatgataacaaaattaaataggaggaagtactatcaggattttaataagatttcatttttgaatgtgagctcaagggctaagcacgctggctgctgctaactttcagcatttttgtatggctaaaacaatgaggctcagattcataaattgttccaagcatgtaaagcaccttctttattgtggttttggggttcattcccagttgggcaatatgatcatcagcaaggacttcataaaatggcaatatgtatccctaaagaaaagaggtgttgcctgtggaaagacctttaaaaactcaggtgactgtacccttggcaaagtcactttaggatgtatagttgagtggtaatgagtattatctgaatcctaagagattttcaaatctgaacttcgttgcttcttagctaggtgaccttgggcaattcacttaaccttgtcgagccactgttttctcatttttaaatatgaacataatgcaaaccacttagagttgctccaaggattaaatgaaataaaacctgtaagaaccttatcattatcagtggcagcagcagcagcacaacattattatttaaaaataacaatagcaggctatttattattgagtctacaccatgttccaggcactgtttctacatgcttacacatattaatatctgtgtttgaacaactatgggaggaaggaattactatagtcattattttgcagatgagaaactgagacacagattaaagaaatttattctggtcatacagcaagttggcagcctgataaaggaaaaacaaataggagcttctgctctgtttactgttatttatctctctgaagttttatctaagaaaagggtataataagctaaaggactattgggaagttaaaatgagatagtaaataagataataaataagaaaaaaatgcttgtaaagagtaaaacggtaattccagaagcttgtttatttgggctgtgattaacaatttgtaatcgcacgtaactagagaagttgaaatgaattccccacctttggcaaggacgtctttaagtgtcatttgttattagtagtgcctcagtttgccctgctaacaggtgatcttatcagttatcttgaaaatgctagaatcaagctttcaacatggcaaactatccatggaacacctgctgtctcactcctccatgtgtcaaggtacctcagggagatagctgaattcccaatcacccaattttgagcatatgccatttcagaataatattagacaatgacagagtctgttgtcctataaattaatttaacacttttcctctggagagcagatgactgcattctaaaaacaatattttctctcgagttatgatggcttgtaaaaacacacagtgaatggagttgacaggaaggtgttgggaagcatatgatatcccagggggctgaacagatctaaatttaggtgggttgtctctactaggcagttggtgtcagataccattgcctcttaaaaggatgacttcagtgaagagcagttaacagattgtgcagaaacataagcctctgtggtccattaagtggggaatcatttaatgagacccagagttgcactgagggaaccatggcacttaagcattaaaagacagaaaaggaaggggtgaaaattttatgaagcaatttattactgctgtaaaccatgtattttaaaaaatgcattccaggtataataagaacttgtgaatgaagatcatgaagagaataatgtacttaattcactatggattctgtcatgatatttgtttcttctctttttgcttcccttttccccatttcttcttcttctgtttctctcttgattctcaatacaatctcccactttcttatgcaattcctgttatagcttcaatttttgacccacgtctatctttctctcaaagaaattctctaagcaaaaattggtctgaattatcattcacacagatttttttcagactcctctttctaaataagggcataaaccattttacctttctctttctcctatcttttcctaaataagcaatgcagatataatttataaaggtagtgttgcttggaatggggcattagtaagtattagttttgttcatccagtcgtttaacatgcatttattcatttaatattcatctaataaacattgtgtgcccggcactgtgctaggcacccagggtatgaaatttagcaaggaataaccttgcctgccactcaacaaatatttgttgaatgatcaaaggaagggattcactttaattcacctagtgaatggggaacaattctctgcatgtataaaggcaggaaactttcttgggattttaaggagttcacaatatctatggagtgagtaatttgttgagtgggcctgggctcagaaggtaggactacatgcagtatagtacagttgtgcagtgcacatcctgaacagtcatacatgataactctagcatagtaagaaagaatgtgggaaaagaaaatagtagctgggctataaagtgctttgcgagccaggttacttgttcttatggagggatgagggtagaagtaaaagagaaggtatcagaattgctgtcaaattttccacattatgtatgcttctgaccaccatggggatgctgatgtcctccccttacccctactactttcccaggatcttcgccacattgccaatttactgtaagtcatatttctcaggtgagctgtagctaagaatgtctgagaaacactagacaatggagagccctcacaggtttttaagaaggcggtagcatgttcagattttcctttgaggaagattactgtggctctggagtagacggtggactagtgaagagtgagagatgaggagacatcctgctgaaaagcgttcatgtcctcaaggtctaatgacatctgtgttcagagcacttgacagatactcctgctgccctcagttttcagggccaccagcacaatattagagacagaatgaaacagatttgtcactgtcatcctgagagggcgatgacacctgacacatttcatacgaattacgatttcaaacagacagggacattcaagcagatctatgctggggaattaaataaagctataaaatataaacatgaacttttaatttaaaattctcattgaaaagacatttcctgttgggtagtttttatttttgttagtggttttgcttgtttgttgtttatgtaatatagctaggatatatacagcttggttatcttaaaaaacaagtacattaccaataaatgcatatttttttctggctctcctatgtggccattactttttcatttagtaaaacatatgattttctgtgatctacatgaatgtagactttaccttttcaatgaaaagcgagttgatatatttgtttctaaacacaaatgttcccaagaaaaaggaaaagacattcttctttttttattgctttaagttcttacctccatataatgtgattccagcctgtcttgctaaactacataactaagagacaggggaaaaaaaactcctttctgaaatcctgttatcacatatcatagaagccagagcactagaccccttgatactgcagtgacctccccaagacccacaggaagctgctgactgatcatttctacaacttacgaaattttcattatgttctaagttaacatgggaaagttaacttatttcatttcaacttatttttcccctttggattaagtatctggatgagctaagaaacttgattggggtgggggcatgggatagtttttttttttattatttaatgttaggaaaataaaattaaaaggtctcaaaaatgtgtattcaattcagtaaaacatagatagtgacttacgtgacatgatgtaataaatcactgctgtatcaatatattaaatgatacacggaccattaaatattgcattcattattaggaaaataatttttgaaataacacagctccttaattctaaggtcatatgctagatggggaataaagatgtggtttctagcctggctctggtgaaccacctatgtgacctctcagactgtgcatctgtgcaacattgccagtgacctcgatgtttctttttaatcctcttaatttcaacagggcatattcgtagattacttggcacatagtaagcactctactattgtatgactctatgtcattcaaggaaacactttccctcttactgtcacatatgaagaggttttctaattaaaacacataattaagcatcacagtaagacaaagtcatgaaacaaaatgctcttgattaagaatgggagtgtttcttctcattactgagagaaaatataaaaaaaaaagcaaaaagacaactttgagacatattgattctttcctcttgacaaggaatgtgtatcattaatagaaacaaagaaatgatttacagtgtttgcaacagcctgagtatgcttatagagcttcattagggacactgggataaaagctgagataatttccaaccatcattctgagcaaactatcacaaggacagaaaaccaaacactgcatgttctcactcacaggtgggaattgaacaatgagaacgcttggacacagggtggggaacatcacacatgggggcctgttgtggggtggagggaggagggagggatagcattaggagatatacctaatgtaaatggggagttaatgggtgcagcacaccaacatggcacatgtatacatatgtaacaaccctgcaggttgtgcacatgtaccctagaacttaaagtattaaaaaaaaaaaaaacccaagctgagctaagattttggtcacggtcttttttttcccccttcagaattgagaaatgttgcttaagtcagtaatggatcgccttgactttgctatgatcagaggcacagtaaggaatgaagccaattgttaaaaatgatgacagccataataaaacctaacatgcaaaaactactgctttgcaacttatagtgttggaggctatttgtagcaactcttttatttcttatcaacaacaaaaataaagaaaaataacaaacaccaacataggactaaatactcgatattcaatatagtcatgtactctataacaatgtttcagtcaataagaatggttctgtaagattttaatacagatttttactgtactttttctatgtttggatatcttcagatacacaaatacttaccatgtgttataattgcctatgtattcagtacagtaatttgctgtacgggtttgtagcctggaagcaacaggctatcttatgtagcttaggtgtgtagaaggctgtgccatctcgttttgtgtaagtacactctatgatgttcacacagtggtgaaattgcctaacacacattctcagaatgtgttctcattgttacgtgttgcacaaccattcctcaattgacatatgcattgatgctactggtcaagagccgctaccttttagaatgaagaacacaaagttcaactctgtgaagcattaaaataaaaaaccagtgagatatacactggacagaaatcaaagccccttcttacttatgccaacagataactagtgtattccgtcgtgttacctcactagacacgttttcttctgaaataattagggctacttgaggataatcttctgaaattaaatttaatgtttatttaagatttgttaggacataagcctatgaatcattttaaatgagcacagttaatctgcttacactacttactacttctgatattagtgatatcttgcctgtgctgaattatcacagataagtaaccaagcatgggtgaaaaccaaaatctagcactttgcagaatatgtgggtatgttttaatggaataaaggattcttgtcccagttctgctactgatttgttgtgtgatcctgcctaagttgcttaacttctcagagcatcagtattcctatctataaaaggagtaatactgataatgacattatagattagataaagtaggtacaacctgtggaagtatcaaatgaaaagaagtattatatgataacagtattgaccctgttctgagtttgcatatatgagattccaaaaatgaagactacatcatccctctcttcagagagctcacatattctgaaaagggacatacaggtaaatcagcaattgcaatattgtgggattcatgtaactgtgaaatcatgtataaactaaacagtacacagcaaggaagggttcacttatctggggaaggagatgaacatggaagattttccatattctgaaaagggacatacaggtaaatcagcaattgcaatattgtgagatgcatgtaacagtgaaatcacctggaaactaaacagtacacagaaaggaaggattcacttatctggggaaggagatgaccatggaagattttccagttgggggtgatgttttgaacatcagggaagaagcaagggctagagttataatttgggaaacaaaagtaggtggtagtgaaaaccatgaggttacaaacagagaatggttagagtcagaaaagcagtagacaaaggacagaatatgttagaatggcaaaacttaacaatgtagaagaaatgtaacctatcaaggaggcagagaaagaacaatgagataggtagcaggcaattcaggagacagacttgtcacaggtagtcaagaagtggggagtttcaaggaaggagtgggcaatatcattagataccttgcttgacaaagttatcatgaaaaataaagtttaaggaccatatattgtatttgatacattagaagccgtctggcttcctttctctgtgcagtcagttaagaggtagagggcagaagcaaagtgtactgtaggttgtaccgtgatgagcaagtgaagacaccaagtgtgaatgtaactatcaagaaggtcagatgtaaggagaaagtatgaaagtaagagtggaaattaatgagagttagaacatagtgggaggaattgaacttggacaggagaacttctgagataagaaaggtggagtaaatgataagtgtagattcaggtatattggccagtagaggtgtcaagagaggatgcatgcttgataaaggtgaagtcattggtaggctgatggagggtggggacaagtagtgtgtttgagaataatagataaaaatgggaaatggagctgaccaaaactaaaaggatcacttaattgcaattggcctgatgtcactaatctgtgagatggaagagttcttggatgaagtatataatcttccttctaaaccagctcagcatctgtgctggaaaagctcattgtagtgcaagcattctagggaaagggagggaagagtttaaataataatagcaggctgatttgcttttaggttaaacagtgggagtttggtttatggagatggaggtgagtgttcaattttttttttttagatcggtcacataccagaaaagcatggaattttaatctctataatcagagctataaatctctatgacagtaatatcttttttaaaaaagaatttatatatgggtcctcttctatttacatatgtatttgtttaaattgacagataaaattatatgtattcatcatgtataacgtaaagttttaaagtacatatgcattgtggaatcactaaatagagctgattaacaaatgtattacctacatagttatcatttttgtggcaagaactcttaacatccactctttttgcatttttttaattaaggaagaatacaatatatcattcttaactatagtcaccatgcagtacaacaaatcttttgaacttattcctcctatctttctgtaattatatatcctttgactaacaccttcctatcaccctcacccaccaaccacttctgcttctagtaaccaccattcttttctctacttctatgagatcaacatctttagattccacatatgagtgaaattgttgcagaaaaggggtctggatccagacaccaagagtggattcttggataagtccacagagtaaagtgaaagcaagtatgttaagaaagtaaagaaataaaagaatggctactccataaacaaaacatccctgagtgctgttggttgcccatattctgattatttcttgatgaaatgctaaacaaggggtagactattcatgcctcccccttttggaccatatagggtaacttcctgatgttgccatggcatctgtaaaatgtcatggcactggtgggagtgtccagtgaggatgaccagaggtcactctcatcgccagcttggttttgatgggttttggctggcttctttactgcaacctgttgtatcagcaaggtttttatgagctgtgtcttgtgctgaccttatcctatatctgatcctatgacttatcctgtgaaatatctcattctatgacttagaatgccttaaccatctgggaatgcagcccagtaggtctcagcctcattttaccaagcccctattcaagatggagttgctctcattcacatgcctccgacaaaatcatatggtatttttatctttctgtgcctggcttctttcatgtaccacaatgtcctctgggttcattctcgttgttgcaaacaacaggattttcttctgtattatggctgagtagtattccattatgtatataaaccacattttctctgcccattcatccattaacggacatgtaggttgacgccatatcttggctattgtgaatagtgctgcagtaaacctgggagtgcagatatctgcactttgatatactgatttcatttcgcttgtatatatacctagtggtggaattgctggatcacatggtacctttatttttaatattttgaggaatctttatgctgttttccataatggctatactaacttgcatttccaccaataatgtgtaaaggttcccttttctccacattcttgccaacacttgttatcttttgtatgaccctaatatcttaatcccaagcttgaaaccttcaaacagcttagccactggctttcttagcaaattataggttactaattagcaaggtctaactgagacgtcagcaagaataactcagaattgaaaatctgtttactagagtatatccccagacagggccacctatttcatggagagaggttgtaaggtttgctgtggaaacctcataatattgacctaaaacccttccatctcccaagagtagccaaaatgaggcatgaggaaaggtaatggattccacaattactcctcatcaatatgaaatcaatattcttctttgaagatgtagaaagtcctttctgttttaagtattatgggtaagtacatgaatcatggatgcttacacccttgtcaaatacagcatcaaggaagcattcagtgaaaggcaatagtgtatttatgtatgttttcatttttttcagtgtagcttagaaacagaaaagcaaagaaaaaagaaaaaacgactccttcaaagcaagagagaagcattttacagttctgataaatttataaggacccaagctgcagagcactgactaggtccatagagaagatcaggaaaaatataaaactgtctttgcaataattggaaaatccaaacaaactactaaggctgatacctaggagaaatcttccaagagaaagaaacctctgatatctgattttactattagtaatgtcccattcttaaggtgtccgtataaggcagtgtctcacgtaagatgttttaaaggaagttgcatctgtttctaaaaggaaaacaattctctaattttgtggaacatgtttttaaaatgtagctataaattgtctgttcattatttcctttaaaagcctgggagtggaaggaggtcagctcacgcctttggagaaaaacacctctccagttactgcctacagaacaacagtcaaagggaaattgttaccaatacaccagcagtttggtctttgtcctattgctctctgcgtggaaagtcaatcactaggcaatgagtgttgccaggaaagaaggctttttcaggtgctgcagcctgtaataggagatcagtcccaaatccatctcaactgactaaaattaggggtttatatagcagagaagaaatataactatgtgtaggaaaacaggaattagggatgggcaaggaggagaagttggttacaagaagcaggtggtcccttaggcaatcatgatgggtgaggggtctggctcccatggtgcagatgtgatgatctggtaagtttcagttgcttgacactgtctgggagtcctgatgattgattttctgagaaaagaactcagataagacagttttaactttctcaaattttaagactgggagggtcaatgtctatgtttattcaaaagaaatcataaacatcagttctatgggacacttgggcaagtttcaaaaggatgagataatctcatgaaaaacctagattcgggtttcaaaatgagaaaacagcaaatatatccctccgcctcacaatcacacaaaatcaatcaacaaagatgtatgcctcctccaactatagctcttatcaaaggaaccttcacatgataaagctagactttggagatagatgttattcacaaaaatacaattatgtccattagactcctcttacaaaggcaggaaagtaaacctagatacattgtaaaagtatttcctgctaatcctcccctattgactgtggtaagaatattggactgaaaccaacatctgcagtagaaaggatgtggaagaggaagtgagcagaaatttaattcctgtattattcatattcagtatgggactctgtttcatgctgtatccactttgcaaagtactatggattcattaagaaattagcaaactgaatatgtgcctaaatggccagcatactccaggctgaaaagtgtttctgtcactgcttcctagaattgtttaaaaactgttgtgactggtggttctttctggttgaaatggcctgctcacaaacactgaattagacttgggcattttgccaggggcattgataccaagaatgtttggaggcaagtcttaaatgtaatttgcagagctaggaggtgccagaacttcaaaataggcaaagttgctctctcgaacagtggtagaaagaatcaaagtgttattctgacactggccttggcagtttttgtcccagtgacttcaaattttggaagctggcagtaagacacatgcagaaacttgtgggaatatgaatatgtggatgaaattataaaagccctagtgattttatttctttagtgaaagctgtcatgagtaaaggactagactggagtcaggtgctaagaatctggctccagtccaacctgactccagtcaggttcttgttttacagaggcgtacactgagaaccagatctttgatttgatttgcttgggtcctaaaatctggttctcagtgtctacatatgtaaaacaacatggtactgtgaccgaaacaccatgggttagatcctcttgcttgctacatagaaagctaatcactaagacaatgagtattgccagggaaggaggctttatttgggtgctgcaaccaagaagaacaaatcagtctcgaattcatttcaccaatcaattaaaattcagggtttctataatggggaaggaatgtagctacatgtaggaaaacaggaattttagggaggggcaaggagtctggcatttaattgtctggtgtcatctgttccttgcctaaaggtcagtttgctgaggaagaaactcagataagaccaatttaagtttcaagtttaagacaagggagggtcaatttccatatttatttattattattattatcattattatttgagatggagtctcactctgtcacccaggctggagtgcagtggcacgatctcagctcactgccacctctgcctcccaggttcaagcaattctcctgtctcagcctcccgagtagctgagactacaggcgcctgccaccatgcccagctaattttttttttttttttttcagtagagatggggtttcaccatattggtcaggatggtctcaaactcctgacctcaggtgatccacccacctcggcctcccaaagtgttgagattacaggcatgagccaccacgcccgaccatatttatttttaaaagtaaatattagttctatgcgacacttgagccaatttcagtactactgggagggccaggaaaggcaaagtagttacaagctaaatcctctttttatctgctttatatttcaggggttctcattgagattttgtttaatgagtatgttctgatgctaaaataagtttgaagacttccagctggaagatgtgttctaaggtccttttgttactgaaatgtcagaggttctgtctaggtcctgctgctcactgcatagaacgccagtcactgaaacattgagtatttccaggggaaaaagctttattcgggtgctgcagccaaggagctaggtgatcagtctcaaatccatctacctaatagactaaaattaagggtttatatagcagggaagaaatgtagccatgaaaacaggaattagggaagggtaaggaagaggaattggtcaacaggaagcacatggtctattaggcgatcacaacagatgaggggtctcatgtctcattgtccagatgcggtgttctggtaagtttcagctccttgatactatctgggaggcctgatggttggtttcctgagaagggaactcaaataagacaactgtaattttcccaaattttaagactgggagggtcaatttctatatttattcaaaagaaaccacaaacatcatttctatgggacagtagtgctggtttcactttctgttctaaatttctcatactctaaatgagaataaccagtagaaatacatttaattcttataaatcaaatagctttaattactatttttcattaaatttttattagttggtacaatatttgattttgaaaactgcttcatgtcaaccacataaatgaagttctgtgaaacccccaaatacacatggagaaattttagatacaggcatatagaaagcaggtccaaaacctttatcaaaacctacatgaaagtggtaagaacaagtggtaagaatacaagtcatctcccactggctgggagtcaaaaaaaaagtctagatctcaagctgacgccaagtaagaagaattgaaacagattttataggctctatgatgtgacttcccagactttctctcacaatcacatcctcttcccaacattacagtgcccgtatgtatccataacattttgggcaggagagggagtcagcagggtctttgatgatcatgcaacattacctcttaatattaaattttctgatatttgcaagaagccgatgacaaattatttggttttccatgtcaaacctccatgatatattttactagatacaaagaatcatgcattcttcacatttaaatcaataaccttgttaagttggagctctagatggctcctgggcctaggggtaagttgtttgttttaaaagacatattctacgataattaggaagaaaaagaataaagaaaaacataaatgtttgcctattcaaaaacaccttgccttcaagggctcagacaatgactggggaaaactccaataatttttttagtgcactttcaatgttattttgtattgagtatttgtctgactcttagcattgtaattcagtagcagacatttccatggtccttaaaatcctgattcagaggggaataacccactgggaaaaatggagcactaagctgagtcagtaggcaggaaccagaggcagtaataagaactgtaatagaagatcagatgtcagagagaagcctccagacacattaaaccaaagaattatacgtaggtgctggttcccatagcacagcaaagctgggttctggagatgtttattcttatcacttccacagaaaaaaaacaggacttctttcatagactatatgctaactcagacattttgcaccaagtagaaaaacaatgggtcatgaaatacaaaccaaaacactaatttcactagaaccaggggttgattcaaggtactgtaagaattctcggaatttaacacttttgatattttttcatttcagatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgctttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtctctaaatcaatgcctcattctgaaatcaagttaattttcaaatggcaactttctccaacagttataagaagaatcaaattagggctccctggcacttcttcactttgggagatgagtgatggtggtgttagttttccttagcagagagttcaggttttattataagtgctgctctcagtataaaaaggatagaaaattaatttttcatgtattcatttttcaacatcaacaaaagaatccacctttcttgctccaaaaagtcaggaaggaagaatatttgtcacatgacaaatttagtcaaaatatacataatgtgttaattgagaagttcttaaataacatgcatggcataattttgtagtgctggaagtgatgataatcatttgggggagagaaagtcagtgaaacctaaaaaaaataaatcgattaaaaaaaaaaaccctgagatgttgtaggagatagtcaccttggtgcagtgaataattctaatatattttaaaatataatgttgagtgataaagattaagatctttaaattacctaatactgacactgagtttctttgtatagttaatgacaatatttccatcaacattttctcctgtgcctaaatttgttccataagcgtatttatatccttaataatataattccactgcctgtctctaaaacaaaaattaaagataatagtcaacttcattaaagaagtgtagcttaacaaaagtaatattaacctctttatcttttgcattagtagttatctattgctgcattaaattgccacaaacttggtagctgaataagcatgtttattatctcacatttctgcagtcattcaacatggtttcaataggctaaaatcagagtgtcaccaaggctgttttccttcctgaagagtctaggggagcatccatttcctttccttttccatcttctagaggccacctgcattcctaagctccatgatttccttcctccatcttcaaaatcagcaatgtagcatctctatgacccgtcttctttcttcacatctctttctctcataggttggaaaggttttctgcttttaacaatcacatgattagcttggatctacctggataatctattttaaggtcactaacttgagcacatctaaagaatcgactttgccatgtaacaacatattcacagcttccagggattaggacatgaacatgtttggcagggagggaaggattatgatacccataccacatctaagatggtcttttaagtgtcactgaaaacatggtcacaactggcactggagtctagctgctagtcaatcggcaccaaccagggatgtgaaaaaaactgagactatattcagcctcttactcctcaactccttattgaagactggccaggacatagaccaagtaggttaatgtcaccttattctcagctagatgtaagatccaaagaaggacaatggagagatgggtccaatagccaatgaataaaggattaaaaagtctaaatagtctagaaatctggttgcaaacagagtggaaacatctcaaaccagaagttcaagtaaatagtaaaaaggccacagtgagaaataatatcaacacactgagcagactaggctgattctgaaattaggtgactcaatgctatcatattcagtgtctcctgatgtgggtggggacagaatagtacctacaggatacctggtaaaagtgcttgaatcagagacatataaggaatgatttcaggaacgctgggaggtgttcattttttattgttaagaaattacttggaggaactgttagctgtcttgtctacagattgttttgtactagcaaaaagaatagaagcagggagaaagagtagaaaactctggatcaccaaatgtagctcaaaggaaagaggaactttgttacaaaaatgatccaagacacaatgcccaccttataaggtacttgacactttgtcactgaaaagacaatatcgactagagttga
